United States Patent 8,344,211 (PLANT NUCLEOTIDE SEQUENCES AND CORRESPONDING POLYPEPTIDES) - sequence listing, part 14

SEQ ID NO: 52805 - DNA, 714 bp, Zea mays
  misc_feature: Ceres CLONE 1470445-F
  misc_feature: Encodes the peptide sequence at SEQ ID NO. 52806
  misc_feature (310)..(310): n is a, c, t, g, unknown, or other
  misc_feature (420)..(420): n is a, c, t, g, unknown, or other
aaagctggagctccccgcggtggcggccgctctagaactagtggatcccccgggctgcaggaattcgtctcacccctagaaaaagtcgtcgtcgcacggattggcattggatgccctccggccctgttcctcgtcctcctcatcaaatcgcgtctcctcaatcctcccaataatggtggagtagatgagaaatccttccgtccggccgtcatcttaaaatatgaactgttcgtcttgttgcgccgttgccgctccatcttctccggagcttctcgacaggccgatgtggggtttagctgctagctgctgnacgacgacagcaaatcatagagtgcttttcctgtgctcaaaacagtttacacggatcgagtatagtcgtgcgtcgtcacggctgtctcggagagagatatagctttaccngagcacgatcttgggacatgggcagaattatcaagaccctgtattccatcactgggcatcaaacttttcagaattggaaagtcttcctcacagtttcactggacttgcttccaaggaaacgccaagaatatgaaccatggaagggtgttggttactgaaaccaccgggggtttttccaccgggggtgactcctcggaaaaaagggggaacattttcagttttgttttaaaaattttaaaagggagggcccaatttggggccctatttctcctttttcttgggaaagataaaaaa

SEQ ID NO: 52806 - protein, 63 aa, Zea mays
  misc_feature: Ceres CLONE 1470445-F
  misc_feature (30)..(30): Xaa is any aa, unknown, or other
MNCSSCCAVAAPSSPELLDRPMWGLAASCXTTTANHRVLFLCSKQFTRIEYSRASSRLSRREI

SEQ ID NO: 52807 - DNA, 672 bp, Zea mays
  misc_feature: Ceres CLONE 1470447-F
  misc_feature: Encodes the peptide sequence at SEQ ID NO. 52808
  misc_feature (672)..(672): n is a, c, t, g, unknown, or other
tctgaactagtggatcccccgggctgcaggaattcgtctcacccctagaaaaaaaaaaaaaaaccctgcctaggacctcggcgccactcgccgcacgtcgtccacgtccgcctccaccccaatccgatggggtatgaagagagcaaaaaacatctcctcagtctcagctaccctgagctgcaatgtttgtgcaaaaggtataaccttcctgctaagaagacccactctcagttagcaagttcgctcgcctcgctgcttgaggcatctccatctcctgctcctcctcctgtccaattagcaaatatgaaagaagcatccacatgcaatcatgctaacaacaaaagaggcccatacaatggcagggatgatggtaaaccacttgtgcatgccaccccccaaaaaggagatcagacacctgttgatgaaacatctaaaaaggggattgacactggtacaagtatacttcctgtttctatgaaccatggaagaccagaatatcatggccttctatcttccgacctgaaacctgctcataatttacagtcccaaaagggacgtggggaactgcaactaaatacaacaaatcctagaaatttgttgggaaaacatgattgtttccccgggctaaagaaaatggacccaaatcctgttcctccttatttatccaaaaan

SEQ ID NO: 52808 - protein, 181 aa, Zea mays
  misc_feature: Ceres CLONE 1470447-F
MGYEESKKHLLSLSYPELQCLCKRYNLPAKKTHSQLASSLASLLEASPSPAPPPVQLANMKEASTCNHANNKRGPYNGRDDGKPLVHATPQKGDQTPVDETSKKGIDTGTSILPVSMNHGRPEYHGLLSSDLKPAHNLQSQKGRGELQLNTTNPRNLLGKHDCFPGLKKMDPNPVPPYLSK

SEQ ID NO: 52809 - DNA, 678 bp, Zea mays
  misc_feature: Ceres CLONE 1470453-F
  misc_feature: Encodes the peptide sequence at SEQ ID NO. 52810
  misc_feature (624)..(624): n is a, c, t, g, unknown, or other
agagctggagctccccgcggtggcggccgctctagaactagtggatcccccgggctgcaggaattcgtctcacccctagaaaaactccctccccttgcgtttagcctcccgctgttgtggagccgcgggccattcccaaccatcgttgcggtggtggccggtattggccgagacccatgggcatccaggtcgcggcggtcgtgatcccgccgccctgctcttctccttcctcctctccggcgtcgccttcgtcctcggccattgccacgtcgccgcagcatgccgttcttggcgccaggctggcgaggagccagtcgtcgctggcttgctggaacgccgccggtctcggccggcggcgcggcggggagcacacgatcaggcgcgctctcagcgcgagcatcgacagcgtcgggagccaccgcggggacgatgaggagttctcgaggaggatccaggagctcgcggtgggtcagcacccgggcgccggcggctgcgggtggccggcgagcgtggagcggagcgcgagcagcgtcgggctgccgctgtccctgcggatgctcaaacggaggaagcagcagcagctggagcaggggcggtgggacgaagcgctggtcaacagcgccngcgagtccgcgcgcgccgcggtggggcgcgccttctcctcgatggtgctcatca

SEQ ID NO: 52810 - protein, 167 aa, Zea mays
  misc_feature: Ceres CLONE 1470453-F
  misc_feature (150)..(150): Xaa is any aa, unknown, or other
MGIQVAAVVIPPPCSSPSSSPASPSSSAIATSPQHAVLGARLARSQSSLACWNAAGLGRRRGGEHTIRRALSASIDSVGSHRGDDEEFSRRIQELAVGQHPGAGGCGWPASVERSASSVGLPLSLRMLKRRKQQQLEQGRWDEALVNSAXESARAAVGRAFSSMVLI

SEQ ID NO: 52811 - DNA, 684 bp, Zea mays
  misc_feature: Ceres CLONE 1470457-F
  misc_feature: Encodes the peptide sequence at SEQ ID NO. 52812
  misc_feature (261)..(261): n is a, c, t, g, unknown, or other
  misc_feature (591)..(591): n is a, c, t, g, unknown, or other
aaagctggagctccccgcggtggcggccgctctagaactagtggatcccccgggctgcaggaattcgtctcacccctagaaaaaaagtttccccatacaccgagggaggaacacacaccgaggaggccgcagcagggcagagtacacccccgcgtttcgggaatggcagtgctgctgcgccccgcggcgatcgcaggcggccggcaggtgtggccggtggcggaggacgaggagggggcccgcgaggcggaggcgtcgtcncagcggctggtggaggcggtggcgcgcggcgacccgagggaggccggcgagctgctcgcggcggggcgcgcggacgtgaactacgccggagtggtgtggctcagggcgcgtcgcgtcgcggaggcggagccccgggaggacgccgccgccgaggcgcgggccctgcacgaggagatccgcgccgacgtctcgccgctcttcctcgcggccggcaacggggacgtcgcgctcgtccgcgccttgctcgcaaagggagcggacgtgaaacggcaggtgttccggggctacccgacgacggccgcggcacgggaagggtggcgcgaaagtgcngaactgcttgtgcgtgcgggcgcgtcgcagccgccctgcaaagagccgtcgtcgaggctgcgttgcagggacagggcggcctcgcgggcatct

SEQ ID NO: 52812 - protein, 174 aa, Zea mays
  misc_feature: Ceres CLONE 1470457-F
MAVLLRPAAIAGGRQVWPVAEDEEGAREAEASSQRLVEAVARGDPREAGELLAAGRADVNYAGVVWLRARRVAEAEPREDAAAEARALHEEIRADVSPLFLAAGNGDVALVRALLAKGADVKRQVFRGYPTTAAAREGWRESAELLVRAGASQPPCKEPSSRLRCRDRAASRAS

SEQ ID NO: 52813 - DNA, 718 bp, Zea mays
  misc_feature: Ceres CLONE 1470460-F
tccccgcggtggcggccgctctagaactagtggatcccccgggctgcaggaattcgtctcacccttagaaaaaacctcgccttcacctcagctcacggcctcacccgtccacccacccacccgcctcgcctccatccacagcgaccacgcccatcttggctctgtccgctcacccccacctctccgcccccgtctccgtccgcacccgtccgcctccgacttccccgtggcccaaccggatccggagccgaactcgaccttgttcaggaaggagagcccgaaccgcggcgggcgggagggctctttttagcttgccccgactgaggacagccgccccatgggccagtcgcctgagcgcgctacatataaaatcatcgaccggtgggaaaggcttgggtaaatcattaccccacccaccctcccttttacatgtaacctttgcatacaatacctgatcacaatgagttcacaaaaataaaggtgtttacaaatagcgtaaaatgcatgttcagttcttagctagggagagtcccatgaattgaatccccaatgggagcagaatttggaacccgccattatgtcaaacccattttttggcaaaatgggtaccgttctcgggatgagcacaaaaatttcgagggtgtttctctcggagaaaaaaacgatttttagataagggccttgaagcccttttaaaattccaaataaactcaagaat

SEQ ID NO: 52814 - DNA, 663 bp, Zea mays
  misc_feature: Ceres CLONE 1470908-F
  misc_feature: Encodes the peptide sequence at SEQ ID NO. 52815
  misc_feature (356)..(356): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (500)..(500): n is a, c, t, g, unknown, or other
  misc_feature (513)..(513): n is a, c, t, g, unknown, or other
  misc_feature (516)..(516): n is a, c, t, g, unknown, or other
  misc_feature (523)..(523): n is a, c, t, g, unknown, or other
  misc_feature (524)..(524): n is a, c, t, g, unknown, or other
  misc_feature (545)..(545): n is a, c, t, g, unknown, or other
  misc_feature (546)..(546): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (611)..(611): n is a, c, t, g, unknown, or other
  misc_feature (612)..(612): n is a, c, t, g, unknown, or other
  misc_feature (631)..(631): n is a, c, t, g, unknown, or other
  misc_feature (661)..(661): n is a, c, t, g, unknown, or other
agagctggagctccccgcggtggcggccgctctagaactagtggatcccccgggctgcaggaattcgtctcacccctagaaaaatattaggatttagattgcttgataaagcagctcagctatctgatggacctgttattttcacctttgccacccctgctcccctcacgtactataaaaacagccaagacattgaagtttggagcctgcttattggagtcccttcccaaacagatgaccaagagagcccaacctggaggctttgcttaagaggacccgtgtggatgccatagaccaccttatattcctcactacattactttgtcttcctgtgggcctatgtttttagccctggngcaaatgttctgaactatgtattgaaaggtcgcatttgaactgcatgtatttgcttgtttgaaactggatcagtttagtgttttgttgaacacttgtttctatatgccaccaaaaagccaggatatgttactnnnnnaaaaaanaaaaaaaaggggnganaaatggnngggaagggaaaggaaaggggnnagggnnnnntaaaannnnnggggggggggggnnnnnggtnnnnnnggggagggggggggggggtnnagaggggggtgggggtttnttaaagggggggagtgtgggagaatttttnga

SEQ ID NO: 52815 - protein, 47 aa, Zea mays
  misc_feature: Ceres CLONE 1470908-F
MDLLFSPLPPLLPSRTIKTAKTLKFGACLLESLPKQMTKRAQPGGFA

SEQ ID NO: 52816 - DNA, 646 bp, Zea mays
  misc_feature: Ceres CLONE 1470909-F
  misc_feature: Encodes the peptide sequence at SEQ ID NO. 52817
aaagctggagctccccgcggtggcggccgctctagaactagtggatcccccgggctgcaggaattcgtctcacccctagaaaaaagcagcagcagcacagtcatccacactaactacctaactcttgctccgatcacgatctacctgatgtctaccatggtggcatgtgctgataccccccgtacactgcacaggccgtgggtggccctgctggtgggggcccttctgctggcttcctctagttccggggacatcaccttccttcacgtggggtcaccgctcgtgccttgcatcccgtacgccaccgggagggccagcgcgctccccgcgtcgtgctgctccgacttcaagagcctcacaagacgggcgcggaccacaccggaccgccaggcgactccgccgctgcctccatagcctctccaatatcgtcaagaccgtctacatgagcaccgtcgcctccatctccggcaagtgcggcctctgcgtatcatgcaccatcagatgtacagcgactgcaacaagatcagttttcttacgacgaccgacctaataagcctaccaaacgtgcaccaacgtccagaacgctgcacgattgctcaatccagaggagcatgaaatccagccgcttattgccaggagcaacaga

SEQ ID NO: 52817 - protein, 88 aa, Zea mays
  misc_feature: Ceres CLONE 1470909-F
MSTMVACADTPRTLHRPWVALLVGALLLASSSSGDITFLHVGSPLVPCIPYATGRASALPASCCSDFKSLTRRARTTPDRQATPPLPP

SEQ ID NO: 52818 - DNA, 657 bp, Zea mays
  misc_feature: Ceres CLONE 1470912-F
  misc_feature: Encodes the peptide sequence at SEQ ID NO. 52819
  misc_feature (178)..(178): n is a, c, t, g, unknown, or other
  misc_feature (256)..(256): n is a, c, t, g, unknown, or other
ctggagctccccgcggtggcggccgctctagaactagtggatcccccgggctgcaggaattcgtctcacccctagaaaaagcttgtgtcccaggtcatctcatccctgactgcttccctgaggttcgatggtgctctgaacgttgatgtgaacgagttccagaccaacctggtgcccntacctaggatccacttcatgctttcgtcctacgctccagtcatttctgctgagaagggctaccacgagcagctgtccngtgccgaaatcaccaacagcgccttcgagccatcctccatgatggccaagtgcgaccccccgcatgccaagtacatggcatgctgcctcatgtaccgtggtgatggtgttccaaaggacgtgaacgctgctgtggcccacatcaagaccaggcgcacatccagttcgtggactggtgcccgactggcttcaagtgcggaatcaactaccagcctcccagcgtcttccccgggcgtgacctgcccaggtgcagcgtgccttgtgcataatctccaactccaccagtgttggggaggtctcctcccccatggaccaaaagttcaacctcatgtccgccaagccccccttcttgcactggtacttccggtaaggtatggaagagggcctattcccccaaagctt

SEQ ID NO: 52819 - protein, 154 aa, Zea mays
  misc_feature: Ceres CLONE 1470912-F
  misc_feature (1)..(114): Pfam Name: Tubulin_C Pfam Description: Tubulin/FtsZ family, C-terminal domain
  misc_feature (21)..(21): Xaa is any aa, unknown, or other
MLSSYAPVISAEKGYHEQLSXAEITNSAFEPSSMMAKCDPPHAKYMACCLMYRGDGVPKDVNAAVAHIKTRRTSSSWTGARLASSAESTTSLPASSPGVTCPGAACLVHNLQLHQCWGGLLPHGPKVQPHVRQAPLLALVLPVRYGRGPIPPKL

SEQ ID NO: 52820 - DNA, 667 bp, Zea mays
  misc_feature: Ceres CLONE 1470925-F
  misc_feature: Translation starting site: 240
  misc_feature (263)..(263): n is a, c, t, g, unknown, or other
  misc_feature (409)..(409): n is a, c, t, g, unknown, or other
aaagctggagctccccgcggtggcggccgctctagaactagtggatcccccgggctgcaggaattcgtctcacccctagaaaaaccctagaaaaaaagaaaaagaaaagaaaacccccgctgccagcgacagaagaagaaggggtcccttctccttggttgcgttgcgcctccctcctgtctgcgtgcgtgcaatcgacgcagaggcgcgggcgctcgcaccaccacgaccacgacccgatggctttcatgcgctcccgctcnaatgcatcttctggcatgggagttgctcctaacattagggagacattcgttgagcttcaaatgaagaaggcattccgatatgttatcttcaaaatcgaagaagagcaaaagcaggtggttgtggagaagacaggggctactactgnaagctatgatgattttttggcctctctcccagagatgactgccgatatgcgctgtatgattttgattttgtactggggagaatgtgcagaaaagcaagatttcttcattgcctggtcccatcgacatcccgcatacgtgctaggatgctgtactccacgtcgaaggaccgcatcaagtacgagcttgacggggtccactacgaaatccaggcgaccgaccccatcggaggtggacatcggagttcctccgggagcggg

SEQ ID NO: 52821 - DNA, 678 bp, Zea mays
  misc_feature: Ceres CLONE 1470930-F
  misc_feature: Encodes the peptide sequence at SEQ ID NO. 52822
  misc_feature (394)..(394): n is a, c, t, g, unknown, or other
  misc_feature (397)..(397): n is a, c, t, g, unknown, or other
  misc_feature (400)..(400): n is a, c, t, g, unknown, or other
aaagctggagctccccgcggtggcggccgctctagaactagtggatcccccgggctgcaggaattcgtctcacccctagaaaaactcttccgtaaaccctagccgcctgtcttgctgaagctgaactgctgatccgtcttccaagctgtggtgtcatccctgcgttctgacccaagatgtatctccagtattacatcaacgagaagggtgacaaggtctacaccaccaagaaggagtcgcctcttggggtgccgacgcattctgctcacccagctcgcttctcaccagatgacaagtactctcgccagcggtacctgttgaagaagagatttggacttctgcccacgcaaaacccgcactgatctcctcccccttcggcggggcggccgtgatnttncantttgtgtccctgcctaatgttggtggttgggaaaggaaaataagtatccgaagaaaaaaatcaaaccctggctagcccttcttctagtgacttccagccgattcggggcctattggaaagggtttgggacttaccgggcttttttctaattagtacccttgggggggggcacaaacccctctttttggcgctccccttttcgcccaaaaaaaaaaaaaaaaaaccgaccccgcccgggcgccccatttccccctttaacgaacggtcgaaaaacccgc

SEQ ID NO: 52822 - protein, 61 aa, Zea mays
  misc_feature: Ceres CLONE 1470930-F
  misc_feature (3)..(53): Pfam Name: Nop10p Pfam Description: Nucleolar RNA-binding protein, Nop10p family
MYLQYYINEKGDKVYTTKKESPLGVPTHSAHPARFSPDDKYSRQRYLLKKRFGLLPTQNPH

SEQ ID NO: 52823 - DNA, 678 bp, Zea mays
  misc_feature: Ceres CLONE 1470935-F
  misc_feature: Encodes the peptide sequence at SEQ ID NO. 52824
  misc_feature (192)..(192): n is a, c, t, g, unknown, or other
ctccccgcggtggcggccgctctagaactagtggatcccccgggctgcaggaattcgtctcacccctagaaaaactctctccttcccgagcaggaggcggacaaggtaagcagcaatcgcaggaaccctagcgccgccgcacccgcaggaatgggtatcgacctcgtcgccggtgggaggataagaagaccnagcgcactgcgcccaagtctgacgatgtctacctcaagctcctcgtcaagctctaccgtttcttggtcaggaggaccccaggagcatttcacgctgtcattctcaagaggcttttcatgagtaaaacaacccgaccaccaatctccatgcgccgccttgtcaagtttatggaagggaagggagaagaactttgctgtcatttgtggcacagtcacagatgacaaaaggatcccaggaggtcccagcaatgaaagttactgccctggagttcacgggacacaggcagggccaggaattgtcaatgctgggtggcaagggccctcaaatttgacccggcttgctcttcgggcctccaactggggaaaaaccccgtccttctttgagggccccacaaaaatgccccgggaaggcagtgaaggcccttttggggaagggctccctgaaattgcccccccaaccccccaccaagggccgtgatgggccccc

SEQ ID NO: 52824 - protein, 34 aa, Zea mays
  misc_feature: Ceres CLONE 1470935-F
MSKTTRPPISMRRLVKFMEGKGEELCCHLWHSHR

SEQ ID NO: 52825 - DNA, 660 bp, Zea mays
  misc_feature: Ceres CLONE 1470938-F
  misc_feature: Encodes the peptide sequence at SEQ ID NO. 52826
  misc_feature (410)..(410): n is a, c, t, g, unknown, or other
  misc_feature (471)..(471): n is a, c, t, g, unknown, or other
  misc_feature (630)..(630): n is a, c, t, g, unknown, or other
  misc_feature (660)..(660): n is a, c, t, g, unknown, or other
ctggagctccccgcggtggcggccgctctagaactagtggatcccccgggctgcaggaattcgtctcacccctagaaaaatccactctcagcatcaccagctaagaacaggtcttcgtctcaataatggaaggcaaaacagggcagctcaggtgctgtttcgtcgccatcgtgctcgtcctgggtcttgtccttgagcagtcccagcaggctgaagctagaggcaaatggtgctgcgaaaccgccaccggaaataccattttaatcgctgcgttgactcgggttgggtcgacaatattgggttctgtgcgagtaatgccggttgcatcattatggaggacagatttggagggtcgttgccagtgcctgctcgtgatgcgctttctctggatgtcatttgattaatataangcagtacgtgaaagtaagaaacgagggccagacgactgtcgtccagcgattggttatttgngaaactgtcgtttgtcttcttatttcaacttccaaataagccccttcgtgtaatcgtgtcctccccttcaaggtttgtcgactgttgcgtaatcaaatctatatagcaaataaagaccgcggccgaacgtgtatatgtctctatttctgatcttgcagncgtttggctaatcaatggtcctgtcactan

SEQ ID NO: 52826 - protein, 92 aa, Zea mays
  misc_feature: Ceres CLONE 1470938-F
MEGKTGQLRCCFVAIVLVLGLVLEQSQQAEARGKWCCETATGNTILIAALTRVGSTILGSVRVMPVASLWRTDLEGRCQCLLVMRFLWMSFD

SEQ ID NO: 52827 - DNA, 655 bp, Zea mays
  misc_feature: Ceres CLONE 1470946-F
  misc_feature: Encodes the peptide sequence at SEQ ID NO. 52828
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (460)..(460): n is a, c, t, g, unknown, or other
  misc_feature (461)..(461): n is a, c, t, g, unknown, or other
  misc_feature (562)..(562): n is a, c, t, g, unknown, or other
ctggagctccccgcggtggcggccgctctagaactagtggatcccccgggctgcaggaattcgtctcacccctagaaaaattccacctgcttggtccatcagcagcttcgcctccaagacgcgccgaggctctccctgcaccgtgccagggccgcttccgaggacacgtcggcctccggcggcgacgagctcatcgaagacctcaaggcaaagtgggacgccgttgaggacaagcccaccgtcctcctgtacgacggcggcgccgtcgtggcgctatggttgacgtccgttgttgtcggcgccatcaacgccgtgccgctgctccccaagatcctggagctcgtcggcctcggctacaccggctgggtcgtgtaccgctacctcctcttcaagcaaagcaggaaagagctggtcgacgacattgagaccctcaagaaaaagattgctggannncgcgganntagcgctagctctcgtgggaaagctttagaacccacgacggagagggcccgttttcttctttgcaaattaggatatcaaacccgaggaacgtcccaatgcncctactgtcccccaatgtgttgtgtgatgcataccttaccttctgtatacctaacgaaattaaagaggaaagctttttgccttgcaaaaaaaa

SEQ ID NO: 52828 - protein, 32 aa, Zea mays
  misc_feature: Ceres CLONE 1470946-F
  misc_feature (2)..(2): Xaa is any aa, unknown, or other
MXLLSPNVLCDAYLTFCIPNEIKEESFLPCKK

SEQ ID NO: 52829 - DNA, 675 bp, Zea mays
  misc_feature: Ceres CLONE 1470949-F
  misc_feature: Encodes the peptide sequence at SEQ ID NO. 52830
  misc_feature (525)..(525): n is a, c, t, g, unknown, or other
agagctggagctccccgcggtggcggccgctctagaactagtggatcccccgggctgcaggaattcgtctcacccctaaaaaaagtcttcggttgcttcaggtcagcctccctctccggatcccccatctgctccgccgccggccaacgcatcgctccccttggcagccaggatgacagaagcaccatttctgccacgtgagaggctcttcaagctgcaacatcatttccagaacatgaccaagcacacctacctgaaagggcgctacgatgtgatcacctccgttgccatccctcttgcacttgctgcctccagcatgttcatgattgggcgtggagtttacaacatgtctcatggacttgggaaaaggagtgatctaccacgggctaactagtttttctacttggcatgaacgtaccatccagactatgaggtcttccttgcatgctaaatatactgtcaaagaacaagccgactacctttttgcatcatatatctgtttggattgggggatatgaaatgccntccacttgaagatcagcatggttactatttcggttaattaagaaaaaaaaaaaaaataaccgaacgcgtcgaggtacccaattccgccttatagggaggtcctattacgggcgcttcactggccgtctttttaacaacggcggggctggg

SEQ ID NO: 52830 - protein, 73 aa, Zea mays
  misc_feature: Ceres CLONE 1470949-F
  misc_feature (9)..(62): Pfam Name: COX7a Pfam Description: Cytochrome c oxidase subunit VIIa
MTEAPFLPRERLFKLQHHFQNMTKHTYLKGRYDVITSVAIPLALAASSMFMIGRGVYNMSHGLGKRSDLPRAN

SEQ ID NO: 52831 - DNA, 623 bp, Zea mays
  misc_feature: Ceres CLONE 1470953-F
  misc_feature: Encodes the peptide sequence at SEQ ID NO. 52832
  misc_feature (514)..(514): n is a, c, t, g, unknown, or other
tccccgcggtggcggccgctctagaactagtggatcccccgggctgcaggaattcgtctcacccctagaaaaatgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactcactccacaacgtcttcagcacctacggcgaggtcctcgagtccaagatcatcctcgatcgggagacgcagaggtcccgcggcttcggcttcgtcaccttctccacggaggaggcgatgcggaaacgcatcgagggcatgaacggcaaggagctggacgggcgcaacatcaccgtcaacgaggcccagtcccgctgcggccgtgtaagcggcggctgtgtgtacagtggtggccgtggaggccgctgctactgcggtggcgggctccatgatggcngaagcggctacggcggtggctgcggctgctacggtggccgtcgctgctacggtggtggtggctgcgctacggcggtggcatcggtgggggggctacggcaactccgacg

SEQ ID NO: 52832 - protein, 150 aa, Zea mays
  misc_feature: Ceres CLONE 1470953-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (115)..(115): Xaa is any aa, unknown, or other
MAASDVEYRCFVGGLAWATDDHSLHNVFSTYGEVLESKIILDRETQRSRGFGFVTFSTEEAMRKRIEGMNGKELDGRNITVNEAQSRCGRVSGGCVYSGGRGGRCYCGGGLHDGXSGYGGGCGCYGGRRCYGGGGCATAVASVGGLRQLR

SEQ ID NO: 52833 - DNA, 646 bp, Zea mays
  misc_feature: Ceres CLONE 1470955-F
  misc_feature: Encodes the peptide sequence at SEQ ID NO. 52834
  misc_feature (254)..(254): n is a, c, t, g, unknown, or other
  misc_feature (267)..(267): n is a, c, t, g, unknown, or other
  misc_feature (423)..(423): n is a, c, t, g, unknown, or other
aaactggagctccccgcggtggcggccgctctagaactagtggatcccccgggctgcaggaattcgtctcacccctagaaaaaaacggcgccacggcggcgacgagaagtggcgagccccgagagcgggtttagttagaggctacgggcggtcgggcgcggcggcggctgcggccatgagcaggcggagcgagagcactaccgccagcaggtggcccgagctggccacgctgcgcgccctggcgcgcgactccncggagcagctgcngctgccgcgggccagcacgtcggcgtcggcgtcagcgtcgtcgtcgccgtggcgcgggcgcaatgaccacctcccggccacagaaagacggccaaggtgatgcacctgctgctctgggggacccaagtgaagcggcgagacgtcaccgtcacgccnggcgttgctcgttttgctctgcctgcaatccgccccgcacggactgtactgtactgtacctatacacctatatactacgacgtgcacatgtaccagtctacaacgtgctgctgtaccatacaaatactagggcgctgctgctcccttggccttcttgattgcaagtgccaccgcccctcggttttttttttgctcaaacgatccactgcctcttcggcgtcgg

SEQ ID NO: 52834 - protein, 63 aa, Zea mays
  misc_feature: Ceres CLONE 1470955-F
  misc_feature (27)..(27): Xaa is any aa, unknown, or other
  misc_feature (31)..(31): Xaa is any aa, unknown, or other
MSRRSESTTASRWPELATLRALARDSXEQLXLPRASTSASASASSSPWRGRNDHLPATERRPR

SEQ ID NO: 52835 - DNA, 653 bp, Zea mays
  misc_feature: Ceres CLONE 1470965-F
  misc_feature: Encodes the peptide sequence at SEQ ID NO. 52836
  misc_feature (251)..(251): n is a, c, t, g, unknown, or other
  misc_feature (350)..(350): n is a, c, t, g, unknown, or other
  misc_feature (380)..(380): n is a, c, t, g, unknown, or other
  misc_feature (442)..(442): n is a, c, t, g, unknown, or other
tccccgcggtggcggccgctctagaactagtggatcccccgggctgcaggaattcgtctcacccctagaaaaatcgggtatcggcattactgggcgcacgagactagggatttcccccttgcatcacgaatccatggcggatgctgaacctgttgatcagaagaattaccttgaggaacgttgcaagcccgcatgtgtaaaaacattgtatgattatgagaaatgcgtcaagagagtcgagagcgacggangtgggcagaagcactgcacccggcaatacttcgactactggtcatgcgttgacaagtgtgttgcacaaagctcttcgacaaactgaaatgataacgganccgcatctttggaggcgcggctcctttcangaagtcaaatagctccaataaccccatgcttggcctctggaatttgttgctgaccctgtggncaggacctcattttaatacgttttgctgaaccgtcttttttttttttttccccctgatctggggtgaatccccaggcgtcaaagccattttctttttttataagaaatatggggggcccaataaaaaaaaggcccccaaaaagattggcccaattggaaaaaaaaaaaaaaaaaaacggggacgcctggggggcccccatttcccccttat

SEQ ID NO: 52836 - protein, 67 aa, Zea mays
  misc_feature: Ceres CLONE 1470965-F
  misc_feature (7)..(67): Pfam Name: UCR_hinge Pfam Description: Ubiquinol-cytochrome C reductase hinge protein
  misc_feature (40)..(40): Xaa is any aa, unknown, or other
MADAEPVDQKNYLEERCKPACVKTLYDYEKCVKRVESDGXGQKHCTRQYFDYWSCVDKCVAQSSSTN

SEQ ID NO: 52837 - DNA, 668 bp, Zea mays
  misc_feature: Ceres CLONE 1470969-F
  misc_feature: Translation starting site: 159
  misc_feature (183)..(183): n is a, c, t, g, unknown, or other
aagctggagctccccgcggtggcggccgctctagaactagtggatcccccgggctgcaggaattcgtctcacccctagaaaaagccgtcatcgtttcgcgtctgcctcagcccgccgcaaggagagggtagttcaggagacatcttcgagaagctgaaatggctcctaaagctgctcctgccnagaagggtgatgccaagacccagggccttgaaggttgccaaggctgtgaagtctggggcagccaagaagaagaccaagaagatcggcacgtctgtgacatttcacgccccacgaccctgaagaaggctagggaccccagtacccacgaatcagcactaccggaaggaacaagcttgatcagtacaaaattctcaagtccccccttaccacagaatccgcgatgaagaatattgaacaaaccaccctctggtcttctttgttgacctcaaggcaaacaaaaagaggatcaacgctgccctcaaaaagatgtttgactcccggcaaagaagggccaccccttgatcaggcctgatgggaaaaaaaaggcttacctaaacctacctcccaactatgagtccccttgatgttcccaaaaaaatccggcttcttctgagggggtgcattaaggcaccctaatccctcggggggggccccagttccaaagg

SEQ ID NO: 52838 - DNA, 681 bp, Zea mays
  misc_feature: Ceres CLONE 1470975-F
  misc_feature: Encodes the peptide sequence at SEQ ID NO. 52839
aagctggagctccccgcggtggcggccgctctagaactagtggatcccccgggctgcaggaattcgtctcacccctagaaaaagcaagccactccgaggccaagtctagggtttgggaatctgtaggaggggagaggggagcgcgctcagggtcagggaggcgaagatgatcgaggtggtgctgaacgaccgcctggggaagaaggtgcgggtgaagtgcaacgaggacgacaccatcggcgacctcaagaagctggtggcggcgcagacggggacgcgccccgagaagatccgcatccagaagtggtacaacatctacaaggaccacatcacgctcaaggactacgagatccacgacgggatggggctcgagctctactacaactaggcgccctgaccccaaccgtgccctgatgtaacgttaatccgaattctgaagtcgtgggtgcgctttccgtcgcagcgtctttagctaacaagctcgcatacttatagggcaacttgaggggagctatgtaatacgggatatgggtttggtggaaaacttgccaatgacttattgccatcccttgcttattttggacttggtgacaaggatccaccctgccgaacatgggtggccctgctactcccatgaaccttttttaccttaaaataaccccgggggggggggggtttttt

SEQ ID NO: 52839 - protein, 73 aa, Zea mays; identical to SEQ ID NO: 39404
  misc_feature: Ceres CLONE 1470975-F

SEQ ID NO: 52840 - DNA, 667 bp, Zea mays
  misc_feature: Ceres CLONE 1470976-F
  misc_feature: Encodes the peptide sequence at SEQ ID NO. 52841
aagctggagctccccgcggtggcggccgctctagaactagtggatcccccgggctgcaggaattcgtctcacccctagaaaaaatcgcatccatccaccacgcaccccaccaacccatacccataccagaggctctctgattttacttctcagcggtagatcggctgagcgagcgagcgagcgaggcacacgggtagaaaagcaagatgtcggacggcacggcgacctgcatcgacatcatcctcgccatcatcctgccgccgctcggggtcttcttcaagttcggctgcggggttgagttctggatctgccttatcctcaccttcttcggctacctccccggcatcatctacgccgtctgggccatcaccaagtagccggccggagcagagcaaccacggccccctgcaatgactccgtcgcgtgcgttagcatgcaatgtcttgagatgtgattccttccttctttgtttaggtgctgctgctcctgctggtgtatccagtccttttaatatcttgattagtttgctcggctgagaaatcaggacccgtgtctgggggtgctgctcagctgcatgtacttgtacaaccattccgccctggaggtggtggccccttcttttttttggtttacctggattggaggattgttaaattccgtgttggaa

SEQ ID NO: 52841 - protein, 56 aa, Zea mays
  misc_feature: Ceres CLONE 1470976-F
  misc_feature (6)..(56): Pfam Name: UPF0057 Pfam Description: Uncharacterized protein family UPF0057
MSDGTATCIDIILAIILPPLGVFFKFGCGVEFWICLILTFFGYLPGIIYAVWAITK

SEQ ID NO: 52842 - DNA, 676 bp, Zea mays
  misc_feature: Ceres CLONE 1470991-F
  misc_feature (241)..(241): n is a, c, t, g, unknown, or other
  misc_feature (276)..(276): n is a, c, t, g, unknown, or other
  misc_feature (396)..(396): n is a, c, t, g, unknown, or other
aaagctggagctccccgcggtggcggccgctctagaactagtggatcccccgggctgcaggaattcgtctcacccctagaaaactccctcgagcttttcttgtgcgcagccgcagccgctgcttttcgttcgtcttcatcctacgcgagggcgaaacccacaaaccctctccctcctgtactccggccgacacatccaggggcgatgacgctgggtagctccggcgccggatcgagcgtcntctttcctcgaaacttcaggctattagaggagctncgagcgtgagagaaggggcattgtgatgggacagtgagctatggaatggatgatgctgatgacatctacatgcggtcatggactggtaccatcattggccctcacaatactgtacatganggtcccatctaccagctgaagttggttttgtgacaaagactatccggagaagccaccatctgtcagatttcactcaagaatcaacatgacatggcttaaatcacgagacaggaaatggttgatccaaggaaagttttgttttgctaaccaacctggcccccgggactacaccaatggaaaaacctccctcccccaatctcaaagaaaagagtgggctgccctcgcaaaaatcgaaaagtttggtggcccccctccagaaagggacattcctttcaaagga

SEQ ID NO: 52843 - DNA, 651 bp, Zea mays
  misc_feature: Ceres CLONE 1471188-F
  misc_feature: Encodes the peptide sequence at SEQ ID NO. 52844
tggagctccccgcggtggcggccgctctagaactagtggatcccccgggctgcaggaattcgtctcacccctagaaaaacattcccttcctccttccgcagcaagctccagcctctcaaagcccccactcccccaatagaccatgccggccgctgcgctctagccgaccgccgcccctcccttccccctcctcgccgccatgtccatcgccgccgtgtccgcggatgggctcctcgcgttggccgacgaggctgagcgccggtatgacttttccgccgcggccgcttgcctcgagtccgcgctgcgtccgccctacgccgcagctctcctcccactcaccgaagcccgcgcgcggctccgcctcgcttcgctcctcctcgcgccccgcgggtcctcccgcgtcccgcgcgccggcgctcccgccgccgccaagacgcacctcgagcgcgcgctgctcatcctctcccctctcccctccgcgccaccgcggctcaagctgttggcccactcccacctcgcgggcgcctatgctgtcctgggggcgatcgcgtcgcagaagcacgtgctccaccgcggcctcggcctcctggattcggcttccgcctcggggctcctccagcgcgagccagcgcttctatggacttgcaactt

SEQ ID NO: 52844 - protein, 150 aa, Zea mays
  misc_feature: Ceres CLONE 1471188-F
MSIAAVSADGLLALADEAERRYDFSAAAACLESALRPPYAAALLPLTEARARLRLASLLLAPRGSSRVPRAGAPAAAKTHLERALLILSPLPSAPPRLKLLAHSHLAGAYAVLGAIASQKHVLHRGLGLLDSASASGLLQREPALLWTCN

SEQ ID NO: 52845 - DNA, 834 bp, Zea mays
  misc_feature: Ceres CLONE 1471189-F
  misc_feature: Encodes the peptide sequence at SEQ ID NO. 52846
  misc_feature (30)..(30): n is a, c, t, g, unknown, or other
  misc_feature (37)..(37): n is a, c, t, g, unknown, or other
  misc_feature (40)..(40): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
tattcccccccaccctatataacccccaancccattnccntnnnnccccccnnntttaaactggcactcaccgcggtggcggccgctctataatagtggatcccccgggctgcaggaattcgtctcacccctagaaaaacctctgcccgctgtgccccacgcccagccccccgatccgacccacccagcccagcgccatgtcccccgcggccaccgcgtgcgccacgccggcggtggcgcgcccgttcaatacggttcctacacgccgctcgccgccctctgccgcgcgcccgccatccggtatccccgcccgtagctccgccggctgctgcttctgcgcctcctcctcatcctcggaatggtcgccctccacctggggaactggacccgattgggacccgccccttcaacgaaggcccatctttccccatagctccgtcatcgcttcctccaattccaaacttggaaaaacggcggcccaaataaccccccattccctagtccacggttgccaccccctctaccccgtgaccacccctcccccgcctttttgccccacttccctctgcggtagccacccgcttaccaaaccaatgcttttcccccccacgcgcaagaataatggtggtttccaactccctttcctttctccgatcgcccaaattgggttcaccttgtccgtctttttcacgggaaacccccccttggatcccgacaagtcttttttctgcagccccccacaccaagaacgcaccaaggaaacccctcgtacttaacgccacctgttggctcttttatcccgccagagccgcgacctctccattgcttctggcc

SEQ ID NO: 52846 - protein, 60 aa, Zea mays
  misc_feature: Ceres CLONE 1471189-F
MLFPPTRKNNGGFQLPFLSPIAQIGFTLSVFFTGNPPLDPDKSFFCSPPHQERTKETPRT

SEQ ID NO: 52847 - DNA, 858 bp, Zea mays
  misc_feature: Ceres CLONE 1471189-R
  misc_feature: Encodes the peptide sequence at SEQ ID NO. 52848
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (21)..(21): n is a, c, t, g, unknown, or other
nnnncccaattgggtacctcnagcgtctcgtttttttttttttttttcttttttttttttttttttttttttttttttttttttttttttttttttttttttttttttttttggaagcgtcatcacaaatcatgggactttatttgcctttttattattatatatggaacatcctgatacaacaaaacgattttgtttaatttgttttccatcctaccttactgaaaccaaaagggaagggggaaaacccccaaaactggtcagccttccctcaaaaaaacaattcaactcctgccgagtaggaacggaaaaaaaattggcaggcatctcagggagcaaaataccccaaaggaccacggaaaaaagggcccccaggccacaaaatttttcgaacacttggaaatggggccagcctctgtgcgttcatgcaatctacatgggaaaaatctgctccttttaggaatctcaacactcgggaaggttaagcccatcgaaaaaaacccaaaaactctgctcaggtaccctgtacaggaaacccagctctgcgcctccaaggggggggaatgtactcttgccattgagcaccaacaggtcaccatccacccattgaggatttttgaatccagggtgtaacttttctacccctggacctttaaaaccggggaaaatcccgaacattttttaaaacaatattttttgcaaaaaaaaaaattaccccccccgaaatttctcttggaaaacgcccccccccaattctccaaagaccgtttggcccctttccacaaatctttcccagaggaaattgtttattttggggccccccaaggggaacaccctcccaaattccacccaagttcc

SEQ ID NO: 52848 - protein, 151 aa, Zea mays
  misc_feature: Ceres CLONE 1471189-R
  misc_feature (6)..(6): Xaa is any aa, unknown, or other
PNWVPXASRFFFFFSFFFFFFFFFFFFFFFFFFFFFGSVITNHGTLFAFLLLYMEHPDTTKRFCLICFPSYLTETKREGGKPPKLVSLPSKKQFNSCRVGTEKKLAGISGSKIPQRTTEKRAPRPQNFSNTWKWGQPLCVHAIYMGKICSF

SEQ ID NO: 52849 - DNA, 664 bp, Zea mays
  misc_feature: Ceres CLONE 1471191-F
tggagctccccgcggtggcggccgctctagaactagtggatcccccgggctgcaggaattcgtctcacccctagaaaaagaaccctttcttcctcctcatcccccaagccccaaccagctccaattcccccccatacaatatcttttctctctcatcctccaaaggaccaagaagtaccatttctgctatctccattcgtctccaatcccaacacagcttctcaattcagttcagggaattctcccttttcttttgttttgctctagtgctcttggctgtttactccgcttcttatcctcttctctccacagaagaggagtgcatgtgcagcagctgtaaagacatttttttttcacctcatcttctcccaaggtgttgttggtgccccaggtggaggcaactgccaaagtgtttgggtttcttgaatgttaggcttttttggggaggaggaagggcttgatcaattaggttcagccattcttgccccagtgttcttggattcatggtcgtggaattaatcaaagggtagctggagctgctcattttcccttccgagaaaacgaaggcgatcgtttgaacggtagctagctgttgccgttgagccggtgcaatgtcgtcttcctgcatgccgaccggcctggggctggacctggacatggtgag

SEQ ID NO: 52850 - DNA, 593 bp, Zea mays
  misc_feature: Ceres CLONE 1471196-F
  misc_feature: Translation starting site: 226
cccccgggctgcaggaattcgtctcacccctagaaaaaaagtcctggcctgtccacggtccacacacgccttccttatatcggcgctcacggttctataaaaaaaaacacagtacgagcagagcaaggcggccgtgagctgagctgagggaaggacgacgtacggcacagttgctagcccggccgccggagctctccgtgatcgatctgggccgccagcaacagcatgggtgccgcgctcttggcttcttggccatgggacaacctcggcttctacaagtacgtcctgtacgggccgctggtgggcaaggcggtggcgtcacgggcgtgggagagggcgagccccgaccgctggatcctcctcctgctcctcctcttcggcctccgcgcgctcacctaccagctctgggagctccttcagcaacatgctcttcgccacacgccggcggcgcgtcgtccgcgacggcgtcgacttcgaccagatcgacaaggagtgggactgggacaacttcctgatcctgcacgccctgatggcggccgcggcgctgtgcgcgttcccgtcgctgcggcatcttccgggggtgggacggccgg

SEQ ID NO: 52851 - DNA, 655 bp, Zea mays
  misc_feature: Ceres CLONE 1471197-F
  misc_feature: Encodes the peptide sequence at SEQ ID NO. 52852
ggagctcaccgcggtggcggccgctctataactagtggatcccccgggctgcaggaattcgtctcacccctagaaacccctttcttcccgaagctgtctgtcctgctcctgcgcgcgttggaggaaggaagcctaggaaagccaccgctcaccttctcgctcgctcccccaccgaacgcctcttggtgggagaagaattggccgaaaagcttccggttggctggccgggatctcttcgtctttaattaccggacccctggggggattgcctgctgcctcattagaccagaccagacagggagagggttgagttgagggggaggagaggagagagacacagacaacgggtggtcgctgggaagaggaagaagaggcccgcggggaagcggagggatccagaagaagatgacccaccgggtcctggccgtcgccattctcgccgctgcttcggcggcggcgctcctcctcggggccgaggcccagcagcagggccaccagacagagaggatctcatgaagcgccggcgacgtgctggaagacaaccccgtcgggaggctgaaggtgtacgtgtacgacctccccagcaagtacaacaagaagctgctgaagaaggaccccaagtgcctgaaccacatgttcggcgcggagatcttcc

SEQ ID NO: 52852 - protein, 36 aa, Zea mays
  misc_feature: Ceres CLONE 1471197-F
MTHRVLAVAILAAASAAALLLGAEAQQQGHQTERIS

SEQ ID NO: 52853 - DNA, 661 bp, Zea mays
  misc_feature: Ceres CLONE 1471199-F
  misc_feature: Encodes the peptide sequence at SEQ ID NO. 52854
  misc_feature (411)..(411): n is a, c, t, g, unknown, or other
ggagctccccgcggtggcggccgctctagaactagtggatcccccgggctgcaggaattcgtctcacccctagaaaaaacagagcagccacttggatccggtgctcagcggaacagctagctatagcctgtagctagcagctagcttcagtcacaggccggacggtcggctcacacacagctagccgccgccgccgctagcttagccaccagtagtccgatctgatctacaggcaaggggcaactagctagctagccgcgcgccggcgccatgatgaacctgaacctgaagcagcctctggtgctgcccgcgcaccacagcaatgtcgtcggctcgcgcctgtcgtcgtcgtcgccctcggcagccgccgccagcaggaggaccggcggcggcgtgtcctcccggtttggntcccggcggcacgtgcggctgccgaggatcagctgcagcgccaccgaggaggtcagcggcgccgtgtcgtccgtcaccgtggagaggatgctcacggtgacggcgtcggtggaggcgtccccggccatcgggcagatgtacttccagcgcgccgaccacgacatcggcgacctcctcggaaagacgcggctgctcgagctcgccacctccgagctcgacccaaagtcgggcgtggagaaaaacccgggtg

SEQ ID NO: 52854 - protein, 130 aa, Zea mays
  misc_feature: Ceres CLONE 1471199-F
  misc_feature: SWISSPROT Homolog: EC 1.13.11.12 Lipoxygenase
MMNLNLKQPLVLPAHHSNVVGSRLSSSSPSAAAASRRTGGGVSSRFGSRRHVRLPRISCSATEEVSGAVSSVTVERMLTVTASVEASPAIGQMYFQRADHDIGDLLGKTRLLELATSELDPKSGVEKNPG

SEQ ID NO: 52855 - DNA, 642 bp, Zea mays
  misc_feature: Ceres CLONE 1471201-F
  misc_feature: Encodes the peptide sequence at SEQ ID NO. 52856
tggagctccccgcggtggcggccgctctagaactagtggatcccccgggctgcaggaattcgtctcacccctagaaaaaaagaagagcacgcccactcctctccggctcctcttcttctccaccacaccacaggcaccggcaccggcaccgcctcctccctccctcctgccaccgcgcggcaccccagccacagcacagcaatggcgggcaacggcgccatcgtggagagcgacccgctgaactggggcgcggcggcggcggagctggcggggagccacctggacgaggtgaagcgcatggtggcgcaggcccggcagccggtggtgaagatcgagggctccacgctccgcgtcggccaggtggccgccgtcgcgtccgccagggacgcgtccggcgtcgccgtcgagctcgacgaggaggcccgcccccgcgtcaaggccagcagcgagtggatcctcgactgcatcgcccacggcggcgacatctacggcgtcaccaccggcttcggcggcacctcccaccgccgcaccaaggacgggcccgcgctgcaggtcgagctgctcaggcatctcaacgccggaatcttcggcaccggcagcgatggccacacgctgccgtcggaggtcacccgggcggcgatg

SEQ ID NO: 52856 - protein, 147 aa, Zea mays
  misc_feature: Ceres CLONE 1471201-F
  misc_feature: SWISSPROT Homolog: EC 4.3.1.5 Phenylalanine ammonia-lyase
MAGNGAIVESDPLNWGAAAAELAGSHLDEVKRMVAQARQPVVKIEGSTLRVGQVAAVASARDASGVAVELDEEARPRVKASSEWILDCIAHGGDIYGVTTGFGGTSHRRTKDGPALQVELLRHLNAGIFGTGSDGHTLPSEVTRAAM

SEQ ID NO: 52857 - DNA, 638 bp, Zea mays
  misc_feature: Ceres CLONE 1471202-F
ggagctccccgcggtggcggccgctctagaactagtggatcccccgggctgcaggaattcgtctcacccctagaaaaaaggctccgcgtctcgctgtccccactccgtctcctccggctccgtctcatcccgatgccgctccttctcatcgtcgtcgtcccagtcccggagtcgctcccctcctctggctaagcgcagccttgatgtgtcggcaactggagtatttggtacgagactgcttgatccagataattttattacacttcaggcgtggcttgtgtgttcagactactactgttgaatacagttacaattggtccttgtggccctcaacagtttggatgctgtcattcagcattgaacagagccagagtctggtaacagtttttaatcatgttcttgataggatggatacatctgttaaatgtgtgaccctgcattcagaattcagatcgacacctttgattggttccaattccctgctgctggcttattatttaactttcctttttgcagtttctataatagcagagacatgcgctaaccagcatttgctaacccaatcaatttgttggcatcattttattgatcgaatccatcccgcctcatgcttttgcttcgccctgttaacatgtttt

SEQ ID NO: 52858 - DNA, 649 bp, Zea mays
  misc_feature: Ceres CLONE 1471203-F
tggagctccccgcggtggcggccgctctagaactagtggatcccccgggctgcaggaattcgtctcacccctagaaaaagttcctgaaagagagagaagcatatcctcactctagtctctctcgccccatccccttccccgtccctcctccagctccctctcctccgactgctgcccctccaccgtccgcccctcctccccgccgccggccacatccggactaccccgccgcgttacctcctcctcctggcgcttcccgcttggcggttgcctgggatttacccccgctctgttcccctttcggggaacgccttcagaggcaggacgggtacttggtccgggaggcgcggcgacggcgacagcggcgagtgatcttcggtcgccagagggagagttttttttaacggggttttggtgggaaggaaggaggcggccgcgagtaggcgagacgttcatgggttagatctggcggtccggcggcgcggatctgagcgaggtttcggtggagggatcgggtggtggtcactatcttcgcctccattcgagtagatggagcgtctcatggccaaatcgggcatgtatggcggattctgctactgtctgaaccaccgtggcctgcaaatctgaaagtcccttggtctccttggcc

SEQ ID NO: 52859 - DNA, 692 bp, Zea mays
  misc_feature: Ceres CLONE 1471209-F
  misc_feature: Encodes the peptide sequence at SEQ ID NO. 52860
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
ggagctcaccgcggtggcggccgctctataactagtggatcccccgggctgcaggaattcgtctcacccctagaaaaaaccgccgccgcatccaccaccacctccgccgccgtgctcgccttcaggctcctccgccgcctgccgcgccgcctcagcgtgtcccgcgcgccgcccgcggcactcgcgtcgtcgtcgtcgtcgtcgtcgcgcagactaccgtccctcgcccgccacccgctcggtcaccgcacccggatggggcacacagccgccgctgcggccgcggccgccgaacccgctctcggactcaccaagcccaacgccgtcgagccgcctcaggtcaccttttcccgagatcattcaggnnnnnnnnntgaaaggcgatatctcgctgtcgccgtcacggagaaggatctgtccaaggacccggacttccaattcgagaaggccttcttgagactgacgnnnnccagttcggggggctcttggtggaaggcgcgggggaaaaaaatttccccgttaaaaaagggaaggcattgggccccccccctccacgggcgggttttcaaaaaagggctaaaattgaaaattttttttttaaagaaaggccccccccaaaaagaaaaaattttcttttaaaaacaacacgggggaaacagaagaagagggcggggggaggagaggggggcgtt

SEQ ID NO: 52860 - protein, 212 aa, Zea mays
  misc_feature: Ceres CLONE 1471209-F
  misc_feature (123)..(123): Xaa is any aa, unknown, or other
  misc_feature (124)..(124): Xaa is any aa, unknown, or other
  misc_feature (125)..(125): Xaa is any aa, unknown, or other
  misc_feature (156)..(156): Xaa is any aa, unknown, or other
  misc_feature (157)..(157): Xaa is any aa, unknown, or other
GAHRGGGRSITSGSPGLQEFVSPLEKTAAASTTTSAAVLAFRLLRRLPRRLSVSRAPPAALASSSSSSSRRLPSLARHPLGHRTRMGHTAAAAAAAAEPALGLTKPNAVEPPQVTFSRDHSGXXXERRYLAVAVTEKDLSKDPDFQFEKAFLRLTXXSSGGSWWKARGKKISPLKKGRHWAPPLHGRVFKKGLKLKIFFLKKGPPQKEKIFF

SEQ ID NO: 52861 - DNA, 681 bp, Zea mays
  misc_feature: Ceres CLONE 1471224-F
  misc_feature: SWISSPROT Homolog: EC 2.7.11.1 Non-specific serine/threonine protein kinase
aactggagctccccgcggtggcggccgctctagaactagtggatcccccgggctgcaggaattcgtctcacccctagaaaaaagcaagccgcccagcacgaccgccagccatcaccggccagtgagacggtacagcaaatttcccccgtcgcgcccggtcattacgacggcgccggccgagcagacgccgccgccacgatgccgcccgccaccggcgccgtcgccgaaccctgcccccgccgcggggaccgtgctcctcggcaggtacgagctcggcggcctcctgggccgcggcgcctccgccaaggtgtacctggcgcgggacctgctccccggccgctccgtggccatcaagtcgttccccaacccacgcgccggcggcggcgccgtgcgttggcgtcaacgccgccatccagcgagaggcgtgcatcctccggcgcctgcggcaccgccacgtggtgcggctccacgagatcctggcgacgcgcaagaatgtccacttcgtgctggacctcgccggcggcggcgaactgttctcgctggtggacgcgtcggggcgcatgaccgaggacctggcgcggcactacttcccgcagctggtgtccgccgtgcgctactgcctacgcgcgcagcgtgtaccaccgcgtacatcagccagagatactgctgctggacgagggc

SEQ ID NO: 52862 - DNA, 679 bp, Zea mays
  misc_feature: Ceres CLONE 1471225-F
  misc_feature: Encodes the peptide sequence at SEQ ID NO. 52863
ggagctccccgcggtggcggccgctctagaactagtggatcccccgggctgcaggaattcgtctcacccctagaaaaatttaaaaggcatgatggacaagctgtcacttgtgcaatacttctatgcacccatgtgtgatgcaaataatgcacaactgccaaactttttacaatggtactctcaagcatgtacccctatagtcaaggtggcatcttcatatgatcctacttctcagacattctctttgaaacttagccaaaaaataccacccactcctggccagccgattaagaagcctatgttcatacctgttgctattagacttgttgactctactggaaaagatatgcccctcacttccgtttacagtgatggaagtctccaaacagtctctactgatggccacccagtcttcactactgtgcttcagtttaaaaaaaaagaagaaaagtttatgtttaaaaacattcctgagacgccagttccttctttgttaaggggatatagtgctcctgtccgtctacattctgatctgagagagggtgacctatttttcttgattgccagcgactcggatgaatttaacagatggaaagctggccaagttttggcacgtaagttgatgctcagtctcgtagctgatttccagcaacagacaacactggttctaaatccgaga

SEQ ID NO: 52863 - protein, 196 aa, Zea mays
  misc_feature: Ceres CLONE 1471225-F
  misc_feature: SWISSPROT Homolog: EC 3.4.11.2 Membrane alanyl aminopeptidase
MDKLSLVQYFYAPMCDANNAQLPNFLQWYSQACTPIVKVASSYDPTSQTFSLKLSQKIPPTPGQPIKKPMFIPVAIRLVDSTGKDMPLTSVYSDGSLQTVSTDGHPVFTTVLQFKKKEEKFMFKNIPETPVPSLLRGYSAPVRLHSDLREGDLFFLIASDSDEFNRWKAGQVLARKLMLSLVADFQQQTTLVLNPR

SEQ ID NO: 52864 - DNA, 652 bp, Zea mays
  misc_feature: Ceres CLONE 1471231-F
  misc_feature: Encodes the peptide sequence at SEQ ID NO. 52865
gcggtggcggccgctctagaactagtggatcccccgggctgcaggaattcgtctcacccctagaaaaaattgggggcatttgctacaccaccacacccacaccccatcccagcacacaacaagcagcctggtttacggcagctgctaccataacaatggacaaccctgctccgagcatcgcactggccatcaccgaacccgtggcggcggacttcgtgaaactcaccttccgtgccctgtatatgcgccgggctggtcctggcagcctggagatgactgtgccgggaaggccatccgaccagctgggcacgacagtcatcactgacagccccgtgtactacggccgtggcgccgacgcccgcctcgtggctcgcatacagggagtcacggtcctgatcggtaacacaaacaccttgatcaccttggtgttcaaaaccaacaggataaagggctccacgctcgtcatcaacggaatggtcacggatgggtcacacgaatgggcgatctacggcggaaccggggtgttcgccatggccaccggtgtcatgaacagaagaaaccttgccggcggtagcaacgacgggaactctgacgagcttgccctgcaatgtttctgcccggtgtgtggagcatcacaacaaccgattagcat

SEQ ID NO: 52865 - protein, 165 aa, Zea mays
  misc_feature: Ceres CLONE 1471231-F
  misc_feature (1)..(156): Pfam Name: Dirigent Pfam Description: Dirigent-like protein
MDNPAPSIALAITEPVAADFVKLTFRALYMRRAGPGSLEMTVPGRPSDQLGTTVITDSPVYYGRGADARLVARIQGVTVLIGNTNTLITLVFKTNRIKGSTLVINGMVTDGSHEWAIYGGTGVFAMATGVMNRRNLAGGSNDGNSDELALQCFCPVCGASQQPIS

SEQ ID NO: 52866 - DNA, 641 bp, Zea mays
  misc_feature: Ceres CLONE 1471234-F
  misc_feature: Encodes the peptide sequence at SEQ ID NO. 52867
ggcggccgctctagaactagtggatcccccgggctgcaggaattcgtctcacccctagaaaaatatttatgccacgaatacccggttgctaccttctccttccgcttccctcgcacccaccccacaccgcaagcccaaactgaactcatcgcgaaccagccattctaatcctccagcgcatgcgcatggtcacgagagggtccttctattctcgccgtgtatggagccccgcccgtctccgtgtctaacatatctggcggcatgcgtacagcacctagcatgaatgcaggatgattttagtaatgtcgttcgctgcagttggcggtcatcctagtggatgtcttggcggagcaccggagatgaattgcagctgtcttatgggctatggactcacgctgcgtgtggctggaggacagctctaaccgttttaggaaatcgactatgcgcgccgggatgggactggggtccgagattacgtacatgtggttgagctggctgaccgaaatatcgctgcattgcagaaccttattgagagctctaccgtaggatgtgaagcgtacaaccttggaaccagaagaggtaatctgtgctggacattgttaaagcatttagagaggcttctgggacgaaataactctgag

SEQ ID NO: 52867 - protein, 43 aa, Zea mays
  misc_feature: Ceres CLONE 1471234-F
MILVMSFAAVGGHPSGCLGGAPEMNCSCLMGYGLTLRVAGGQL

SEQ ID NO: 52868 - DNA, 611 bp, Zea mays
  misc_feature: Ceres CLONE 1471236-F
  misc_feature: Encodes the peptide sequence at SEQ ID NO. 52869
ggcggccgctctagaactagtggatcccccgggctgcaggaattcgtctcacccctagaaaaaatgtgacggtcgtcttgtgtcactcatggactctcctctaatggagcccctactagtgcccaacaaccacagtcccggtccggttgtcgccgccacgccgggagaacacggcggtgctgcggtcgacgagagcagcaccctcgtggatgctgccagtggcacggatgagagccacagggcactcgccgacgccgacgtgaagatgaacgacgatggcgacgtacaaagggacgagctgtccgcgtccgtgcagcgccggctggacgagagcagcgccgtggagggggaggatgaagaggaggagattggtgacgacgcggaggccgactacatggcggcgcgcatgggacggcgcctggcggcgctgcccgggaatgcgcatgagagcgagccgttcaccatcttccgcgtggcggggcccatgcgcgagcgcaaccggcacctctacgagccgcatatgatctccatcgggcccttccaccgtggcgccggccggcacctcgccgccatggaggagcacaagtggcggtacctccgcgacattctgg

SEQ ID NO: 52869 - protein, 169 aa, Zea mays
  misc_feature: Ceres CLONE 1471236-F
MEPLLVPNNHSPGPVVAATPGEHGGAAVDESSTLVDAASGTDESHRALADADVKMNDDGDVQRDELSASVQRRLDESSAVEGEDEEEEIGDDAEADYMAARMGRRLAALPGNAHESEPFTIFRVAGPMRERNRHLYEPHMISIGPFHRGAGRHLAAMEEHKWRYLRDIL

SEQ ID NO: 52870 - DNA, 765 bp, Zea mays
  misc_feature: Ceres CLONE 1471238-F
  misc_feature: Encodes the peptide sequence at SEQ ID NO. 52871
  misc_feature (42)..(42): n is a, c, t, g, unknown, or other
  misc_feature (46)..(46): n is a, c, t, g, unknown, or other
  misc_feature (52)..(52): n is a, c, t, g, unknown, or other
  misc_feature (54)..(54): n is a, c, t, g, unknown, or other
agtggatatgatgagatggggggttgggggggggggggggcngggnccgggntnttttctaatttagagggtcggcgggggggcggccgctctagaacttgtggatcccccgggctgcaggaattcgtctcacccctagaaaaaaggagagagagcaatcgagagatgaggagggagcttgcctcccccttacctactgccgccgctgccacggccggtgcctccttctcggctgccgcctcgctccggggctggtgggacgatgtcaacgagtcgccccagtggcaagacggggccttcttctccctcgccgccgcctacgccctcgtctccgccgtcgcactgattcagctcgtcaggatccagcgccgggtgcccgatttcggatggaccacgcagtaagtcttccacctcatgaacttccttgtcaatgggggtccgggactctggtgcttcggcttccatgtccatgtccttcctccttgcgcgcaagaggatagaggtgcggggggtgcgtagattgtccccggggttggttggttgttctcccagcttacaggggtggctgcggagctcgttcgggggcaagaagatataaccaatacagggcgtgtgagatccgcacggaggggaaaaggccttaagggcgcggacagagaggggtccccgcgtagacggggcgaagaaggatgggggtttgggtcgggggcatatgggcgggtaaggggatgtgtccccagcagggaggtgtaaagcaggagaaag

SEQ ID NO: 52871 - protein, 78 aa, Zea mays
  misc_feature: Ceres CLONE 1471238-F
MRRELASPLPTAAAATAGASFSAAASLRGWWDDVNESPQWQDGAFFSLAAAYALVSAVALIQLVRIQRRVPDFGWTTQ

SEQ ID NO: 52872 - DNA, 1974 bp, Zea mays
  misc_feature: Ceres CLONE 1471242
  misc_feature: Encodes the peptide sequence at SEQ ID NO. 52873
aaccccggcgcgcaccatgagccgcgccacgccacgccactcctcctcgtcctcgcaccatgcccccactccccgcgccagcctcctccatcccctccgccccgccgcggggcaccgccaacgacgccgcccgctcctccgtcaacctcctccgctccctcgcgcgcgcgcggcgcgcggacctgtcccaccgcgcgctgctcctcttccgcacgctgcacgcctccccgtccccgccgccgccgcgctactccctgcccgccgcgctctccgcggccgccttcctcgccgcgctcccggagggccgccagctccacgcgctcgccgccaagctcgccctcgcgcccgcccacaccgtcgtcgccaactccctcgtccacttctacgcctcctgcggccgcccgggcgccgcgctcgccgtcttccgccgcgtcccggaccggtcgctcgtgtcgtggaacaccgccgtcgacgcgctcgcgggcaacggggaccacctcgccgcgctcgacctgttccgggagatgcagcgcgacaggcccgacctcgcgcccgacgcctacaccgtgcagagcgtgctcggcgcctgcgcggccaccggcgcgctctcgctcgggctctacgcgcacgcgctgctactccgggagctcggcggcgccggccacgcctcgccggtgtcgcgcgacgtgctcatcaacaactcgctcgttgacctctacggaaagtgcggcgcggtggagctcgcgcgccaggtgttcgaccggatgtccgagcgggacctcgcgtcctggaacgccatggtcctcgcgctcgccaaccacggccgcgtccaggactcgctcgatctgttcgatcggatgacgagggtggagggcctggtgccaaatgccatcacgttcgtcgcggtgctcagtgcctgcaaccacggtggactggtcgacgaagggaggaggtactttgctgccatggtcagtgaccacgggatcaggccgaggatcgagcactacgggtgcatggtggacatccttgcacgggcagggttcatcgaggaggccctcgatgttgtggccgggatgaactgccgtcctgattccatcatctggaggagcctgcttgacgcgtgctgcaagaggaatgctgggctggagctcagtgaggctatggccaagctggcgcttgatgtccctgatgacgctgtgagtggcgtctacgtccttctctcgagggtttacgcgtccgcgcaacggtggaacgatgtgggcatgatccggcagttgatgagccaagagggtttcaagaaggagccagggttcagctccattgaaatggatggatcagtgcaccagtttgtcgcgggtgacacttcgcatcctcagtcggaagagatatacgtgaagctggatgagatccaacagaggctcacatctgctggatacaagccggacttgtcggaggcacctatggtcgccgacattgaccgcaccaaaggcgccaccctgcgtttgcacagcgaacggctagccatatcatttggcctactcaatgcaacacctggggcacccattcggatcctgaagaaccttagagtgtgcaaagactgccacaccatcagcaagctcatatcgaagctatacaatgttgaaatcattgtgagggatcggattcggtttcatcacttcaaggatggatcatgttcttgcaaagattactggtgatccttgaacttgagccatgatgacctgcaatttggagagatcctgctgatgttctattggaagcgcctctgctggcatccaagagggagcttaatgcattttaagtgctgatggttacagcgaccttcaactttaagccgggagaaaagtggctggtggttgtttagcaagttgtgaattatagatggttgtccaccatgtgactgattatagaagctcatttgagcgttttttttcttgatccaaaaaaaaaaaaaaa

SEQ ID NO: 52873 - protein, 551 aa, Zea mays
  misc_feature: Ceres CLONE 1471242
  misc_feature (131)..(165): Pfam Name: PPR Pfam Description: PPR repeat
MPPLPAPASSIPSAPPRGTANDAARSSVNLLRSLARARRADLSHRALLLFRTLHASPSPPPPRYSLPAALSAAAFLAALPEGRQLHALAAKLALAPAHTVVANSLVHFYASCGRPGAALAVFRRVPDRSLVSWNTAVDALAGNGDHLAALDLFREMQRDRPDLAPDAYTVQSVLGACAATGALSLGLYAHALLLRELGGAGHASPVSRDVLINNSLVDLYGKCGAVELARQVFDRMSERDLASWNAMVLALANHGRVQDSLDLFDRMTRVEGLVPNAITFVAVLSACNHGGLVDEGRRYFAAMVSDHGIRPRIEHYGCMVDILARAGFIEEALDVVAGMNCRPDSIIWRSLLDACCKRNAGLELSEAMAKLALDVPDDAVSGVYVLLSRVYASAQRWNDVGMIRQLMSQEGFKKEPGFSSIEMDGSVHQFVAGDTSHPQSEEIYVKLDEIQQRLTSAGYKPDLSEAPMVADIDRTKGATLRLHSERLAISFGLLNATPGAPIRILKNLRVCKDCHTISKLISKLYNVEIIVRDRIRFHHFKDGSCSCKDYW

SEQ ID NO: 52874 - DNA, 638 bp, Zea mays
  misc_feature: Ceres CLONE 1471245-F
  misc_feature: Encodes the peptide sequence at SEQ ID NO. 52875
ccccgcggtggcggccgctctagaactagtggatcccccgggctgcaggaattcgtctcacccctagaaaaagacacttccatcaccgcccatcgaaatccttctaccgccccgctccgtcttccatggctcgtctgctcgcggcgcgagcccttgcgctggcccgcccctcggggacgccatccgccctacgcttctgcccctcccgtgcgctgtcggacgaggtggagttcgtcgagatcgacctatccgaggagtcccctgcctcttcatccggaggggaaggcgagggcgactcctccacggttcaagcacaaatggagtcgcggcgcctggacgacgccatctatggggtgctcgtgcaccgggcggcgcccgaatggctccccttcgtgcccggggcatcctactgggtcccgccggtgccgcggccgctcggggtggctagtctcctcggcgcggctgtgtacaccgcgaggggcgccacggcgatgacagaggaggaggcgttcagcttctctaccggactggggtgtccatccgcggcatactttgagggaggaaaatttccgcgacccgtggacaaatcgagggaagatgctactcatactgacgatggcgatgaaagctaattctat

SEQ ID NO: 52875 - protein, 168 aa, Zea mays
  misc_feature: Ceres CLONE 1471245-F
MARLLAARALALARPSGTPSALRFCPSRALSDEVEFVEIDLSEESPASSSGGEGEGDSSTVQAQMESRRLDDAIYGVLVHRAAPEWLPFVPGASYWVPPVPRPLGVASLLGAAVYTARGATAMTEEEAFSFSTGLGCPSAAYFEGGKFPRPVDKSREDATHTDDGDES

SEQ ID NO: 52876 - DNA, 654 bp, Zea mays
  misc_feature: Ceres CLONE 1471250-F
  misc_feature: Encodes the peptide sequence at SEQ ID NO. 52877
tccccgcggtggcggccgctctagaactagtggatcccccgggctgcaggaattcgtctcacccctagaaaaaaccaacgagcacctctaagccaaagcaagttgctaggtcctttgaaccagcaactgaagcttcctcgtctcatcatcgagaccagtaagcaacatggcggctaatctcaagtgggctcctgttctagccctcgtcgtcgtcgttgctgccatggttggcaccacgagcgccggcaacatcgcagtgtactggggccagaacggcaacgaaggcagcctggcggacgcctgcaactccgggctctacgcctacgtcaacatcgcgttcctcacaaccttcggcaacggacagaccccagtcctcaacctcgccggacactgcgaccccggctctggcagctgcaccggccagagcagcgacatccagacctgccagtcgctgggcatcaaggtgctcctctccatcggcggcgccagcggcagctacggcctctcctccaccgacgacgccaacagcgtggccgactacctgtgggacaacttcctgggcggcagcggctcgtcccgcccgctcggcgccgccgtgctcgacggcatcgacttcgacatcgagaacggccagtcggcgcactacgatgacct

SEQ ID NO: 52877 - protein, 162 aa, Zea mays
  misc_feature: Ceres CLONE 1471250-F
  misc_feature (27)..(162): Pfam Name: Glyco_hydro_18 Pfam Description: Glycosyl hydrolases family 18
  misc_feature: SWISSPROT Homolog: EC 3.2.1.14 Chitinase
MAANLKWAPVLALVVVVAAMVGTTSAGNIAVYWGQNGNEGSLADACNSGLYAYVNIAFLTTFGNGQTPVLNLAGHCDPGSGSCTGQSSDIQTCQSLGIKVLLSIGGASGSYGLSSTDDANSVADYLWDNFLGGSGSSRPLGAAVLDGIDFDIENGQSAHYDD

SEQ ID NO: 52878 - DNA, 662 bp, Zea mays
  misc_feature: Ceres CLONE 1471251-F
  misc_feature: Encodes the peptide sequence at SEQ ID NO. 52879
ccgcggtggcggccgctctagaactagtggatcccccgggctgcaggaattcgtctcacccctagaaaaaatcggccagtacagtgcccaggcggttagggtttcgcccaccacatcgacctacggcgacggccaaacagcaggcgcagccatggcctcccccggcggcggcatgggagcggcctaggcacggccatggcggccggaagcacggccccctgagcgagccccccggcggcgcatgctctggcggcgcgcggttccggccaggcgggcgcggcggcccggcagcgtgcggctccggccaggcgggcgcggcggccccggccaggcaggagcgatgggcatggcggccttgggcataggcgcggcggcccccggcgcgcacgggtgcagctcggcacgagcgcgcctcccccgcggtggtgtgggctgcaccggcgtgcggccctcggatcctcggcggctcgccgcaggccggcggacgagggcgggcacagcccctcggcgcaggcgtggccccggcggccctgtggtagcgtgggcgcggcctccggcgcgcgcgggcgtggccccggctggtccatcggcatgcgggctcgcggctctgacgcgcgggcacggcggcactggccccggcgtgggctcaggcgcgcgtccct

SEQ ID NO: 52879 - protein, 107 aa, Zea mays
  misc_feature: Ceres CLONE 1471251-F
MGMAALGIGAAAPGAHGCSSARARLPRGGVGCTGVRPSDPRRLAAGRRTRAGTAPRRRRGPGGPVVAWARPPARAGVAPAGPSACGLAALTRGHGGTGPGVGSGARP

SEQ ID NO: 52880 - DNA, 672 bp, Zea mays
  misc_feature: Ceres CLONE 1471252-F
  misc_feature: Encodes the peptide sequence at SEQ ID NO. 52881
ctccccgcggtggcggccgctctagaactagtggatcccccgggctgcaggaattcgtctcacccctagaaaaaacgcgcattggtggctcctcacttctgcgccgccacccactacaggtaaggaagaggaggagggcaggatgtcgcaccgtaagttcgagcacccgaggcacggctccctcggcttccttcccaggaagcgctcctcccgccaccgcggcaaggtgaagtcatttcccagggatgaccccaagaagccttgccatctcactgccttccttggctacaaggctggcatgactcacattgtccgtgaggttgagaagccaggatccaaactccataagaaggaaacttgtgaggctgttaccatcattgaaacccctcctcttgtcattgttgggctcgtggcatatgtgaagactcctcgtggcctccgcacactcaactctgtttgggcccaacatcttagcgaagaagtgaggagaagggtctacaagaactggtgcaagagcaagaagaaggttttcccaagtatgctctcaattatgaaaatgatgctggcaaaaaggaaattccacctgcaccttggaaaaaataaaaaaataaggcttctggttatccgggtccctggctcataccccgatttaggaaaatgaagggggttgaa

SEQ ID NO: 52881 - protein, 172 aa, Zea mays
  misc_feature: Ceres CLONE 1471252-F
  misc_feature (50)..(172): Pfam Name: Ribosomal_L3 Pfam Description: Ribosomal protein L3
MSHRKFEHPRHGSLGFLPRKRSSRHRGKVKSFPRDDPKKPCHLTAFLGYKAGMTHIVREVEKPGSKLHKKETCEAVTIIETPPLVIVGLVAYVKTPRGLRTLNSVWAQHLSEEVRRRVYKNWCKSKKKVFPSMLSIMKMMLAKRKFHLHLGKNKKIRLLVIRVPGSYPDLGK

SEQ ID NO: 52882 - DNA, 1307 bp, Zea mays
  misc_feature: Ceres CLONE 1471255
  misc_feature: Encodes the peptide sequence at SEQ ID NO. 52883
accttaaacaaagaggcatttttgtccacgacgccctgcctcgcggcctgagctggcacatctccactcctcgccctctctactgtcctgtctcctcactccaccggtccaacccaacaaccagccccgccgaattccaaggtttcccgcgtgcggcggcgagcggggcgggacgtgccggggacggtggttgggttggattggattggatcggatcggtgccgcccgttgaccagagcgtaaaccagagatgggcaagggcggcggctgcgtccccagcaagaagcgccagccgccggccgccgcgccttcttcgtcgtccgccgcggcggcggtgccgcgcgaggcgcccgaggaggaggcggccgccgcggtcgggcgaaagctgcggctctacatcgtgttctactcgatgtacgggcacgtggagtccctggcacggcgcgcagcggctggcgccggcgcagtggacggcctggaggccgtgctgcggcgggtccccgagacgctcccgccggaggtgctggagaagatgcaggcgccggtcaaggaccccgcggtccccgtgatcgcgtcggccgcggagctgcaggaggctgacggagtgttgtttggcttcccgacgaggtacggcgccatggctgcgcaaatgaaggccttcttcgactccaccggctcgctctgggaggcgcagaagctcgctgggaagcccgccgggttcttcgtcagcaccggaacgcagggcggggggcaggagaccacggcttggacggccatcacccagctagctcaccatggaatgcttttcgtcccaattggctacacctttggttcaggcatgttcgacatggatggtatcagaggaggcagcccctatggcgcgggggtatttgctggcgatggcagcagacaacccagtgagactgaactcgcccttgcagagcaccagggcaagtacatggcctccatagtgaaaaagctagctctccatgcttgagacagccacccctgtgcagtggaagtcacatggtcaccttcctccggtgctcggcttctcctattgtttccggatacatccggcccgtcgtatatgtgcacagcttgccctatcgtttgtgaaagtagccacccctaaattaaggttcatttgtacattgtcggcatattcatattgttgtccatttgaacaataagagtgtcataataaacatcatatgtcatattggttttggtgtttgttttgttgcacggaactgttcttatactataaaagaagagtaattttgttctgaaaaaaaaaaaaaaaa

SEQ ID NO: 52883 - protein, 248 aa, Zea mays
  misc_feature: Ceres CLONE 1471255
  misc_feature (50)..(183): Pfam Name: Flavodoxin_1 Pfam Description: Flavodoxin
MGKGGGCVPSKKRQPPAAAPSSSSAAAAVPREAPEEEAAAAVGRKLRLYIVFYSMYGHVESLARRAAAGAGAVDGLEAVLRRVPETLPPEVLEKMQAPVKDPAVPVIASAAELQEADGVLFGFPTRYGAMAAQMKAFFDSTGSLWEAQKLAGKPAGFFVSTGTQGGGQETTAWTAITQLAHHGMLFVPIGYTFGSGMFDMDGIRGGSPYGAGVFAGDGSRQPSETELALAEHQGKYMASIVKKLALHA

SEQ ID NO: 52884 - DNA, 619 bp, Zea mays
  misc_feature: Ceres CLONE 1471256-F
  misc_feature: Encodes the peptide sequence at SEQ ID NO. 52885
  misc_feature (106)..(106): n is a, c, t, g, unknown, or other
  misc_feature (283)..(283): n is a, c, t, g, unknown, or other
  misc_feature (299)..(299): n is a, c, t, g, unknown, or other
  misc_feature (311)..(311): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (401)..(401): n is a, c, t, g, unknown, or other
  misc_feature (438)..(438): n is a, c, t, g, unknown, or other
  misc_feature (444)..(444): n is a, c, t, g, unknown, or other
  misc_feature (486)..(486): n is a, c, t, g, unknown, or other
  misc_feature (569)..(569): n is a, c, t, g, unknown, or other
tggcggccgctctagaactagtggatcccccgggctgcaggaattcgtctcacccctagaaaaaagatctcaagtcttcacactcctcgccatcacattaaaccantgcaagcagaagcagcgcaatggggaggaggagcatggggctctcctccacagacttctccggcaaaggagtgaaagaggcgccctctctcttctgcgaggcccgcgtgacgatgcgcaagacggcggcgaaagcaaagacggcggcgagactcccggcagccccgtggtacgtgcncccgaccagcgtgctnctacccttttgnccgctgttcggcgcgccccccaccacctggacgggagtatcccgggggcaatcgnnnttggagaacgcgggtgtcgcaaacccgaaactncgccagaaccgggagctggagtcatcccctcccgctngcatgnctggccgtttgggctgctggtccccgactgctcccccgcacnggctcagttccggaaaaggccggtgggtcaaaggcgggttccaaaactttcagcgagaggggcctggataacctcggaaaccngaacttgattccgggcccaaaaaacccctccccttgggggccggggcagg

SEQ ID NO: 52885 - protein, 143 aa, Zea mays
  misc_feature: Ceres CLONE 1471256-F
  misc_feature (53)..(53): Xaa is any aa, unknown, or other
  misc_feature (62)..(62): Xaa is any aa, unknown, or other
  misc_feature (81)..(81): Xaa is any aa, unknown, or other
  misc_feature (105)..(105): Xaa is any aa, unknown, or other
  misc_feature (107)..(107): Xaa is any aa, unknown, or other
  misc_feature (121)..(121): Xaa is any aa, unknown, or other
MGRRSMGLSSTDFSGKGVKEAPSLFCEARVTMRKTAAKAKTAARLPAAPWYVXPTSVLLPFXPLFGAPPTTWTGVSRGQSXLENAGVANPKLRQNRELESSPPAXMXGRLGCWSPTAPPHXLSSGKGRWVKGGFQNFQREGPG

SEQ ID NO: 52886 - DNA, 673 bp, Zea mays
  misc_feature: Ceres CLONE 1471259-F
  misc_feature: Encodes the peptide sequence at SEQ ID NO. 52887
ggagctccccgcggtggcggccgctctagaactagtggatcccccgggctgcaggaattcgtctcacccctagaaaaagaccttatccccttgcggcaaaagcttgtgcgcaactttggcctcttccttcttgattaccggcgcgtgcctcgaggccccagccttctgctaccggtgacccaaggctccctcagcctccgccctcccgcgtggcgccgccttccctgcgatcgccttctcggcggcgcccctgcgcccgcgcctcgcgccgaggccagtggcggtccgggccggggccgaggagccctagacgataatgatctcctggtgctactacaaccactggctgatcgtcatggagttccccaaggtaccacgcggacctccggggagccatgatcgacacctaactcctcacagtcgtgcatcgtcctcgggggggtggaggaagccgagatgaacgtgtacgccttcagcatgaccacctacgtgtggttccagtgcaccgtggacgacgagaccgccgagaacttcaaggctctgcctggggtgatgagggtgctccctgattccgatatccacgtgaaaaacaaggactaccggagtgacaagtacgtgaacggccagataatcacctgcgcgtacccgacgtaccggacgaaggagccgacga

SEQ ID NO: 52887 - protein, 72 aa, Zea mays
  misc_feature: Ceres CLONE 1471259-F
MNVYAFSMTTYVWFQCTVDDETAENFKALPGVMRVLPDSDIHVKNKDYRSDKYVNGQIITCAYPTYRTKEPT

SEQ ID NO: 52888 - DNA, 674 bp, Zea mays
  misc_feature: Ceres CLONE 1471260-F
  misc_feature: Encodes the peptide sequence at SEQ ID NO. 52889
ggagctccccgcggtggcggccgctctagaactagtggatcccccgggctgcaggaattcgtctcacccctagaaaaaaatatacatatgctagatttgctatattgagttgacatgccgttagttgcgatttgcgaagctagctcccaccatctgcgacgccatgtcttcttcctctgtccaacaaacggcctttcccgagcaagaagccgatgcggaaggcgaaacgaaccctgagctctaccagcatttcgccaacttggtctcctccctgccgagctccaaaggcttgtccaacaacaaattctaccgccacgaccaatgctggcactgcagcgtggtgagcatagtgggcgccatggtcgccgacgcgtgcttcagcgcgcgccccctcgacgtcatcgtcgccaccctgcccagtccggcacacgtggatgaagtcgctcctgtacgccacgtgcaccggaaaagcgtcccgtcgtcggcgccccgccgacaagatccctccaaaggttggggccccccaaaccctcaagttcttcaaagacaactccaaccccgggaaaggggcccggaactggaagggtccccaaacctcggtttttcggaaaaaagttcccttttgggggtgttgcaaaatcgggggcgcccaccccggggtgaaaatttttcaa

SEQ ID NO: 52889 - protein, 80 aa, Zea mays
  misc_feature: Ceres CLONE 1471260-F
MKSLLYATCTGKASRRRRPADKIPPKVGAPQTLKFFKDNSNPGKGARNWKGPQTSVFRKKVPFWGCCKIGGAHPGVKIFQ

SEQ ID NO: 52890 - DNA, 647 bp, Zea mays
  misc_feature: Ceres CLONE 1471262-F
  misc_feature: Encodes the peptide sequence at SEQ ID NO. 52891
tggagctccccgcggtggcggccgctctagaactagtggatcccccgggctgcaggaattcgtctcacccctagaaaatcacaactcttcctctgcgtccacacacacacttgagccccacccgtgccgctcccgccccgcatcccttagcctgacgctggcgctgcagccgcccatgtccgccgccccgccccgccgcgtggtcatctgcggcggcggcatggtgggcgcgtgcacggcctacttcctcgccacccacgccgcgtcccccaccgtcccgacgctcgtcgagaggtgcgccccggcgtgcgccgcctcggggaaagccggcggcttcctggcgctggactggagcgactccaccccggcgctgtccaggctcgcgcgggcctccttcacgctccaccgccgcctgaccgacgccctcggcggcgccgacgcctacggcttccgccccgtccacaccctctccatcatgctccccccgcacaccgccgcctcctcctactcgccgcagcacccgctgctcccgccctgagtcgacccctccgcgtccgccgcctcgacgagggagctcgggacccccgacaccaccgcgcatgtccacccgggcctcttcaccaaagacgtcctagacgcagcagaag

SEQ ID NO: 52891 - protein, 120 aa, Zea mays
  misc_feature: Ceres CLONE 1471262-F
MSAAPPRRVVICGGGMVGACTAYFLATHAASPTVPTLVERCAPACAASGKAGGFLALDWSDSTPALSRLARASFTLHRRLTDALGGADAYGFRPVHTLSIMLPPHTAASSYSPQHPLLPP

SEQ ID NO: 52892 - DNA, 643 bp, Zea mays
  misc_feature: Ceres CLONE 1471264-F
  misc_feature: Translation starting site: 84
ctccccgcggtggcggccgctctagaactagtggatcccccgggctgcaggaattcgtctcacccctagaaaaattttgaagcatgcatgacctttgcgagcaggttgtttatgctttctcaatctcagtagggctgagggggttttctgctgggtgtttgcaacaatatgctaatttttgcccttcagtaaataaattgctgaatctatttctgttctttgtcacctactccagggtctttcgctggtctaggttttcttgcatggtacttggctggaaaacttaaagcttttgatcgcaaaggtcacattgcaaaactgtgcttagtttttctgcctctacttgtcgcgtcacttgtggctgtttctcgagttgatgattactggcatcactggcaagatgtctttgccggcggcatcataggtttgctagtatttgatgctcttttgtatttagcatttcgaacacccttcacaatcaaaagtcaatcatggagtgtcattctcttatttcttttcaggtcttacagttgcttcattctgttacctgcagttcttcccatatccctttgacaatgatggtacctttttcgcctttctctacaatatatgctgatgagatattaatacattttattacatg

SEQ ID NO: 52893 - DNA, 662 bp, Zea mays
  misc_feature: Ceres CLONE 1471271-F
  misc_feature: Translation starting site: 144
  misc_feature: SWISSPROT Homolog: EC 2.7.4.6 Nucleoside-diphosphate kinase
  misc_feature (281)..(281): n is a, c, t, g, unknown, or other
tggagctccccgcggtggcggccgctctagaactagtggatcccccgggctgcaggaattcgtctcacccctagaaaaactccgacggcgccgactaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctganaagcactacgccgatctcgcctccaagcccttcttccaggggcctcgtggactacatcatctctggccctgtggtggccatggtctgggagggcaagagcgtctccacaactggccgcaagatcattggcgccaccaaccccctggcttctgagcccggcaccatccgtggcgactttgctgtcgacattggcaggaatgtcattcatggaagtgacagcatggagagtgctaataaggagatggccctgtgggtccccgaaggccctgctgattggcaaacacccaccacccctggatctacgagatgtaaacctgggaagtttacatcaaaccttgagagccagaggaagcatgccacccatttgtgctttagcaatgg

SEQ ID NO: 52894 - DNA, 640 bp, Zea mays
  misc_feature: Ceres CLONE 1471279-F
  misc_feature: Encodes the peptide sequence at SEQ ID NO. 52895
  misc_feature (435)..(435): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
aagctggagctccccgcggtggcggccgctctagaactagtggatcccccgggctgcaggaattcgtctcacccctagaaaaattactctagggataacaggctgatcttccccaatagtccacatcgacgggaaggtttggcacctcgatgtcggctcttcgccacctggagctgtatgtggttccagggttgggctgttcgcccattaatgcagtacgtgagctggggtcagaacgtcctgagacagttcggtccatatccggtgggggcgttagagcattgagaggacctttccctagtacgagaggaccgggaaggacgcacctctggtgtaccagttatcgtgcctacggtaaacgctgggtagcctagtgtggagaggatcactgctcaaatatatagtagtaagccaccccagatgaggctctctcantnnnaacaaccagaatggaattggaaattaaaacgtccgaacgctcgaggacccaattcgacttatagtgagtcgtattacgcgcgctccctggccgtcgatttacaacgtctggactgggaaaaccctgacgttacccaaataagtcgccttgcagcacatccccctttccgccagctggcataaaaccgaagaggcccccccc

SEQ ID NO: 52895 - protein, 66 aa, Zea mays
  misc_feature: Ceres CLONE 1471279-F
  misc_feature: SWISSPROT Homolog: EC 3.2.1.23 Beta-galactosidase
  misc_feature (5)..(5): Xaa is any aa, unknown, or other
  misc_feature (6)..(6): Xaa is any aa, unknown, or other
  misc_feature (7)..(7): Xaa is any aa, unknown, or other
MRLSXXXQPEWNWKLKRPNARGPNSTYSESYYARSLAVDLQRLDWENPDVTQISRLAAHPPFRQLA

SEQ ID NO: 52896 - DNA, 672 bp, Zea mays
  misc_feature: Ceres CLONE 1471281-F
  misc_feature: Encodes the peptide sequence at SEQ ID NO. 52897
ctggagctccccgcggtggcggccgctctagaactagtggatcccccgggctgcaggaattcgtctcacccctagaaaaatgtaccattttgattgggaggttccgggctctgcagcaggggtgtccatggacgagtcctttgggctgacgcttcgccggaaagagaagcttctccttgttccaggattgctttcctgatatcctacatctgtaaaacttgtgtcttgctagctgtacccgggaacagattaaataatgcaaggaataaagtgactctgttcttcgtcagtaactatatattgtaggagtcctgatgatgaataatgggatgtcgtgatttgttgcaactgaaaaaaaaaaaaaaaacgagacgctcggagtacccaattcgccctatagtgagtcgtattacgcgcgctcactggccgtcgttttacaacggcgtgactggaaaaacctggcgttacccaacttaatcgccttgcacaacatcccccttttcgcaggttggggtattagcgagaaggcccgcccccgatccgcctttcccaattttggcccagcctggattggcgaaatggaaattgtgtaccccctttatatttttggttaaaattccccgtttaaaattttttgttaaaatccaggcctccctttttttttaaccccaa

SEQ ID NO: 52897 - protein, 39 aa, Zea mays
  misc_feature: Ceres CLONE 1471281-F
MYHFDWEVPGSAAGVSMDESFGLTLRRKEKLLLVPGLLS

SEQ ID NO: 52898 - DNA, 645 bp, Zea mays
  misc_feature: Ceres CLONE 1471283-F
  misc_feature: Encodes the peptide sequence at SEQ ID NO. 52899
  misc_feature (228)..(228): n is a, c, t, g, unknown, or other
  misc_feature (305)..(305): n is a, c, t, g, unknown, or other
ggagctccccgcggtggcggccgctctagaactagtggatcccccgggctgcaggaattcgtctcacccctagaaaaaaccaatccataactcgaaaccttttcttgtgctctgttctgtctgtgtgtttccaaagcaaacgaaagaggtcgaggatgtcttgcagctgcggatcaagctgcaactgcggatcaagctgcaagtgcggcaagatgtaccctgacctgnaggagaagagcggcgggggcgctcaggccagcgccgccgccgtcgtcctcggcgttgcccctgagacgaagaaggcngcgcagttcgaggcggcgggcgagtcccgcgaagccgctcacggctgcagctgcggtgacagctgcaagtgcagccccctgcactgctgatcctgctgcgttgtttcgtttgcggcatgcatggatgtcacctttttttactgtctgctttgtgcttgtggcgtgtcagaataaaggatggagccatcgtctggtctgactctggctctccgccatgcatgcttggtgtcggttctgttgtgctttgtgtttgggcatgtaatcctatggcatcgttacacaccatgcatctctgatctctttgggccagtgtgtgtgactatgtcccaatctacaacgg

SEQ ID NO: 52899 - protein, 79 aa, Zea mays
  misc_feature: Ceres CLONE 1471283-F
  misc_feature (1)..(79): Pfam Name: Metallothio_2 Pfam Description: Metallothionein
  misc_feature (25)..(25): Xaa is any aa, unknown, or other
MSCSCGSSCNCGSSCKCGKMYPDLXEKSGGGAQASAAAVVLGVAPETKKAAQFEAAGESREAAHGCSCGDSCKCSPLHC

SEQ ID NO: 52900 - DNA, 654 bp, Zea mays
  misc_feature: Ceres CLONE 1471285-F
  misc_feature: Encodes the peptide sequence at SEQ ID NO. 52901
  misc_feature (406)..(406): n is a, c, t, g, unknown, or other
  misc_feature (482)..(482): n is a, c, t, g, unknown, or other
  misc_feature (583)..(583): n is a, c, t, g, unknown, or other
  misc_feature (588)..(588): n is a, c, t, g, unknown, or other
  misc_feature (621)..(621): n is a, c, t, g, unknown, or other
ggagctccccgcggtggcggccgctctagaactagtggatcccccgggctgcaggaattcgtctcacccctagaaaaagcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccaatgctcttctggggttcgagaagcttgtgaaggccaagacacaagtggttgctggcacgatgtactatctcactattgaagtgaaggatggcgaactcaagaagctctaccaagctaangtatgggagaagccatgcgagaagttcaaggagctgcacgaattcaaacctgttgaagagggtgctagcgcctaangatgtctccttctccatgtgcgagcctgaaagctcaagcaaagttgcagaataaggagccatgctcccttgtgtaatttcataagactaccaccctcatanggctngtttggttgtgtctgtaccgaagggaattgaangtgattaattttcctttctatctaatagagggt

SEQ ID NO: 52901 - protein, 103 aa, Zea mays
  misc_feature: Ceres CLONE 1471285-F
  misc_feature (10)..(98): Pfam Name: Cystatin Pfam Description: Cystatin domain
  misc_feature (79)..(79): Xaa is any aa, unknown, or other
MANNTGTLVGGIQDVPGSENDLHLQELARFAVDEHNKKANALLGFEKLVKAKTQVVAGTMYYLTIEVKDGELKKLYQAXVWEKPCEKFKELHEFKPVEEGASA

SEQ ID NO: 52902 - DNA, 667 bp, Zea mays
  misc_feature: Ceres CLONE 1471292-F
  misc_feature (378)..(378): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (534)..(534): n is a, c, t, g, unknown, or other
  misc_feature (548)..(548): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (599)..(599): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (607)..(607): n is a, c, t, g, unknown, or other
  misc_feature (609)..(609): n is a, c, t, g, unknown, or other
  misc_feature (610)..(610): n is a, c, t, g, unknown, or other
  misc_feature (612)..(612): n is a, c, t, g, unknown, or other
  misc_feature (613)..(613): n is a, c, t, g, unknown, or other
  misc_feature (615)..(615): n is a, c, t, g, unknown, or other
  misc_feature (616)..(616): n is a, c, t, g, unknown, or other
  misc_feature (621)..(621): n is a, c, t, g, unknown, or other
  misc_feature (623)..(623): n is a, c, t, g, unknown, or other
  misc_feature (632)..(632): n is a, c, t, g, unknown, or other
  misc_feature (636)..(636): n is a, c, t, g, unknown, or other
  misc_feature (638)..(638): n is a, c, t, g, unknown, or other
  misc_feature (646)..(646): n is a, c, t, g, unknown, or other
  misc_feature (647)..(647): n is a, c, t, g, unknown, or other
  misc_feature (651)..(651): n is a, c, t, g, unknown, or other
  misc_feature (656)..(656): n is a, c, t, g, unknown, or other
  misc_feature (661)..(661): n is a, c, t, g, unknown, or other
  misc_feature (665)..(665): n is a, c, t, g, unknown, or other
tggagctccccgcggtggcggccgctctagaactagtggatcccccgggctgcaggaattcgtctcacccctagaaaaagcaatgcactagctcctcctctcttgcccaccagcgactcccgtagctggaactcgctcgtcaaaaggaaaaggaaaacttcgcttcagctcgttgacagacgacgactcagagcaaaatgggtatacctggggtgaatttacgggtggggacctaggactggctgtcgctgcatagccaagatcaccaagggtccctggactggtctcaaaaagggaatttctagcatccggaaaaaaaagttggaaattttcgatggataagaaaggaaaaaagaaagggtgggtggtttgggtccnttggggaaaatttccaccccccaaaaaaacctcctgcaaagaagggtgtgggcccaagggcccggggaaaaatcccgaaaagggggaatggtcatccgctaaggggtgggccaataacccacccccggcccaagggagggtggnnnnnnnncccgnctcccttttttttntnnnnnnnnnnnnnnnnnnnnnnnnnnnnnnnnnntnnnnnnnnnnnnntntnnnnntntnntnntnnttttntnttttccccntttntnttttcttnntttnttttnccccntttncg

SEQ ID NO: 52903 - DNA, 643 bp, Zea mays
  misc_feature: Ceres CLONE 1471293-F
  misc_feature: Encodes the peptide sequence at SEQ ID NO. 52904
ggagctccccgcggtggcggccgctctagaactagtggatcccccgggctgcaggaattcgtctcacccctagaaaaaccactcatcaccagctagtagctctagcaaagcacttgccatctaccgaccgccgcattccaaacagcccgacgagctagcagagcggcaggcacctcctccaggaacatggcccgcacgcagcagttggcagtagtggcgacagccgtggtggccttggtgctgctggcggcggcgacgtcggagggcggcatcagctgcgggcaggtggcgtcggccatcgcgccctgcatctcctacgcgcgcggccagggctcagggccctccgccggctgctgcagcggcgtcaggagccctcacaacgccgccggcaccaccgccgaacgccgcgccgcctgtaactgcctcaagaacgccgccgccggcgtcagcggcctcaacgccggtaacgcccgcagcatcccctccaagtgcggcgtcagcatccccctacacatcagcacctccaccgactgctccagggtgaaaactgaccctaacgacgacgacggggccgggcggccgcctgaagacgatccatatctatcccgccgtcgtcggcgcctgcggttcggaacgtcatgaa

SEQ ID NO: 52904 - protein, 151 aa, Zea mays
  misc_feature: Ceres CLONE 1471293-F
  misc_feature (31)..(116): Pfam Name: Tryp_alpha_amyl Pfam Description: Protease inhibitor/seed storage/LTP family
MARTQQLAVVATAVVALVLLAAATSEGGISCGQVASAIAPCISYARGQGSGPSAGCCSGVRSPHNAAGTTAERRAACNCLKNAAAGVSGLNAGNARSIPSKCGVSIPLHISTSTDCSRVKTDPNDDDGAGRPPEDDPYLSRRRRRLRFGTS

SEQ ID NO: 52905 - DNA, 665 bp, Zea mays
  misc_feature: Ceres CLONE 1471294-F
  misc_feature: Encodes the peptide sequence at SEQ ID NO. 52906
  misc_feature (498)..(498): n is a, c, t, g, unknown, or other
  misc_feature (612)..(612): n is a, c, t, g, unknown, or other
aagctggagctccccgcggtggcggccgctctagaactagtggatcccccgggctgcaggaattcgtctcacccctagaaaaacttatcatccccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagcttgaagatattgttccttcatcacacaactgtgatattccgcatgtgaaccgtactgagtaccagctgattgatatatcagaagatggatttgtgagccttcttacttcagatggcaacacntaggatgatcttagactccccactgatgagactcttgtggcccagatcaaggaagggggtttgaagcgcaagggatcttgtgtgactgtccagtctgctatgggggaagagcanatctgcgcgctgaaggatgttggcccccagtaacttacctgcgcttggaaact

SEQ ID NO: 52906 - protein, 112 aa, Zea mays
  misc_feature: Ceres CLONE 1471294-F
  misc_feature (30)..(64): Pfam Name: KOW Pfam Description: KOW motif
MSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNT

SEQ ID NO: 52907 - DNA, 664 bp, Zea mays
  misc_feature: Ceres CLONE 1471296-F
  misc_feature: Encodes the peptide sequence at SEQ ID NO. 52908
  misc_feature (547)..(547): n is a, c, t, g, unknown, or other
  misc_feature (548)..(548): n is a, c, t, g, unknown, or other
  misc_feature (560)..(560): n is a, c, t, g, unknown, or other
  misc_feature (652)..(652): n is a, c, t, g, unknown, or other
tggagctccccgcggtggcggccgctctagaactagtggatcccccgggctgcaggaattcgtctcacccctagaaaaatagcacagcacaaggagaggccgagaagcgctttagccgtagccgtagcgataagagtgagctagctggtgcacaccggcatggcggccacggcgtactccgtggcgctcctcggcggcgcgcgcctccccgccgctccgcgctccgccctcctccctcggcgcagcgtctgccagcttcgcttccaagatgcaccgaggctctccctgctccgtgcgaaggccgcttccgaggacacatcggcctccggcgacgagttgatcgaggacctcaaagcgaagtgggacgccgttgaggacaagcccaccgtcctcttgtacggcggcggcgccgtcgtcgccctatggctgacgtccgtggtcgtgggcgccatcaacgccgtgccgctgctccccaagatcctggagctcgttggggctcgctacaccggctggttcgtgtaccgctacctttctctttaagaagcanngaagagtggccngccgacattgagaccttgaagaaaaaaatagctggaacagaataaacgctcatggaaagttttagagcgtcttttcttcttgggaagagatnctatcggatcga

SEQ ID NO: 52908 - protein, 126 aa, Zea mays
  misc_feature: Ceres CLONE 1471296-F
MAATAYSVALLGGARLPAAPRSALLPRRSVCQLRFQDAPRLSLLRAKAASEDTSASGDELIEDLKAKWDAVEDKPTVLLYGGGAVVALWLTSVVVGAINAVPLLPKILELVGARYTGWFVYRYLSL

SEQ ID NO: 52909 - DNA, 646 bp, Zea mays
  misc_feature: Ceres CLONE 1471308-F
  misc_feature (354)..(354): n is a, c, t, g, unknown, or other
ggagctccccgcggtggcggccgctctagaactagtggatcccccgggctgcaggaattcgtctcacccctagaaaattcaggtggaaacgatttaggctggagatggaaccacccatgttcggatgcttggtacatctgaccaatctgcaaagctaaatgcgcaatgtcttgaaatcaacatgcacgtgcagctattcattcgacgatttgctgaggtcaaggcgtgtgaaaaaaatcagctgcattcactaactgcaggtgccctctgccactatataatatataagactagggggagaagttttccttcccccggaaagcacggctgtacatattatattagggattggtnggttgtttgtgcaggcatttttgtatgcatcatattccggcctgtatgggtccaaaactgtaaagtgaaaatgacacattcaaaggatgagagtttttgtttgacaaaaaaaaaaaaaaaaccagacgctccaggtacccaattccgcctatagggaagtcgtataccccccgcctccctggccgtcttttttacaacgtcctgactggaaaaaacctggcgttacccaaactaaatccccttggaacacaatccccctttcgccaagtggggataatagcaaaaagggccc

SEQ ID NO: 52910 - DNA, 661 bp, Zea mays
  misc_feature: Ceres CLONE 1471313-F
  misc_feature: Encodes the peptide sequence at SEQ ID NO. 52911
ggagctccccgcggtggcggccgctctagaactagtggatcccccgggctgcaggaattcgtctcacccctagaaaaaaccgttgtagcaagttctcccatctagcaacaccataatcgcaggagaatcgctgctccaccagactcggtttcctcttgcttcagcgtcaaaatcatggccgcagctggcaagtcgtcatcggccatggaggagacggttgccgcgacggccgccgcgcgggggcggctcgcgattgaccggcaggccgtccacaggagcatcacctacctgctcatgatggccgccctcgtcgccacctacgcacttcactagatttcggtctgctccggctcgtgcagacctcacgggaaaggaaggcttttgtgcgcttctgcttcacgaccgcctcaaccacttcagagttcccctagcacaaacttcattcgttcgtcttccaaccttgtattgtatggagaatcgtagatgaagatgcatgtgtatgtgtgctacatctccatacactgcacaagttgttttcatatacttctttccgggggattaatctgcacaaaatattcatttgttggcaaaaacgatcaacgttaccttggttttcggcttaggcttggtaacaacaacaaaaaaaaaacgagaaccctcg

SEQ ID NO: 52911 - protein, 52 aa, Zea mays
  misc_feature: Ceres CLONE 1471313-F
MAAAGKSSSAMEETVAATAAARGRLAIDRQAVHRSITYLLMMAALVATYALH

SEQ ID NO: 52912 - DNA, 635 bp, Zea mays
  misc_feature: Ceres CLONE 1471321-F
  misc_feature: Encodes the peptide sequence at SEQ ID NO. 52913
ggcggccgctctagaactagtggatcccccgggctgcaggaattcgtctcacccctagaaaaattcctagctacgactgtatttttgttcagcctgacccgtgagttcgatcgatctatgcatgcgttggtgcagacgaagcttaagaccgtggttgtatgcgaccgtaattcagttgttgcatctaagatggtaatgataatgacgagtacgtagaaccattccagcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaatcagctcatttttttaaccaataggccgaaatcggcaaaatcccttataaatcaaaagaatagaccgagatagggttgagtgttgctccagttttgaacaagagtccactattaaagaacgtggactcc

SEQ ID NO: 52913 - protein, 32 aa, Zea mays
  misc_feature: Ceres CLONE 1471321-F
MHALVQTKLKTVVVCDRNSVVASKMVMIMTST

SEQ ID NO: 52914 - DNA, 677 bp, Zea mays
  misc_feature: Ceres CLONE 1471324-F
  misc_feature: SWISSPROT Homolog: EC 3.2.1.23 Beta-galactosidase
  misc_feature (677)..(677): n is a, c, t, g, unknown, or other
aagctggagctccccgcggtggcggccgctctagaactagtggatcccccgggctgcaggaattcgtctcacccctagaaaattctcatatttatttgacgcgggggtggacgtggacgtggaactatggaagttatcacggcgaacttttgcttagagactttgtcatgctttcggtctgagacagtttgatgagcattcctagggacaatcgatgttaccagtgcctgcgtcttgtgggagttcttcatgcaatgtgtaccatttgactattattgcatgcgcggaatttgctcaaaaagacaatgacaagactctcgaggtacccaattcgccctatagtgagtcgtattacgcgcgctcactggccgtcgttttaaggcgtgcgtggactgggaaaaccctggcgttacccaccttaatcggcttgcaacgcatccccctttctccagcgtgggtaataacgaagacgcccgcaccggatccccttcccaacaattgcccgatcctgaatggcgaatggtaaatcctaaccgccaatattttggtaaaaatccgggttaatttttttgttaagtcacctcctttctttgacccatgggggccgaaacccgcaaaaatcccttttcaattcaaaggaattcgcccgacactggggtccagggggggtttccccn

SEQ ID NO: 52915 - DNA, 651 bp, Zea mays
  misc_feature: Ceres CLONE 1471327-F
  misc_feature: Encodes the peptide sequence at SEQ ID NO. 52916
  misc_feature (287)..(287): n is a, c, t, g, unknown, or other
ggagctccccgcggtggcggccgctctagaactagtggatcccccgggctgcaggaattcgtctcacccctagaaaactcgagcctgacccttacgccttcgctcgcgccgccgccgccgccgccgctacgctccgcacctcgcttcatttcgtgtcgccaagatgacgaagcgcactaagaaggcaggaattgttggcaaatatggaacaggtatggtgctagcttgcgtaagcaaatcaagaagatggaggtatctcagcattccaagtacttttgcgagttctngtggaagtttgctgtgaagaagaaagcagttggaatttgggggtgcaaggactgtgggaaggtgaaggctggtggtgcttacaccatgaacactgctagtgcggtcaccgtcaggagcacgatccgcccgctgagggagcagactgaagcatgatatagctctttatattattggggtttcctgtagttgctcttgtcaggcatggttgtgggggcttatctagtggaaatgtggaatcactgtactggctgttttgccaagacaatgctccttatatttggttatgctctcagatctcaaaggtgtgtaagaattggcccttggtaccggttctgatctgacaggtgattattcatcctatgc

SEQ ID NO: 52916 - protein, 64 aa, Zea mays
  misc_feature: Ceres CLONE 1471327-F
  misc_feature (1)..(63): Pfam Name: Ribosomal_L37ae Pfam Description: Ribosomal L37ae protein family
  misc_feature (14)..(14): Xaa is any aa, unknown, or other
MEVSQHSKYFCEFXWKFAVKKKAVGIWGCKDCGKVKAGGAYTMNTASAVTVRSTIRPLREQTEA

SEQ ID NO: 52917 - DNA, 654 bp, Zea mays
  misc_feature: Ceres CLONE 1471332-F
  misc_feature: Encodes the peptide sequence at SEQ ID NO. 52918
  misc_feature (214)..(214): n is a, c, t, g, unknown, or other
  misc_feature (252)..(252): n is a, c, t, g, unknown, or other
  misc_feature (257)..(257): n is a, c, t, g, unknown, or other
  misc_feature (280)..(280): n is a, c, t, g, unknown, or other
  misc_feature (298)..(298): n is a, c, t, g, unknown, or other
  misc_feature (303)..(303): n is a, c, t, g, unknown, or other
  misc_feature (337)..(337): n is a, c, t, g, unknown, or other
  misc_feature (339)..(339): n is a, c, t, g, unknown, or other
  misc_feature (576)..(576): n is a, c, t, g, unknown, or other
  misc_feature (577)..(577): n is a, c, t, g, unknown, or other
tggagctccccgcggtggcggccgctctagaactagtggatcccccgggctgcaggaattcgtctcacccctagaaaaaaaactgaattcgctgcgctgcacttccctcgtcggccccggcccgtgcgcgggcgtaccggctctacctcacaaaatccgccatggctggcggttcgctcgagccaggcaaactggagccgcgcccaacagcgcnagaggaggctccggcccctaccgcaaacgctgaggacnaagcngaggcggaggaactgcaaagtgntgaggagctggagagagnagtanccgatctggaccgccgcgtcctcaacacgtcggngnacccgcaccctcctctcgacgctattgtctccccgctcgacgcgctccgcccgtccgctcgccttgaagctgcagttatctcggaaacatcagttacggaagacgaccaggagcttgagaagaaagtcaagatcctcaaatctaagatcgaagctaatattgcagacctgccgaaggtacttgaaaaaaataaatgaacccgttgctcggtgtgagaatttcacgaatttgaatgtnnatgtcaatccctgtgtttcgaaagaagtggtaaagtttgacccatcatgcatgaaactggctgattcagtgttatgg

SEQ ID NO: 52918 - protein, 124 aa, Zea mays
  misc_feature: Ceres CLONE 1471332-F
  misc_feature (18)..(18): Xaa is any aa, unknown, or other
  misc_feature (31)..(31): Xaa is any aa, unknown, or other
  misc_feature (40)..(40): Xaa is any aa, unknown, or other
  misc_feature (46)..(46): Xaa is any aa, unknown, or other
  misc_feature (48)..(48): Xaa is any aa, unknown, or other
  misc_feature (59)..(59): Xaa is any aa, unknown, or other
  misc_feature (60)..(60): Xaa is any aa, unknown, or other
MAGGSLEPGKLEPRPTAXEEAPAPTANAEDXAEAEELQSXEELERXVXDLDRRVLNTSXXPHPPLDAIVSPLDALRPSARLEAAVISETSVTEDDQELEKKVKILKSKIEANIADLPKVLEKNK

SEQ ID NO: 52919 - DNA, 670 bp, Zea mays
  misc_feature: Ceres CLONE 1471334-F
  misc_feature (378)..(378): n is a, c, t, g, unknown, or other
  misc_feature (395)..(395): n is a, c, t, g, unknown, or other
ggagctccccgcggtggcggccgctctagaactagtggatcccccgggctgcaggaattcgtctcacccctagaaaattcctcgtgtctcttctgaagaagaacgggcagaatgtaagatgtctctacatcaagagcaccatggggcaaaccattcaggattttctaagtctgtttttttgtgaagtctgctctttatgatatttggtttttgaaccgaggttgtcttgaactaaaactcttgttagatcatgctttggttcgtaggatatctgagtctgggcaagtgtcttactcttggcgccatgtctttggaatctctctatatagttttttggagagctcagcataatatgggtatgatgcgttataccccggnccggggaggaaaacggnaaggaagaggtctagggaaaaattgacgccaatttgtttgaaaggcgggccgctcggggtcccctattcgccctatagggagtcgtattacgcgcgctcagtgggcgtcttttaacaacttccggacgtgggaaaacccttgttttacccaacttaatccgcttgggaaaaatccccccttccacccggtggggaaatacccaaaaaagccccgcaccaatgccccttcccaaaaatttccccacccctaaaatgccaatggaaaattgttaacc

SEQ ID NO: 52920 - DNA, 651 bp, Zea mays
  misc_feature: Ceres CLONE 1471335-F
  misc_feature: Pfam Name: 6PGD Pfam Description: 6-phosphogluconate dehydrogenase, C-terminal domain
  misc_feature: SWISSPROT Homolog: EC 1.1.1.44 Phosphogluconate dehydrogenase (decarboxylating)
  misc_feature: SWISSPROT Homolog: EC 3.2.1.23 Beta-galactosidase
  misc_feature (386)..(386): n is a, c, t, g, unknown, or other
  misc_feature (413)..(413): n is a, c, t, g, unknown, or other
tggagctccccgcggtggcggccgctctagaactagtggatcccccgggctgcaggaattcgtctcacccctagaaaaaatggacaggcaggcggcgtggcgcaaggtggtgtgcctcgccatcaacaacggcgtcagcaccccgggaatgtccgctagcctggcctacttcgactcctaccgcagggacaggctgcctgccaacctggtgcaggcccagagggactacttcggggctcacacctacgagagggtcgacatgcctggctctttccacaccgagtggttcaagattgcgcgcaacatctccaacaactgatgagctgctcaacggatggcatgtcccgggtgttgactactccagtcggtaatgagatttcctgcangaacttgtctattgatcttctgaaagnaattatttatatgaactaaataagagcagacatgcttgtgtttgggcaccgtaaaaaaaaaaaaaaaaacgagacgctcgaggtacccaattcgccctatagtgagtcgtattacgcgcgctcactggccgtctttttacaacgtcctgactgggaaaaccctggcgttacccaatttaatcggcttgcagcacatccccctttcgccagctggcgtatagcggagaggcccgcaccg

SEQ ID NO: 52921 - DNA, 650 bp, Zea mays
  misc_feature: Ceres CLONE 1471336-F
  misc_feature: SWISSPROT Homolog: EC 3.2.1.23 Beta-galactosidase
  misc_feature (192)..(192): n is a, c, t, g, unknown, or other
tggagctccccgcggtggcggccgctctagaactagtggatcccccgggctgcaggaattcgtctcacccctagaaaaaaattgtacaggcatgtaggtttagctttctggtatgtagctaaattcaaagcatcatcttgtagccttatgtggttaaccagatctttgatctattagttaatttagtaaacncgacagaaaaaaaaaaaatgaaaaaaaaaaaaaaaagagaaaaaaaaaaaaaaaaccgagacgctcgaggtacccaattcgccctatagggagtcgtattacgcgcgctcactggccgtcgttttacaaggtcgtgacggggaaaaccctggcgtaacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaagaacgtggactccaacgtcaaagg

SEQ ID NO: 52922 - DNA, 658 bp, Zea mays
  misc_feature: Ceres CLONE 1471339-F
  misc_feature: Encodes the peptide sequence at SEQ ID NO. 52923
  misc_feature (455)..(455): n is a, c, t, g, unknown, or other
  misc_feature (459)..(459): n is a, c, t, g, unknown, or other
  misc_feature (460)..(460): n is a, c, t, g, unknown, or other
  misc_feature (508)..(508): n is a, c, t, g, unknown, or other
  misc_feature (619)..(619): n is a, c, t, g, unknown, or other
ggagctccccgcggtggcggccgctctagaactagtggatcccccgggctgcaggaattcgtctcacccctagaaaatcgatgcccccaattaattcgggtcccgtggtgtggcggcagcggcagcggcagcagtactgcctccactgcagtcccaggttagcgctctcagcggtggcggccggcgaccggcgacatcctccggtatcgactcccgtagagtggagcgttgaaccacgctgcggacctgcattcaccagtccgccgtttccttcgccttctccgcgtggtccggttgctctggccactgatggccggtgacattacttgcggatccttgctgcaaaaattgcagttgatatgggatgaagtttgcgagagtgatgaggatcgtgacaaggtcctttatcagctggatcaggaatgccttgatgtttacaagaggaaagttgaccnagcnnactactctagggatctcctgatccaggctctggatgactcaaagatangaacttgctaagcttctttctggtcttggaaaaaagctattggcagaacccctgagaagaacacaggacaatcaagcagcagctagctgctatagcgcaacactttgagcngttgacttaacggaaaaaaaaaaaaaaaacgagacgctc

SEQ ID NO: 52923 - protein, 69 aa, Zea mays
  misc_feature: Ceres CLONE 1471339-F
  misc_feature (49)..(49): Xaa is any aa, unknown, or other
  misc_feature (51)..(51): Xaa is any aa, unknown, or other
  misc_feature (67)..(67): Xaa is any aa, unknown, or other
MAGDITCGSLLQKLQLIWDEVCESDEDRDKVLYQLDQECLDVYKRKVDXAXYSRDLLIQALDDSKIXTC

SEQ ID NO: 52924 - DNA, 672 bp, Zea mays
  misc_feature: Ceres CLONE 1471348-F
  misc_feature (335)..(335): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (348)..(348): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (374)..(374): n is a, c, t, g, unknown, or other
  misc_feature (393)..(393): n is a, c, t, g, unknown, or other
  misc_feature (400)..(400): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (425)..(425): n is a, c, t, g, unknown, or other
  misc_feature (429)..(429): n is a, c, t, g, unknown, or other
  misc_feature (430)..(430): n is a, c, t, g, unknown, or other
aagctggagctccccgcggtggcggccgctctagaactagtggatcccccgggctgcaggaattcgtctcacccctagaaaaacaacaatacagcaaaaggtgttgagccctttcatgtttgtagtagaaagggtcatgtactcaggttgtccaagttttgtaagttgatgatggccgcaagtgatagtcatctgtgtttatgtttaatcatgccgcacttgtgagttgtaagaacggacgtctcaaaagggtcgaaagcgtgaggtgtgttgtgttgtgtgcatgaccttaatccctcatgaacctaaaagaatcgtgagaggtaaaaaaaaanttnnnnnnnaaanaaaataaaaaaaaaaannnaaaaccntaaaagaaaaaaaaatagnaaaaaantaaataattatttttttnnnaaaangaanncccgggccgctcgagggaccccatttccccctatggggagcctaattacgcccgctcactgcccttctttttaaacgcccgtggcgggaaaacccctggggttaccccaattaaatccccttgaaaaaattccccctttccacggttgggggaaaaaggaaaaaagccccaaaccaatcccccttccccaaaaattcccccaccctgaaggggaaaatggaaaattcaaacccttatatttt

SEQ ID NO: 52925 - DNA, 686 bp, Zea mays
  misc_feature: Ceres CLONE 1471357-F
  misc_feature: Encodes the peptide sequence at SEQ ID NO. 52926
  misc_feature (378)..(378): n is a, c, t, g, unknown, or other
  misc_feature (396)..(396): n is a, c, t, g, unknown, or other
  misc_feature (399)..(399): n is a, c, t, g, unknown, or other
aaagctggagctcaccgcggtggcggccgctctagaactagtggatcccccgggctgcaggaattcgtctcacccctagaaaaagtaggagtaggagcaggagatagcgcgggcggggaggggaaggagacaagtgaactcagagaagaactagcgcggcgggcgagcattgcaagccgagctgcaggggcccggagcggagaccggaggagggagacgtcgcttgcgatgtcaccggcagcatccgccgccgaaaccgccgtcgtcgtcgtcgtcgcaagcgtcccgagccagcagcagagcagccaccgcgccgcggcgccgtccgtcccgtcgtcctacgccgtctgggagaaggagcggtaaggcgtctgcagntttacgacgacgtcgtcntcntctgccaccctactactgctgctgctgctgcaaggggaagtaaaaggaacgggaaaggggaaggcctgggaggtggaggcggcccattgcgagtgctggcgggttcccggagggagggacgccgggcgtacctcgcggggggggccgcgcccaagtccctgggcccgctggggtctggcggcccccgccccgcagggggggggggaaacaagaccccggcgcgggggggccccctccgccccgggccgaagggcgcccgccccggccccctccccgggtcccgccgc

SEQ ID NO: 52926 - protein, 45 aa, Zea mays
  misc_feature: Ceres CLONE 1471357-F
MSPAASAAETAVVVVVASVPSQQQSSHRAAAPSVPSSYAVWEKER

SEQ ID NO: 52927 - DNA, 649 bp, Zea mays
  misc_feature: Ceres CLONE 1471360-F
  misc_feature: Translation starting site: 168
  misc_feature: SWISSPROT Homolog: EC 2.5.1.18 Glutathione transferase
  misc_feature (435)..(435): n is a, c, t, g, unknown, or other
  misc_feature (561)..(561): n is a, c, t, g, unknown, or other
  misc_feature (570)..(570): n is a, c, t, g, unknown, or other
  misc_feature (582)..(582): n is a, c, t, g, unknown, or other
  misc_feature (649)..(649): n is a, c, t, g, unknown, or other
ggagctccccgcggtggcggccgctctagaactagtggatcccccgggctgcaggaattcgtctcacccctagaaaaaggctctcttctatcctgctctgctagtgccaggattccgccctatccatcccatcaacctcagctaaggtccccagcggcggcgaggcgatggcggcgcctgtgacggtgtacggaccgatgctctcaccagctgtggcccgcgtggcggcctgcctcctggagaaggacgtgccgttccagatcgagccggtggacatgtccaagggcgagcacaagtcgccgtccttcctcaagctccagcccttcggacaggtccctgccttcaaggaccacctcacaaccgtctttgagtcaagggctatttgccgttacatatgcgaccagtatgcggactctggtaatcaggccctcttcngcaagaaagagacggcgcggttggccgcgctgccattgaacagtggatagagtctgaaagccagagctttaccccaccgagcttggctattatcttccagctcgcatttgcaccgatgatgggccnggacactgnactggctgtggntgagcagaatgaagcgagcttgcgaaggtgcttgatgtgtatgacaaacggctgggggagagccatn

SEQ ID NO: 52928 - DNA, 691 bp, Zea mays
  misc_feature: Ceres CLONE 1471362-F
aaagctggagctccccgcggtggcggccgctctagaactagtggatcccccgggctgcaggaattcgtctcacccctagaaaagtccaaaaccctagccctcgcgccgccgccgccgtgcccagcgctcgagctcctcgcctgccgcgagctcgcgccgcaacgccaccatgaagttcacatcgcgaacccgtctaccggggtgccagagaagctgggaatcgatgacgaccagaaactacgtgccttttatgaccgagggatctcccaggaggtcagtggtgatgctctgggtgaggagtttaagggttatgtcttcaagatcatgggtgggatgtgacaaacagggcttcccaatgaagcaaggagttctgacctctgggcggggccccctttctgctccacagaggcactcccttcctcccccggttatggaaggcgtaatggtgaccgcaagaagaagtcctgcccgtggtttttattgtaagccaaaacctatctggttatcaacttgggaaattgttgaaaaagggggaaaaacaacctgccttggtttaactgacccctgaaaaagccaaggggtgagggggccccaaaagggcccctccaagatcaaggaaggcttgtttaattctttccaaagaaaaaaccaacctgccccaaattaacttaaaacccggtccccgcagggt

SEQ ID NO: 52929 - DNA, 698 bp, Zea mays
  misc_feature: Ceres CLONE 1471363-F
  misc_feature: Encodes the peptide sequence at SEQ ID NO. 52930
  misc_feature (398)..(398): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (406)..(406): n is a, c, t, g, unknown, or other
  misc_feature (441)..(441): n is a, c, t, g, unknown, or other
gctctagaactagtggatcccccgggctgcaggaattcgtctcacccctagaaaaagctccatttcgaggttaatcgctgcccgctctccactcctccggtccttccgccggcgggcacgcgccgggcgaaatggaagcggcaccatccctccgcaccttctccccctcatcgttcttctccgcggggcctagacactgccttctgctcgcggggccggcctcgcggggcgccggggggctcccggggccggccctggccccgggccgtcgcctcccaccggcgcggcggtgggtggtctccaggcccgccacccgcccggcggcctccggggacagaccgcaccccggcaggggcgagggtgaccccctccggggggggctttttaaatcccttttntnnnnnancggggcccccccccccccccacccaatttttatantggcggtgggtgttgggggaggggaacacgacggtcctcgttcggttttcttcgcagcgggggaggaggcggcgggtaagaaagaaggagccccggggttttggctttctccaagagggggagggcgcgatggggggggggggggccgttctgagaggtttgggcaggcacaagacttcccggacggtttgagaaacgggcgaggagggcgtaggagagcgtgcccccggcccgaaacggggtggagggccgcgccc

SEQ ID NO: 52930 - protein, 189 aa, Zea mays
  misc_feature: Ceres CLONE 1471363-F
  misc_feature (89)..(89): Xaa is any aa, unknown, or other
  misc_feature (90)..(90): Xaa is any aa, unknown, or other
  misc_feature (91)..(91): Xaa is any aa, unknown, or other
  misc_feature (92)..(92): Xaa is any aa, unknown, or other
  misc_feature (104)..(104): Xaa is any aa, unknown, or other
MEAAPSLRTFSPSSFFSAGPRHCLLLAGPASRGAGGLPGPALAPGRRLPPARRWVVSRPATRPAASGDRPHPGRGEGDPLRGGLFKSLXXXXGAPPPPHPIFIXAVGVGGGEHDGPRSVFFAAGEEAAGKKEGAPGFWLSPRGGGRDGGGGGRSERFGQAQDFPDGLRNGRGGRRRACPRPETGWRAAP

SEQ ID NO: 52931 - DNA, 647 bp, Zea mays
  misc_feature: Ceres CLONE 1471365-F
  misc_feature: Encodes the peptide sequence at SEQ ID NO. 52932
  misc_feature (362)..(362): n is a, c, t, g, unknown, or other
  misc_feature (536)..(536): n is a, c, t, g, unknown, or other
  misc_feature (571)..(571): n is a, c, t, g, unknown, or other
  misc_feature (592)..(592): n is a, c, t, g, unknown, or other
ctccccgcggtggcggccgctctagaactagtggatcccccgggctgcaggaattcgtctcacccctagaaaaaagcgcgtcctgcgttccattccaccctcctccgtctccgatcctcgccttcaactccactccctcgctctctcgggccttcttccctagcggcgacgacggggtgatcactgattcactgccgcccgcgccaggtcggccagaactagtgggcgccaaacatcatagcgatcatggaggtggtctcttgcagccactcctgctcggcattacatcaaacaccagcaagcacatggaggcttcggggcagtgctcttggccttggtcttgggcatgccaggccttcccnggacagaagatacacagttgcgtgtgtaggaaccacgagtggagcttccaatcggggtggttccgcaagggtcatgcaggccagggattccatgtaagcgacgtggatgcagccctgcagggcattccttccatgaaagcggggaagccgagagggtgatgattcagggccttncggaaggccctgacagctccccgatcagtactggntttctgggagtggaagccaangctgactgtgtactaccaagagtccggcataaaaaacaacaggcaccctgcggtg

SEQ ID NO: 52932 - protein, 70 aa, Zea mays
  misc_feature: Ceres CLONE 1471365-F
  misc_feature (39)..(39): Xaa is any aa, unknown, or other
MEVVSCSHSCSALHQTPASTWRLRGSALGLGLGHARPSXDRRYTVACVGTTSGASNRGGSARVMQARDSM

SEQ ID NO: 52933 - DNA, 681 bp, Zea mays
  misc_feature: Ceres CLONE 1471367-F
  misc_feature: Encodes the peptide sequence at SEQ ID NO. 52934
  misc_feature (306)..(306): n is a, c, t, g, unknown, or other
  misc_feature (314)..(314): n is a, c, t, g, unknown, or other
  misc_feature (337)..(337): n is a, c, t, g, unknown, or other
  misc_feature (361)..(361): n is a, c, t, g, unknown, or other
  misc_feature (364)..(364): n is a, c, t, g, unknown, or other
  misc_feature (368)..(368): n is a, c, t, g, unknown, or other
  misc_feature (370)..(370): n is a, c, t, g, unknown, or other
  misc_feature (443)..(443): n is a, c, t, g, unknown, or other
aagctggagctccccgcggtggcggccgctctagaactagtggatcccccgggctgcaggaattcgtctcacccctagaaaaagtcacaacgcgtcctcgaataaaaatccagacgaaacccaaaatccccaccgaacgcaacctaaaatctccccatccctcctcgatccagccccgcggagaagagccatggccgattccgcaaccaacgacgcccccctggtcgccagcaaccagcccacggaggaggaggtgacggtggagaaggccgcggcgacggaggagcaggaggaggagaggctgcngtacctcnagttcgtgcagcaggcggcggcncaggcgctggtgctggcggccgcngcntacncntacgccaaggagggcgccggcccgctccgccccggggtcgatcaggtcgagggcaccgtgaaggccgtcgtcngccccgtctacgaccgttttcacgccgtcccgctcgacctcctcaagttcatcgaccgcaaggttgggtgagtccgttgaggaaatagaccgccgcgtcccctcccggtggtgaaggaagcccaacccttgccccgctcggcttgcaaaggaagttccccaggccgggcctgtgggggcacggccactggccttggccaaagtcagccatccgccccgcgccgagccaaaaggccggg

SEQ ID NO: 52934 - protein, 107 aa, Zea mays
  misc_feature: Ceres CLONE 1471367-F
  misc_feature (29)..(108): Pfam Name: REF Pfam Description: Rubber elongation factor protein (REF)
  misc_feature (39)..(39): Xaa is any aa, unknown, or other
  misc_feature (42)..(42): Xaa is any aa, unknown, or other
  misc_feature (60)..(60): Xaa is any aa, unknown, or other
  misc_feature (85)..(85): Xaa is any aa, unknown, or other
MADSATNDAPLVASNQPTEEEVTVEKAAATEEQEEERLXYLXFVQQAAAQALVLAAAAYXYAKEGAGPLRPGVDQVEGTVKAVVXPVYDRFHAVPLDLLKFIDRKVG

SEQ ID NO: 52935 - DNA, 649 bp, Zea mays
  misc_feature: Ceres CLONE 1471368-F
  misc_feature: Translation starting site: 270
  misc_feature (392)..(392): n is a, c, t, g, unknown, or other
  misc_feature (411)..(411): n is a, c, t, g, unknown, or other
  misc_feature (551)..(551): n is a, c, t, g, unknown, or other
  misc_feature (555)..(555): n is a, c, t, g, unknown, or other
  misc_feature (574)..(574): n is a, c, t, g, unknown, or other
  misc_feature (575)..(575): n is a, c, t, g, unknown, or other
  misc_feature (584)..(584): n is a, c, t, g, unknown, or other
  misc_feature (590)..(590): n is a, c, t, g, unknown, or other
ctccccgcggtggcggccgctctagaactagtggatcccccgggctgcaggaattcgtctcacccctagaaaaagctcgcccaccctccccgcggatcacagacagcctgtgcccgccttccagtccacaatctccctgcctctcctctcccaccctccgaaaagcaagctccggccggaccgccccaccgcgcgcgcgcatacacacacacagagagagagaccgcacggtcgttcggggttcctttggccaggcgcacgacacgagcatggcgcagcgcgacaagaaggaggagccccacgagctgcgggcgccggagatcgcgctctgcgccacaactgcggcttcccgggcaacccgccacgcagaacctgtgccagagctgcttctncgcgtcgaggtcgtcgtcntcgtcttcgcagccgtcccctacctcctctccctcagcttccgcgccgggccgcgcggtgccgcagccgaggccggcgctcctgggacgcgcgctgcagctggcgcctcccgcccgcggcgcggggcagccctgtgaggnctcngccaggacttctgccaccnngtgctccanctgccngaagcgcgtggggctgacgggggtccggggccgctgcggcgacctgttctgcggggcgc

SEQ ID NO: 52936 - DNA, 743 bp, Zea mays
  misc_feature: Ceres CLONE 1471372-F
  misc_feature: Encodes the peptide sequence at SEQ ID NO. 52937
  misc_feature (407)..(407): n is a, c, t, g, unknown, or other
ctccccgcggtggcggccgctctagaactagtggatcccccgggctgcaggaattcgtctcacccctagaaaaaaacgaactgaccacaaccacctaagctaaaagctaaccaccagacccccggccatggcgctcgcgcccacttccgctgccgtgctcaagaccccgttcctcggggccaggcgcgcgctcgccaatgccgccgccaagcccgcgcctcgccgcgcgctggtcgtcgccgccgcggccgccgccaaaaagtcgtgaatcccggccctcaagaggggcggcggaaattctgaacccgccctggtcccaacggcttccctcccccggcgactttcgggtttctacccttcccccccccggggggggggggggggggggcccccaaacccctacaccnaaaaaaaaagtggccccccccccgggggggtggggccacaaaggcggcgcggggggggggcctcttttcttgggggaccagcgcctacaaaccggccaccccccggggctccgagggccccggcccccaacccccacgcccccccctgccgccccttccttccttgcggggggggcgggccgggggcccccaccctacctccctcatatcggggtcggggcggagaatctcaactcccgcggggccgcacccctctctactgccgggactctctcgcgggcggcgggccgggggccccttccccgccccccgccggctggtggtgggcgtggtccg

SEQ ID NO: 52937 - protein, 46 aa, Zea mays
  misc_feature: Ceres CLONE 1471372-F
MALAPTSAAVLKTPFLGARRALANAAAKPAPRRALVVAAAAAAKKS

SEQ ID NO: 52938 - DNA, 631 bp, Zea mays
  misc_feature: Ceres CLONE 1471378-F
  misc_feature: Encodes the peptide sequence at SEQ ID NO. 52939
  misc_feature (232)..(232): n is a, c, t, g, unknown, or other
  misc_feature (416)..(416): n is a, c, t, g, unknown, or other
  misc_feature (466)..(466): n is a, c, t, g, unknown, or other
  misc_feature (490)..(490): n is a, c, t, g, unknown, or other
  misc_feature (496)..(496): n is a, c, t, g, unknown, or other
  misc_feature (631)..(631): n is a, c, t, g, unknown, or other
tggagctccccgcggtggcggccgctctagaactagtggatcccccgggctgcaggaattcgtctcacccctagaaaaaacacggctttttggcagctacaaaccacccaaaagccacccccagaaaccggcggtccttgggtgttccggatctgagccagcagctgagaagaggatgagcgccgtggccgccatggcgacgtcgtcgctgaaccccaacgcgccgctcttncatccggcggcgtaccggcaggtggaggaattctcgccagagtggtacgagctcgtcaacaccaccgcctggttccgggaccactggttccgccagcaccagcaccacgaggccgccttcgccgccgccgacgccgagctcgacgtcgccgcgctcctttccgacgactccgtcgacctcctcnacaccgacgacctcttctacgcgcctgacgtccaccacccccacacgccnagccggcgctgctgcccgggtacnacctcnacatgctcagggcgctgagcctcagctcccccggggccgccgcgcgccgtcgccgtcgccgttgctgcgcccccagcagcagaggcacgcggacggccggccccacacgccagggggcccgcgcgccgcgtcatn

SEQ ID NO: 52939 - protein, 112 aa, Zea mays
  misc_feature: Ceres CLONE 1471378-F
  misc_feature (19)..(19): Xaa is any aa, unknown, or other
  misc_feature (81)..(81): Xaa is any aa, unknown, or other
MSAVAAMATSSLNPNAPLXHPAAYRQVEEFSPEWYELVNTTAWFRDHWFRQHQHHEAAFAAADAELDVAALLSDDSVDLLXTDDLFYAPDVHHPHTPSRRCCPGTTSTCSGR

SEQ ID NO: 52940 - DNA, 584 bp, Zea mays
  misc_feature: Ceres CLONE 1471381-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (17)..(17): n is a, c, t, g, unknown, or other
  misc_feature (18)..(18): n is a, c, t, g, unknown, or other
  misc_feature (23)..(23): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (49)..(49): n is a, c, t, g, unknown, or other
  misc_feature (50)..(50): n is a, c, t, g, unknown, or other
  misc_feature (63)..(63): n is a, c, t, g, unknown, or other
  misc_feature (109)..(109): n is a, c, t, g, unknown, or other
  misc_feature (132)..(132): n is a, c, t, g, unknown, or other
  misc_feature (144)..(144): n is a, c, t, g, unknown, or other
  misc_feature (147)..(147): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (189)..(189): n is a, c, t, g, unknown, or other
  misc_feature (193)..(193): n is a, c, t, g, unknown, or other
  misc_feature (194)..(194): n is a, c, t, g, unknown, or other
  misc_feature (211)..(211): n is a, c, t, g, unknown, or other
  misc_feature (220)..(220): n is a, c, t, g, unknown, or other
  misc_feature (259)..(259): n is a, c, t, g, unknown, or other
  misc_feature (359)..(359): n is a, c, t, g, unknown, or other
  misc_feature (397)..(397): n is a, c, t, g, unknown, or other
  misc_feature (398)..(398): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (507)..(507): n is a, c, t, g, unknown, or other
  misc_feature (508)..(508): n is a, c, t, g, unknown, or other
nnngggcgnnnnngggnnggggngnnnnngggtgggnnnnnngnnnggnnggggccctcgcgngggcgccccctcgacctgggatccccgggctgggggatcgggtgantttagaaaagggccttgggtggngttttgtcgccnacntgnnnnnnntttttttttttcaaaaactggagactccaccgncggnntggcggccgcctctagnactagtggnatcccccggggctgcagggaattccgtctcacccctagnaaaaagtctgtatacctgtcactcacgctaccgccgtgaccgatcatctctcactctctcgtcagatcctctcggctagctagctagctaggacagaggnagggaggggaaggcgctgggctatgcactgcggccgcnngcgnnnnnnnnnccatgaagggcccggaaactctcaacggcccaactggtaaaccggggggccccccggggggggcctttggcccacccccctctttgggggggggggnnggggggttttttccccaagaggtccccaaaaaattttgggaaaaggggggcggtttcccccaaagtgacccccccc

SEQ ID NO: 52941 - DNA, 666 bp, Zea mays
  misc_feature: Ceres CLONE 1471384-F
  misc_feature: Encodes the peptide sequence at SEQ ID NO. 52942
  misc_feature (493)..(493): n is a, c, t, g, unknown, or other
  misc_feature (503)..(503): n is a, c, t, g, unknown, or other
  misc_feature (558)..(558): n is a, c, t, g, unknown, or other
aagctggagctccccgcggtggcggccgctctagaactagtggatcccccgggctgcaggaattcgtctcacccctagaaaaattccgctgttctccgatttgggggacgtcccttgcccgctccggagtccggtccagcggagccagctacggcacagatcggcctccgtccgccccttcccatctcaccagactctccaccgccgcggtgagcgtgcctcggctgcttcctagattactgcttcaggcggtgctgatgcaaaatggttctatgtcagggcgtttctgttggaaatgctcagttgctagcttttcctggtagatcatcaagttttaagagcacccagtttcatgttaaaacggatcatttttctgcaagagctctacgtgttggcactgattccattcatcatggcatgcctacatcattcccaagggagaattctctcaggggcatcccatcactatcagggcagcataatcagcatccanggtccgttangtgtcgggcatcctcgctggcatctttcagctaccctgagctgacatccaacccnagatggtgggtggagactctagcttgtgtgccgtacttgctgccactgcacaacatgtggtcttatgccgacgtgatctaccagctgcacacttacttgcaggggttt

SEQ ID NO: 52942 - protein, 134 aa, Zea mays
  misc_feature: Ceres CLONE 1471384-F
  misc_feature (77)..(77): Xaa is any aa, unknown, or other
  misc_feature (80)..(80): Xaa is any aa, unknown, or other
MVLCQGVSVGNAQLLAFPGRSSSFKSTQFHVKTDHFSARALRVGTDSIHHGMPTSFPRENSLRGIPSLSGQHNQHPXSVXCRASSLASFSYPELTSNPRWWVETLACVPYLLPLHNMWSYADVIYQLHTYLQGF

SEQ ID NO: 52943 - DNA, 659 bp, Zea mays
  misc_feature: Ceres CLONE 1471387-F
  misc_feature: Encodes the peptide sequence at SEQ ID NO. 52944
  misc_feature (573)..(573): n is a, c, t, g, unknown, or other
ctccccgcggtggcggccgctctagaactagtggatcccccgggctgcaggaattcgtctcacccctagaaaagtcgctcggtccaccacctcagctccgccgcttgcccgcttttgctctctccctcccggctctcggcttcttctacacgctaccgtctcacagccgtaaacgcccctcccggatcccgctagttcgccaccgccgcccgcccgcccgccgttcgcctcatcatggccgcctcgtcgaccgccacctccgtccacgacttcatcgtcaaggatgcgagcggcaaagacgttgacctcagcacctacaaggggaagggttctctcattgttaacgtcgcatcccagtgtggcttaaccaactccaactacactgagctggcccagctctatgagaagtacacggaccagggctttgaaatcctggctttcccatgcaaccagttgggtgggcaggagcctggtacaaatggaggagattggtcagtttgcctgcacaacgcttcaaggctgagtaccccatccttcgacaaggttggatgtcaacgggtagcaatgctcgcncccatctacaagttcttgaaatctagcaaaggtgggccttttcggcgaccgcctcagggggaacttttccaagttctgggtgaaaa

SEQ ID NO: 52944 - protein, 141 aa, Zea mays
  misc_feature: Ceres CLONE 1471387-F
  misc_feature (10)..(120): Pfam Name: GSHPx Pfam Description: Glutathione peroxidase
  misc_feature: SWISSPROT Homolog: EC 1.11.1.12 Phospholipid-hydroperoxide glutathione peroxidase
MAASSTATSVHDFIVKDASGKDVDLSTYKGKGSLIVNVASQCGLTNSNYTELAQLYEKYTDQGFEILAFPCNQLGGQEPGTNGGDWSVCLHNASRLSTPSFDKVGCQRVAMLAPIYKFLKSSKGGPFRRPPQGELFQVLGE

SEQ ID NO: 52945 - DNA, 680 bp, Zea mays
  misc_feature: Ceres CLONE 1471388-F
  misc_feature: Encodes the peptide sequence at SEQ ID NO. 52946
  misc_feature (394)..(394): n is a, c, t, g, unknown, or other
  misc_feature (489)..(489): n is a, c, t, g, unknown, or other
ctccccgcggtggcggccgctctagaactagtggatcccccgggctgcaggaattcgtctcacccctagaaaaaaacaattccaggagctacagtcacacaaccaaagcaactcggccagcgcgcgggccggggtcgcatgggcgacgccggcgacaagtgtgcgctgcggctggccgccaccgcgaggaagtgctggaggacgtccgcgtcgaccgcgagggcgcgtccaccccgcgtagccagcggggggcaggcgctcacctggctcgcgactgccggcgcccgcgtctcgctggccgagcccgggcgcgtcgtctgctcgctccgcgtgggcgccccgctcaccgacgcggaggggaggtggcacgcccggggccatcgcggtgggcggnggacaacgtgtgcgcggcggcggtcttcacggcgctgggcgcggacgtgctcaccgtccagtacagcctgtcctacttctcgcccgccccatctncgacaaggaggtggagatggaagggggcaagtggttgggcccgaaagggggcccctggcggcccgcgaccggtggaaggtgcgaaaaaaaagatcccggccaaggctggtgggccaatctcccagggcagtgggatggccaccttctctccaacaacaaaagggtcaagcaccaagcaccgggccaagcaa

SEQ ID NO: 52946 - protein, 180 aa, Zea mays
  misc_feature: Ceres CLONE 1471388-F
  misc_feature (86)..(86): Xaa is any aa, unknown, or other
MGDAGDKCALRLAATARKCWRTSASTARARPPRVASGGQALTWLATAGARVSLAEPGRVVCSLRVGAPLTDAEGRWHARGHRGGRXTTCARRRSSRRWARTCSPSSTACPTSRPPHLRQGGGDGRGQVVGPERGPLAARDRWKVRKKRSRPRLVGQSPRAVGWPPSLQQQKGQAPSTGPS

SEQ ID NO: 52947 - DNA, 638 bp, Zea mays
  misc_feature: Ceres CLONE 1471398-F
  misc_feature: Encodes the peptide sequence at SEQ ID NO. 52948
  misc_feature (153)..(153): n is a, c, t, g, unknown, or other
  misc_feature (275)..(275): n is a, c, t, g, unknown, or other
  misc_feature (407)..(407): n is a, c, t, g, unknown, or other
aaagctggagctccccgcggtggcggccgctctagaactagtggatcccccgggctgcaggaattcgtctcacccctagaaaaaacccagccgcccattgccggcattgctcgcagcgctagcttcttgcgctcatcactcgtctccgacaangatcagcaaggaccggatggctctcgaagcagcgtacgactacctgcacgtcgccgtcgtccagtgcacgcccacacaagcagcagcagtcctcggggtcctcctcctcctcgccatccggntagccgcggcggcgagagctcgtccccgacgtcccccaatggagcagcacaggctgcccccaaccctcgggggagctcccatcatcggcacctcacctcatgggtccaccgcacgtctcttcgcgacctcanccagtacgcacacgggctatgctggtcaggtcgcccctcccacatcgtggtgtcacgcggaggcggcaagggcttctcccacccacgacaccttgtgggtccccccccgggaacccttccccgattcatccgctaacacttcggggaggtggccttccccccctaagggaaatactggccacggggcgggaaagggggccaaccccaccctggcccccccccaaaaatggg

SEQ ID NO: 52948 - protein, 156 aa, Zea mays
  misc_feature: Ceres CLONE 1471398-F
  misc_feature (36)..(36): Xaa is any aa, unknown, or other
  misc_feature (80)..(80): Xaa is any aa, unknown, or other
MALEAAYDYLHVAVVQCTPTQAAAVLGVLLLLAIRXAAAARARPRRPPMEQHRLPPTLGGAPIIGTSPHGSTARLFATSXSTHTGYAGQVAPPTSWCHAEAARASPTHDTLWVPPREPFPDSSANTSGRWPSPPKGNTGHGAGKGANPTLAPPQKW

SEQ ID NO: 52949 - DNA, 795 bp, Zea mays
  misc_feature: Ceres CLONE 1471411-F
  misc_feature: Encodes the peptide sequence at SEQ ID NO. 52950
  misc_feature (1)..(1): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (80)..(80): n is a, c, t, g, unknown, or other
  misc_feature (148)..(148): n is a, c, t, g, unknown, or other
  misc_feature (257)..(257): n is a, c, t, g, unknown, or other
  misc_feature (269)..(269): n is a, c, t, g, unknown, or other
  misc_feature (272)..(272): n is a, c, t, g, unknown, or other
  misc_feature (321)..(321): n is a, c, t, g, unknown, or other
  misc_feature (324)..(324): n is a, c, t, g, unknown, or other
  misc_feature (343)..(343): n is a, c, t, g, unknown, or other
  misc_feature (369)..(369): n is a, c, t, g, unknown, or other
  misc_feature (370)..(370): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (422)..(422): n is a, c, t, g, unknown, or other
  misc_feature (423)..(423): n is a, c, t, g, unknown, or other
  misc_feature (464)..(464): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (527)..(527): n is a, c, t, g, unknown, or other
  misc_feature (610)..(610): n is a, c, t, g, unknown, or other
  misc_feature (650)..(650): n is a, c, t, g, unknown, or other
  misc_feature (654)..(654): n is a, c, t, g, unknown, or other
  misc_feature (663)..(663): n is a, c, t, g, unknown, or other
  misc_feature (696)..(696): n is a, c, t, g, unknown, or other
  misc_feature (720)..(720): n is a, c, t, g, unknown, or other
  misc_feature (795)..(795): n is a, c, t, g, unknown, or other
naaaaccccnnnnacaacctgggctcaccgcggtggcggccgctctagaactagtggatcccccgggctgcaggaattcntctcacccctagaaaaaaccagcggcatctatagcaaccggtccagcactttcacgctcagctccagnaatggctgcctccaccatggcgatctcctccacggcgatggccggcacccccatcaaggtgggctccttcggcgagggccccatcaccatgcgcaagaccgtgggcaancccaaggtggcnccntccgggaccccctggtacggcctttacccccccgaggagggcggggccnctnttcgggtattttcttaaantaattaaacggttaagaggccccggnnaatttttttttcccccccccccggggagaaccgacaaggggggccnnncccnncccctattaacccccccccccccaaaaaaaaaaaaaaaaanatcgggtcttgccgcggggggggcgccctacactcaataactatccaaatcccgggggnnntntatcccgtttacccccttaccccacccctggcgccacccgcctctttcccccgctccgttccaacactcccacccgcgcgggnaaatgggaaccccaaataacaatcatccaacccattaccncccncctactctnaaccctccccccccgccgcgccgcgccgatagnggaatagacgacctgcccgatccngccactacccccacgggcccacaaagacgcccgcgggctcccccggcagccgcgccgggtttcgcttaattatan

SEQ ID NO: 52950 - protein, 63 aa, Zea mays
  misc_feature: Ceres CLONE 1471411-F
  misc_feature (36)..(36): Xaa is any aa, unknown, or other
  misc_feature (58)..(58): Xaa is any aa, unknown, or other
  misc_feature (59)..(59): Xaa is any aa, unknown, or other
MAASTMAISSTAMAGTPIKVGSFGEGPITMRKTVGXPKVAPSGTPWYGLYPPEEGGAXXRVFS

SEQ ID NO: 52951 - DNA, 643 bp, Zea mays
  misc_feature: Ceres CLONE 1471417-F
  misc_feature (414)..(414): n is a, c, t, g, unknown, or other
aagctggagctccccgcggtggcggccgctctagaactagtggatcccccgggctgcaggaattcgtctcacccctagaaaattaagccatgcatgtgcaagtatgaactaattcgaactgtgaaactgcgaatggctcattaaatcagttatagtttgtttgatggtacgtgctactcggataaccgtagtaattcctagagctatacgtgcaacaaacccgacttccgggaggggcgcatttattagataaaaggctgacgcgggctctgcccgccgatccgatgattcatgataacttgacggatcgcacggccttcgtgccggcgacgcatcattcaaatttctgccctatcaactttcgatggtagataggggcctaccatggtgtgacggtgacggaaaataggttcnattccgagagggacctgaaaacgctacacatccaggaagcagcaggcgccaatggccacgcgccgattcaccacacctcggcggcgtgttcgcctccaggttcctccgccggctgccgggcgcctcagtgtgtcccgcccgccgcccgcggaactcgcgttcttccttcttctcgcgaaaactaccgttcttccccccgccacccggtgggtccccgcacccggatggg

SEQ ID NO: 52952 - DNA, 698 bp, Zea mays
  misc_feature: Ceres CLONE 1471419-F
  misc_feature: Encodes the peptide sequence at SEQ ID NO. 52953
  misc_feature (698)..(698): n is a, c, t, g, unknown, or other
aaagctggagctccccgcggtggcggccgctctagaactagtggatcccccgggctgcaggaattcgtctcacccctagaaaaattcttccccgagtcgccgtcgtctgctccgggctgctgttctgcgcctccacaaggctttggcctctgttgtaagttttaagcttcacctccagccatgggtaaggagaagtcccacatcaacattgtggttattggccatgtcgactctggcaagtcaaccaccaccggccacctgatctacaagcttggaggcattgacaagcgtgtgattgagaggttcgagaaggaagccgctgaaatgaacaaacggtccttcaagtacgcttgggtgcttgacaagctcaaggctgagcgtgagagaggtatcaccattgatatcgctctgtggaagtttgagaccaccaagtactactgcactgtcattgatgcccctggacatcgcgacttcatcaagaacatgatcacgggtacctcccaggctgactgtgctgtcctgatcattgactccaccactggtggttttgaggccggtatctctaaggatggccagacccgtgagcatgctctccttgctttcacccttggggtcaagcagatgatttgctgctgcacaagatggatgcgaccactcccaagtattccaaggcccgttacgatgagattgtgaaggan

SEQ ID NO: 52953 - protein, 170 aa, Zea mays
  misc_feature: Ceres CLONE 1471419-F
  misc_feature (5)..(164): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCTRWMRPLPSIPRPVTMRL

SEQ ID NO: 52954 - DNA, 731 bp, Zea mays
  misc_feature: Ceres CLONE 1471426-F
  misc_feature (625)..(625): n is a, c, t, g, unknown, or other
ccccgcggtggcggccgctctatatctagtggatcccccgggctgcaggaattcgtctcacccctagaaaaaaaaacgcctcttgttctgactccctctctgcctgacagcttaggatcaacggaactagctatggtgaatagcctagccgaacgaagtgacgagctgcctcaccttgggcgtgatggaggggggggactcgtccggccggtgcggcggcgtggccctggtctgcgccgacaactggcctagtggacgcgtcaccgtgtttccagtagtgcatggacggctagacgcctcatgcccacctgcaggggtctctctcccggtgactccggcttcaattccctggtgctggtgtccgtggtgtagaacttctagctgttcacgtactcggaggtgatctacggcccccccccccatggttgccttccccccgcccatgggcgaccgaagatctggaccctttcaccctctccgaaaggggcggagttgggcagccgggccttgtggaggagggtcaagttatttcgtgcatcccccttcccctagtggaaagtttttggaatcaccctcgcaaaaagaattttggtggaaccttttccttcctccctttccttcctcnctcgtttggaaaaatggtttcccttttgaggaataaagtaccctccgggcgggcgggcattgggacccccctttgggcctttacccaaaggaaaacctcgcccaat

SEQ ID NO: 52955 - DNA, 673 bp, Zea mays
  misc_feature: Ceres CLONE 1471437-F
  misc_feature: Encodes the peptide sequence at SEQ ID NO. 52956
  misc_feature (368)..(368): n is a, c, t, g, unknown, or other
  misc_feature (371)..(371): n is a, c, t, g, unknown, or other
  misc_feature (432)..(432): n is a, c, t, g, unknown, or other
  misc_feature (450)..(450): n is a, c, t, g, unknown, or other
  misc_feature (456)..(456): n is a, c, t, g, unknown, or other
  misc_feature (457)..(457): n is a, c, t, g, unknown, or other
  misc_feature (673)..(673): n is a, c, t, g, unknown, or other
ctggagctccccgcggtggcggccgctctagaactagtggatcccccgggctgcaggaattcgtctcacccctagaaaaaagcacagaactgttaagctccgcaggctgcagctcgtccccaatgtcgtctgcttctcttgcatcttctctcttgtgcagcagcagtgcttctactagtagaagcgcaaccgtgccaagagtaaccaggacccctcttttttccaagaaccagtacaaaccgcctcttcggcctcttaggagtagttcagtagtaaggcgatcgttgcagcaggagcaagaggagagggtgggcccggcgtcctctgtctctgtggccctccgcgagcgacaggaggaggcgacggcntcncatcatgttggagggggtggatgaggccaaaggcgtcgggcatgttgggagagcagataanggaggccaagagaaggcnacggcnnagaagagaaagacacagacgagcagcgggaggtggactggaagtcaaacgaggagttcaagaggttcatgggcaaatccctcatcgagggccgccatcaagttggaagaagaggcccgccaagggaaagctcccgcgagctggaccgggagcccgaccccaaccccgtcgccgggcttgttccggggcttgggtgaaggaaccagctggcccccan

SEQ ID NO: 52956 - protein, 90 aa, Zea mays
  misc_feature: Ceres CLONE 1471437-F
MSSASLASSLLCSSSASTSRSATVPRVTRTPLFSKNQYKPPLRPLRSSSVVRRSLQQEQEERVGPASSVSVALRERQEEATASHHVGGGG

SEQ ID NO: 52957 - DNA, 712 bp, Zea mays
  misc_feature: Ceres CLONE 1471442-F
  misc_feature: Translation starting site: 222
  misc_feature (326)..(326): n is a, c, t, g, unknown, or other
ggagctccccgcggtggcggccgctctagaactagtggatcccccgggctgcaggaattcgtctcacccctagaaaaaattcctcggagagggagaagccgccgccgcagcaatcacagcagcccggagaaagcccaggtccgacaagatgcagatcttcgtgaagacgctgacagggaagaccatcaccctcgaggtcgagagcagcgacaccatcgacaatgtcaaggccaagatccaggacaaggaagggaatcccgccggaccagcagcggctgatctttgccgggaagcagctggaggatggccgcacccttgcggactantacatccaaaaggagtctacgcttcacctcgtgcttaggctcccgcgtggcatcattgaggcctcgctgcaggcgctcgctcgcaagtacaaccaggacaagatgatctgccgcaaatgctatgcacgactgcaccctagggctgtcaactgccgcaagaagaatggtggtcacagcaaccagttgagggccaggagaagatcaagaactgaggggctgtctctatcaggtttcggaacaaatgttggcttttttgctggggggttgttgaacccggtttgtttccccaccatttggcccttcggtttggtttaccctgggggcgagggcccattcttttttgacatttgcccctttggtttttggaatttttggccccggttccc

SEQ ID NO: 52958 - DNA, 701 bp, Zea mays
  misc_feature: Ceres CLONE 1471443-F
  misc_feature: Encodes the peptide sequence at SEQ ID NO. 52959
  misc_feature (21)..(21): n is a, c, t, g, unknown, or other
  misc_feature (28)..(28): n is a, c, t, g, unknown, or other
aaagctggagctccccttggnggcggtngctatttcatagtggagtctcggggctgcaggataccgtctcacccctagaaaaaagtggccactctctccgtctctcgactgaaaaaaaggacccttcttcttggcactccaagcggaaggaacggtggcgtttctccgttctacgaagtggcgcgccatctgcaccggtcggctgcggcggattgagcggtggctttcctcgtcagttgcgcttcccgaacgacgccggcaccgcccgtggcatctgcgtctctgccttctccaaccgccagcaccgctcccgacccagggccaagaagcgtgtgaggagctttcagctgccaccatgctccagcatctccagtgagacctccgtgccattcactactcacccatcatcggccgcgatgcctcctgcaagcccattatcctccaccggtcctgggattcacatatagagcatgccgccagagatttctctacttccaaaagacttgcaggacgtccgatatatcaccacaatgcgttagaaccgactacgcctgtgaaggatactgacttaataattgatcggatacgaaagagcacactataattggaggaacgcgctgtaggaaaaaatctgtcttcagcggagaaaaggaaatttctcgtcaacactctccttaggctcggagattcaagaccacgcg

SEQ ID NO: 52959 - protein, 154 aa, Zea mays
  misc_feature: Ceres CLONE 1471443-F
  misc_feature (7)..(7): Xaa is any aa, unknown, or other
  misc_feature (9)..(9): Xaa is any aa, unknown, or other
SWSSPWXRXLFHSGVSGLQDTVSPLEKSGHSLRLSTEKKDPSSWHSKRKERWRFSVLRSGAPSAPVGCGGLSGGFPRQLRFPNDAGTARGICVSAFSNRQHRSRPRAKKRVRSFQLPPCSSISSETSVPFTTHPSSAAMPPASPLSSTGPGIHI

SEQ ID NO: 52960 - DNA, 702 bp, Zea mays
  misc_feature: Ceres CLONE 1471444-F
  misc_feature: Encodes the peptide sequence at SEQ ID NO. 52961
aaagctggagctccccgcggtggcggccgctctagaactagtggatcccccgggctgcaggaattcgtctcacccctagaaaaattaagtgccagtctacctagatccacatccacctgattggaataaccaggtactcataaagtcataatagcatgagcttctctcttcatctctctccctctctctatgtttaataaggtcttcgatctagctaacttcgaatcttgatccgcccatacacttgttcttcttcatgaaaaattgaaggattttgacacaaagatgttttctcatctcaataatgaatattcattggcaattctctggcttttcctttttcttctcttttgatacgtaacatctaacatgcttgtgtgcatacgtagcagcagcaaggtcagcagccgagggcgagtgggggagccgatgcaccgctgttgcccatgggtccgatggctgccacagcggcggcttcggagcccggcggcttgccgagaagctcgtcaacgtccagtgccgccttggccatgcacgcaaggcccaactcgatggcggagcgcgcgcggctggcacgaataccgaatccagagccggcgctcaagtgccctcgttgtgactccaccaacaccaagttctgctactacaacaactactccctctcccagccccgccacttctgcaagacgtgccgtcgctact

SEQ ID NO: 52961 - protein, 85 aa, Zea mays
  misc_feature: Ceres CLONE 1471444-F
  misc_feature (47)..(85): Pfam Name: zf-Dof Pfam Description: Dof domain, zinc finger
  misc_feature: The sequence is a functional homolog of SEQ ID NO 2 in US patent 7265264
  misc_feature: The sequence is a functional homolog of SEQ ID NO 1967 in the 11/479,226 US patent application
  misc_feature: The sequence is a functional homolog of SEQ ID NO 2318 in the 10/374,780 US patent application
  misc_feature: The sequence is a functional homolog of SEQ ID NO 240 in the 10/225,066 US patent application
  misc_feature: The sequence is a functional homolog of SEQ ID NO 1142 in the 11/479,226 US patent application
  misc_feature: The sequence is a functional homolog of SEQ ID NO 502 in the 10/412,699 US patent application
  misc_feature: The sequence is a functional homolog of SEQ ID NO 8 in the 10/286,264 US patent application
MGPMAATAAASEPGGLPRSSSTSSAALAMHARPNSMAERARLARIPNPEPALKCPRCDSTNTKFCYYNNYSLSQPRHFCKTCRRY

SEQ ID NO: 52962 - DNA, 635 bp, Zea mays
  misc_feature: Ceres CLONE 1471447-F
  misc_feature: Encodes the peptide sequence at SEQ ID NO. 52963
acccgcggtggcggccgctctagaactagtggatcccccgggctgcaggaattcgtctcacccctagaaaaaagcaaaaccgcgccccaccgcttccccgttccccaccccgaccgactgctccccctcccccgcaccagcctcaaggcatcgccggcgccgcaacatcgctgaggaagcccgcacccctgcccggatccgatggccaacagcaacctcccgcggcggatcatcaaggagactcagcggctgctcagcgagccagcaccggggatcagcgcgtcgccctcggaggagaacatgcgctacttcaacgttatgatccttgggccggcgcagtcgccctatgaaggtgcaggcttctgattcggatttttttatgcgctgttcgtgctgtgtggcgccccgactagagtggtaatattggagtgcttccagatatcgatagtcgagtcgaatcgattcttttcaaaagatgccactggaagtggcagaaatgctgaaatgtttgctctagtttatgcgcacataggtaagcttgtatagtttgggcggctggtgacttttggcttgtcaattttagtttttggggcggattgtggctgatgagtctcagctcctatttgcaaaattcg

SEQ ID NO: 52963 - protein, 54 aa, Zea mays
  misc_feature: Ceres CLONE 1471447-F
  misc_feature: SWISSPROT Homolog: EC 6.3.2.19 Ubiquitin--protein ligase
MANSNLPRRIIKETQRLLSEPAPGISASPSEENMRYFNVMILGPAQSPYEGAGF

SEQ ID NO: 52964 - DNA, 699 bp, Zea mays
  misc_feature: Ceres CLONE 1471452-F
  misc_feature: Encodes the peptide sequence at SEQ ID NO. 52965
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
aaagctggagctccccgcggtggcggccgctctagaactagtggatcccccgggctgcaggaattcgtctcacccctagaaaaaaaaaatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttccgcgagaagccggtcaccgtctttggcatcaggaaccccgaggagatcccgtggggtgaggctggtgctgagtatgtcgtggagtccaacggtgtcttcactgacaggacaaggctgctgcacatctttaaggtgggggccaaaaaggtttgttttctcttgccccaagcaagatgcgcccatggtttttttgtttggggtcaatggggacaatcccaccccccccttttnnnnnntttttccaatggtaagttgccccacaaactgccctggttcccccttgctaagggacttccctgtacaaaccttttgggattattttgggg

SEQ ID NO: 52965 - protein, 179 aa, Zea mays
  misc_feature: Ceres CLONE 1471452-F
  misc_feature (4)..(130): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (148)..(148): Xaa is any aa, unknown, or other
  misc_feature (149)..(149): Xaa is any aa, unknown, or other
  misc_feature (150)..(150): Xaa is any aa, unknown, or other
MGKIKIGINGFGRIGRLVARVALQSEDVELVAVNDPFITTDYMTYMFKYDTVHGQWKHSDIALKDSKTLLFREKPVTVFGIRNPEEIPWGEAGAEYVVESNGVFTDRTRLLHIFKVGAKKVCFLLPQARCAHGFFVWGQWGQSHPPLXXXFSNGKLPHKLPWFPLAKGLPCTNLLGLFW

SEQ ID NO: 52966 - DNA, 708 bp, Zea mays
  misc_feature: Ceres CLONE 1471467-F
  misc_feature: Encodes the peptide sequence at SEQ ID NO. 52967
  misc_feature (41)..(41): n is a, c, t, g, unknown, or other
  misc_feature (313)..(313): n is a, c, t, g, unknown, or other
  misc_feature (379)..(379): n is a, c, t, g, unknown, or other
  misc_feature (696)..(696): n is a, c, t, g, unknown, or other
ggagctccccgcggtggcggccgctctagaactagtggatnccccgggctgcaggaattcgtctcacccctagaaagatgtttcgctgagaagagagccgactcctgctcctattatccgcgtcgctcctcagggcggagaggaggcaagaggaaggaagcgccgcgggagcgccagacagacagacgaaccgagcaccaccgccactagaaaaagccagcccaaaaccctagctccggcgcgccaccgcgcagatccggtgctcccgcgcgatgtcggaggcggaaacggcggggtctttgtccaggcggcnaatggaggacgaggagggggcgggcggcgatggaggcggattgggccccccgcgtggggggcaatnccaatattaaagaagtcaaaaataacccccgcccccccccgagggcgaggggccccgagggcaacgggccgggggggagaccctggcgcggccgggtgtgggagagtcctcgcagggggggcgcgggccctcgggcgggcacaggggccgggggggggggggtggggctcgccgggagaggggtgcgcggggagacggagcccgagcggcgaggaggggggggggcgggaagcgggcgggaggggggcgcggacggctcggacggaacgcagcgggcggggattaaagccgcacgagacctcaagagcagaggggcnctccagcgggct

SEQ ID NO: 52967 - protein, 122 aa, Zea mays
  misc_feature: Ceres CLONE 1471467-F
  misc_feature (13)..(13): Xaa is any aa, unknown, or other
MEADWAPRVGGNXNIKEVKNNPRPPPRARGPEGNGPGGRPWRGRVWESPRRGGAGPRAGTGAGGGGVGLAGRGVRGETEPERRGGGGAGSGREGGADGSDGTQRAGIKAARDLKSRGALQRA

SEQ ID NO: 52968 - DNA, 721 bp, Zea mays
  misc_feature: Ceres CLONE 1471486-F
  misc_feature: Encodes the peptide sequence at SEQ ID NO. 52969
agagctggagctccccgcggtggcggccgctctagaactagtggatcccccgggctgcaggaattcgtctcacccctagaaaaaatcgctccctctcagcttcctcattggccatccttcgtcttccatggagaggctccttgccggcctactactcggcttcctattattgatcgcgtcagtaggaagccatgcaactcgtgctccagatcagtactggaagtctgctcttcccgacactcccatgccgagctccctctcccaactcctcaacaccccagctggcaagggcggcgtcggtggaggcagcagcggcaagaagcccggcggcaccactgtggggagttgggaaaagggggagtgggcgttaacgttaaccctaccaaacccgggcggcgccggtacaaccgttggcccccccccaaggtggcgttcaggctccggagtccatccccgggaacggaaagccgggggggccccaccggggggccttttgcaaaggccagggtttggggttccccgtgagaacccggggaaaaaaaaccccgctccaagttccccctttggggcccttttccaggaaaaaaaaccccccccttttgaaaaacctagttttgccaaaaaaacccccccggggggggcgtttctttttcccagaaagagaaaaaaccccgcccccccccgaaaaaaaaacaaaacaccctctcttttcctcccacaa

SEQ ID NO: 52969 - protein, 198 aa, Zea mays
  misc_feature: Ceres CLONE 1471486-F
MERLLAGLLLGFLLLIASVGSHATRAPDQYWKSALPDTPMPSSLSQLLNTPAGKGGVGGGSSGKKPGGTTVGSWEKGEWALTLTLPNPGGAGTTVGPPPRWRSGSGVHPRERKAGGAPPGGLLQRPGFGVPRENPGKKNPAPSSPFGALFQEKKPPPFEKPSFAKKTPPGGAFLFPRKRKNPAPPRKKNKTPSLFLPQ

SEQ ID NO: 52970 - DNA, 710 bp, Zea mays
  misc_feature: Ceres CLONE 1471487-F
  misc_feature: Encodes the peptide sequence at SEQ ID NO. 52971
aaagctggagctccccgcggtggcggccgctctagaactagtggatcccccgggctgcaggaattcgtctcacccctagaaaaaacgcacctcacctctcacaattccaagcccaccagtccaccactctccgcttcgcttcttgtcgctgcggcgcgcggccatggtctccctccgcttccctaccgctgcaatcccccgcctcccgccatcccaggcccccaacggcgtcgccatcgccgccacggtcgccgctgcagccgcggccgcagctgcagtagcggccagcttgaccctcacgggcaagtccaccggccggacagtcccgcaccctgcccctctctgggcctccctctccctggccgacgcggcggcccccagctccgacgaaccccggaacggggcgacataccccacctgagccgacgatgggcgcctgctactctggcatagcctgcaggagaacaagcgtcgtcgggctcaagtccatcaacgtctacgcatttctgcgtgtatgccgatgacaacgattttaaagcctcagctgcaggaaaagtactcgaaattctcgggtctctgaactttaaggataacagtgagctgattaaagaatgcctaaaaccgggaaaaaccctataccgtcaggctccaaaatggtatatggaaggggaaaatattcctccgcttctccaccttttttaaaaaaaagg

SEQ ID NO: 52971 - protein, 85 aa, Zea mays
  misc_feature: Ceres CLONE 1471487-F
MVSLRFPTAAIPRLPPSQAPNGVAIAATVAAAAAAAAAVAASLTLTGKSTGRTVPHPAPLWASLSLADAAAPSSDEPRNGATYPT

SEQ ID NO: 52972 - DNA, 657 bp, Zea mays
  misc_feature: Ceres CLONE 1471490-F
  misc_feature (657)..(657): n is a, c, t, g, unknown, or other
ctggagctccccgcggtggcggccgctctagaactagtggatcccccgggctgcaggaattcgtctcacccctagaaaagcgaccccaggtcagtcgggactacccgctgagtttaagcatataaataagcggaggagaagaaacttacgaggattcccctagtaacggcgagcgaaccgggagcagcccagcttgagaatcgggcggctcgcccgccgaattgtagtctggagaggcgtcctcagcgacggaccgggcccaagttctctgaaaagggacgcctgggagggtgagagccccgtccggcccggaccctgtcgcaccacgaggcgccgtcaacgagtcggggttgtttgggaatgcaccccaaatcgggcggtaaaactccgtccaaggctaaatacaggcgaaacacccatagcgaacaagtaccgggaggggaaagatgaaaagggactttgaaaagaagagtcaaagagtgcttttaaattccccgggaggggaaccggatgggggcttggcaaccccccacggcccgtatggggaacggctccctgctggtcccccccaaggggtcgggggggtggaacctttgtccccccggcgccggggggcaaaggccgggggggcccttggccccccccccggaacccttn

SEQ ID NO: 52973 - DNA, 647 bp, Zea mays
  misc_feature: Ceres CLONE 1471493-F
  misc_feature: Translation starting site: 192
  misc_feature: SWISSPROT Homolog: EC 1.4.1.2 Glutamate dehydrogenase
  misc_feature (568)..(568): n is a, c, t, g, unknown, or other
ggagctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaggtcattcctgggcccggtgagagccaatgatagtttgtcagcacaggggggaggagaacagtttgcagccgaagagatctcctccatggntctcatcaagatgcgtgagatcgctgaagcttaccttggcagcacgatcaagaatggctgtgtcacggtcccctgctac

SEQ ID NO: 52974 - DNA, 647 bp, Zea mays
  misc_feature: Ceres CLONE 1471494-F
  misc_feature: Encodes the peptide sequence at SEQ ID NO. 52975
  misc_feature (627)..(627): n is a, c, t, g, unknown, or other
ctccccgcggtggcggccgctctagaactagtggatcccccgggctgcaggaattcgtctcacccctagaaaaaacgtctccggctccggcgtccgcttccaaccaactcacaccaaagtggcgacatcgccttccgccgcctgacacgtctggagttgttgttttagccgccagctcgctcccatctatctccatggagtctgctcccgccgcggtcatggagcgggagcgcctcacagccgagatggccttccgcggcgcggacgaagcgcggcgggacggcggcgagccggcgcccagcatcgtcatcaagatccgccgccggctcccggacttcgcccgcagcatcaagctcaagtacgtcaggctcgggatccgacacggaggcagccccacgtcggtgctgccgatgctctgcgtgccggcggtcgccgccgccgcctactcgttcgtccgcctcgacgtcatctactactccatcgacctgctcacctgcgtcgcctggctcggcaccgcgctgctgctgctcaccgtctactacttcaagcggccccgcccggtgtacctcgtggacttcgcgtgctacaagccggaggagcagctcaagatctccaagtccgcttccntcgagatgaccgagagcacg

SEQ ID NO: 52975 - protein, 151 aa, Zea mays
  misc_feature: Ceres CLONE 1471494-F
  misc_feature: SWISSPROT Homolog: EC 2.3.1.119 Icosanoyl-CoA synthase
  misc_feature (145)..(145): Xaa is any aa, unknown, or other
MESAPAAVMERERLTAEMAFRGADEARRDGGEPAPSIVIKIRRRLPDFARSIKLKYVRLGIRHGGSPTSVLPMLCVPAVAAAAYSFVRLDVIYYSIDLLTCVAWLGTALLLLTVYYFKRPRPVYLVDFACYKPEEQLKISKSASXEMTEST

SEQ ID NO: 52976 - DNA, 661 bp, Zea mays
  misc_feature: Ceres CLONE 1471501-F
  misc_feature: Translation starting site: 162
  misc_feature: SWISSPROT Homolog: EC 3.5.2.2 Dihydropyrimidinase
  misc_feature (550)..(550): n is a, c, t, g, unknown, or other
  misc_feature (613)..(613): n is a, c, t, g, unknown, or other
aaagctggagctccccgcggtggcggccgctctagaactagtggatcccccgggctgcaggaattcgtctcacccctagaaaaaaaagcgggctgcgacggctactttctcatctgctcactgctctgcttctccactccgctccgctggcagcgcaggccatggcgacacaggcgctggcgccctccctccgcctcctcctgctgctaccgctgctcgccgccgccgccgccgccgccgcgttgtctcacccagcgcacgagttctgcgcggtcgggggtgacgcctccggctgcggcggcggaggagacggcactaggatcctgatcaagggcgggacggtggtcaacgcgcacctcgcggagtgaggccgacgtctacatcgaggacggcgtcatcgtcgccgtccgcccagacatcccggttgatgttgataatgtcagggtaatcgacgacacaagaaaatatgtcgtgccaggtgtgattgaccctcacacgcacctgaagatcgagttcatgagcaccgtgaccatagatgacttcatcagcngtcatgctgcagcactgggcggtgagacgacgatgcatattgactttgtcattccagcggacngcaacttgactgcagggctggagtcctacaaacctatgcggcaaaagc

SEQ ID NO: 52977 - DNA, 769 bp, Zea mays
  misc_feature: Ceres CLONE 1471505-F
  misc_feature: Encodes the peptide sequence at SEQ ID NO. 52978
  misc_feature (769)..(769): n is a, c, t, g, unknown, or other
tccccgcggtggcggccgctctagaactagtggatcccccgggctgcaggaattcgtctcacccctagaaaaactctgattctccccctgctggtctgctctgctcccatcccatggagcccgacgccgcccaaaaccctagccccagccccgtccccccgcccatctccgcctactaccagacgcgcgccgaacaccacgccgtcgtaactagcgactggctcgcccacgccgccgccgcagccgcagccttccccggtgccgataccgccgatgccgccccgcccccgtcccccgggggcggcggcgtgatcgaggagttcaacttctggcgccgcaagcccgaagccgccgaggcggtggccgccctcatggctctcgtctgccgttttatggttttgtgaccccccccaaaaatggatgggaggtcgaagctcgacgctcaagaagggaatctgaagaagactcatgcccctggggaggcttgccttcacgtttcccctttctgtcgtcatggatggtacggttacaagcgcgtttcatgacggaggtaccctccgtatttggggcctgttgtggcgcccctgatgtgtcttagaatcgattgaggtccctgaagtccccgtagcccaaacttttgggggccctatatcgttaacaggcatcgccggatacctcgaccagggccctctacaagaaattctttttgaatgatcggcgcagcccgatcgccggctctgatgggttcgtttttatgacgcaggggcgn

SEQ ID NO: 52978 - protein, 96 aa, Zea mays
  misc_feature: Ceres CLONE 1471505-F
MEPDAAQNPSPSPVPPPISAYYQTRAEHHAVVTSDWLAHAAAAAAAFPGADTADAAPPPSPGGGGVIEEFNFWRRKPEAAEAVAALMALVCRFMVL

SEQ ID NO: 52979 - DNA, 660 bp, Zea mays
  misc_feature: Ceres CLONE 1471515-F
  misc_feature: Translation starting site: 282
  misc_feature: SWISSPROT Homolog: EC 1.7.1.4 Nitrite reductase (NAD(P)H)
aagctggagctccccgcggtggcggccgctctagaactagtggatcccccgggctgcaggaattcgtctcacccctagaaaaactagaaaaaaacgcagtaccgcaccaccaccaagcaccgcaaccggagccggagccagaggagggcgagaggccgaggggagaggagcgaaggaggccgccgaccgaccgtgcgtccggccccgcggcggcgtcggcaggtcgtagacggcagacgaggagcagcagcagcacgaggcggccgggcccgggccacgccatgccggagaaggaggcgcaggccgccgcgttctgcggcgagggcgtgattcgcgagttcgagtccctcacgcgggacgccgccgccgtgcagcgcgacacgctgcgccggatccctggcagacacgcctgcgccgagtacctcccgctgcggggcctcgcgggccgcaccgacgccgccagctttcgcgccttggtgccgctcgccacgcacgccgacatcgagccctacattgcgcgtatcgccgacggggacacggtcccccgtgctcaccgcaagcccattcacctccatctccctcagcttcggcacgacgcaggggaagcgcaagtacttgcccttcaaccaggagctcgtcaagtccacaatgcagatttcc

SEQ ID NO: 52980 - DNA, 699 bp, Zea mays
  misc_feature: Ceres CLONE 1471520-F
  misc_feature: Translation starting site: 113
  misc_feature: SWISSPROT Homolog: EC 3.2.1.14 Chitinase
  misc_feature (465)..(465): n is a, c, t, g, unknown, or other
  misc_feature (473)..(473): n is a, c, t, g, unknown, or other
  misc_feature (483)..(483): n is a, c, t, g, unknown, or other
  misc_feature (632)..(632): n is a, c, t, g, unknown, or other
  misc_feature (647)..(647): n is a, c, t, g, unknown, or other
aagctggagctccccgcggtggcggccgctctagaactagtggatcccccgggctgcaggaattcgtctcacccctagaaaaaggagtgggagagcgcgaagttaagccaccatgtggacgagggctttagcgatgatgctgttcgtggcaggcgccgcgctgctcggcgtcggcggcgccagcgcgcagcagggcgtgtggaacatcatcactcgtcccatgttccagagcatgctgagccaccgcggcgacagcgggtgccagggcgccttctacacctacgacgcgttcatcgaggccgccagcaagttccccggcttcggcaccaccggcgacgagcagacgcgcaggcgggagctcgccgccttcttcggccagacgtcccacgaaaccaccggtggatgggcgactgctcccggtggaccgtttgcctggggatactgccgggtgaaggacagaatctngacgaccnatcctactantgacgaagacccatacagctaactcatgagtacaactacaggctcgccgggcaagcgctgaacctgaaccctgtgggcaaccccgacattgtggcgagcgaccccgtggtagccttcaggacgccatctggttcttgatgacgccgcantcgcccaagccgtcntgccacccccctgatgaacggggcttggacaccctcgcccacgaacgggccc

SEQ ID NO: 52981 - DNA, 686 bp, Zea mays
  misc_feature: Ceres CLONE 1471533-F
  misc_feature: Translation starting site: 129
ctccccgcggtggcggccgctctagaactagtggatcccccgggctgcaggaattcgtctcacccctagaaaaagctagtcggctagtgggtgggaaatccgcagattcccgtcgctacttcggccacatggctgcagcggcggcgtggaccggcgccgcatcccccaactcgctgctgctctcgcgctcgcctccccacgccgccgcgctcgcgccttcgccgggaagctccatgcggaggcggctcctcctcggcgtcggcaccccggccgtggcggcgctggcggccgcggcgccgccagcggtgctgcaggacggagcggtcactgtgctcatcaccgccggcgcctactctcttgtgcgcgtcttcgacgagctcaccgagcggcggctcatcgaaaagagcttgagcaggaaggttgtgcacgtgctatccggcgtcctgttcatgtcatcttggcccctgttcaggtattccctgtccctagcatgcatcgaggttctcagattcataacgtttcacactgcaaagccaccaccaaagcatgctctgcccgcagcaattcgacagaagcacggtatttcgccgcggctgtcccgttcctggactccatgaggcttctgatatatggactccgtctctacactgatgaagctctggtaaatcagtgacacgtgaaggaaa

SEQ ID NO: 52982 - DNA, 714 bp, Zea mays
  misc_feature: Ceres CLONE 1471544-F
  misc_feature: Encodes the peptide sequence at SEQ ID NO. 52983
  misc_feature (415)..(415): n is a, c, t, g, unknown, or other
  misc_feature (466)..(466): n is a, c, t, g, unknown, or other
  misc_feature (492)..(492): n is a, c, t, g, unknown, or other
  misc_feature (519)..(519): n is a, c, t, g, unknown, or other
aaagctggagctccccgcggtggcggccgctctagaactagtggatcccccgggctgcaggaattcgtctcacccctagaaaaaaaccccgcgcgcgggggagcgataaaccctagtcttcgccgtcgtcgcaggaggacccgcgatgtcgcacttcgggaggtcaggcccgccggacatccgcgacaccttctcgctcctcgtcctcaacatcagcttccgcaccacggccgacgacctcttcccgctcttcgagcgctacggcaaggtcgtcgacgtcttcatcccgagggacaggaggaccggggactcgaggggtttcgcgttcgtgcggtacaagtacgccgacgaggcgcagaaggctatagatcggctcgatggccgtgatgtggatgggagaaacatcatggtgcantttgcaaagtacggccccaatgctgagccaatcggcaaaggaaggttaaangagggggttggaggaatccccagacngatccagaagccgccgtccaggcccanggcctcgagttaagatctttgaaacccaagtctccaccggggccaaaaaaaagccttgcccgtgaaaaaaacaggggtctatccttcctcgggaccaaaattaaaaccccaaagcttttattccagcccttggcaaacaaagatttctttaaaacaaaaatataaatttttggcccccaaactcttgtttaaaaa

SEQ ID NO: 52983 - protein, 128 aa, Zea mays
  misc_feature: Ceres CLONE 1471544-F
  misc_feature (18)..(89): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (90)..(90): Xaa is any aa, unknown, or other
  misc_feature (107)..(107): Xaa is any aa, unknown, or other
  misc_feature (116)..(116): Xaa is any aa, unknown, or other
  misc_feature (125)..(125): Xaa is any aa, unknown, or other
MSHFGRSGPPDIRDTFSLLVLNISFRTTADDLFPLFERYGKVVDVFIPRDRRTGDSRGFAFVRYKYADEAQKAIDRLDGRDVDGRNIMVXFAKYGPNAEPIGKGRLXEGVGGIPRXIQKPPSRPXASS

SEQ ID NO: 52984 - DNA, 696 bp, Zea mays
  misc_feature: Ceres CLONE 1471551-F
  misc_feature: Encodes the peptide sequence at SEQ ID NO. 52985
  misc_feature (426)..(426): n is a, c, t, g, unknown, or other
  misc_feature (427)..(427): n is a, c, t, g, unknown, or other
aaagctggagctccccgcggtggcggccgctctagaactagtggatcccccgggctgcaggaattcgtctcacccctagaaaaagtcacgaccgggaaaaacctcgccgccgccggcctcctctctcttgccttccatcccccgttgcgtcgaaccgtccctctcggggagtagagagaggatgatggagtcggaggtggtgaggatggagatggtgctggcgccgacgctgccgttcaagaaggtgcagacggcggacaagtatcccaagggccagtcccggggccgccagtggaagcacctgcgccacctgctccagtccgctgatgcatcctccatgcccccggaccgcccaattgtgagcaccctccgggccccacctcatgatctggatactcctccctgagttctgtagatgattatccnnacatcgcatattgtggccctgcttgtctttagagaacacacgtttctgcggtccttctcagtattcatggttatggggggaaataagtgaaaataatggttgggggggtgggccaaaaaaaaagggaagttgggttgctccttttcagttaatttgccggaactaaaattaaggccttttgggggcgttttgttttggatcccgaaaacacaatttttgagagggccccggtctttcaccccctaaaaaagggaactttttttttgtaa

SEQ ID NO: 52985 - protein, 73 aa, Zea mays
  misc_feature: Ceres CLONE 1471551-F
MESEVVRMEMVLAPTLPFKKVQTADKYPKGQSRGRQWKHLRHLLQSADASSMPPDRPIVSTLRAPPHDLDTPP

SEQ ID NO: 52986 - DNA, 615 bp, Zea mays
  misc_feature: Ceres CLONE 1471558-F
  misc_feature: Encodes the peptide sequence at SEQ ID NO. 52987
  misc_feature (509)..(509): n is a, c, t, g, unknown, or other
gctctataactagtggatcccccgggctgcaggaattcgtctcacccctagaaaaaacagagcagccacttggatccggtgctcagcggaacagctagctatagcctgtagctagcagctagcttcagtcacaggccggacggtcggctcacacacagctagccgccgccgccgctagcttagccaccagtagtccgatctgatctacaggcaaggggcaactagctagctagccgcgcgccggcgccatgatgaacctgaacctgaagcagcctctggtgctgcccgcgcaccacagcaatgtcgtcggctcgcgcctgtcgtcgtcgtcgccttcggcagccgccgccagcaggaggaccggcggcggcgtgtcctcccggtccggctcccggcggcacgtgcggctgccgaggatcagctgcagcgccaccgagggagtcagcggcgccgtgtcgtccgtcaccgtggagaagatgctcacggtgacggcgtcggtggaggcgtcncccgccatcgggcagatgtactttcagcggcgcgtcgacgactcggcgacctcctcggcagacgctgctgctcgagctcgtcagctccgagctcgacgcaaggtcg

SEQ ID NO: 52987 - protein, 122 aa, Zea mays
  misc_feature: Ceres CLONE 1471558-F
MMNLNLKQPLVLPAHHSNVVGSRLSSSSPSAAAASRRTGGGVSSRSGSRRHVRLPRISCSATEGVSGAVSSVTVEKMLTVTASVEASPAIGQMYFQRRVDDSATSSADAAARARQLRARRKV

SEQ ID NO: 52988 - DNA, 688 bp, Zea mays
  misc_feature: Ceres CLONE 1471561-F
  misc_feature: Encodes the peptide sequence at SEQ ID NO. 52989
aagctggagctccccgcggtggcggccgctctagaactagtggatcccccgggctgcaggaattcgtctcacccctagaaaaaaagggcaccgagcgcctgcacccggtgccgccgccggcgctgctggacgcggcggccgcgtcctcctcgtcgtccggctcgcaggagacgcccacctcgtcgtcctctgccgggtgggaggcgcgcggcaggacggctcaccggatgaagagcgccagcgcgtgtggcgcggccgacgccgagctcggggagtacgtggcgtacaagggcgaggagcgcgccgcggacgccgcgacgcataccgaggacggcggccgcggccacggccacagccacagccagaggcgcgtcctggctcccgccgcgcaggaggagctgagcagggcggagacgacctccccgccgacggcgtccacgagccccgagacgctggaggcgctcatcagggcggacgggcgcgttgtggcggccgtcagcggcagcggccgggccagggcgtcctccgtgctcatgcagctcatctcgtgcgggtccgtgtccgtgcgggacgcctcggtggtgccgcgcgcgcaggcgcaggcacaggtgcaccaccaccaccaccaccaccatcgtgcctgccgcccgccccgcccgccggcgtccgcggccgtcgacctgccgtc

SEQ ID NO: 52989 - protein, 228 aa, Zea mays
  misc_feature: Ceres CLONE 1471561-F
  misc_feature (10)..(228): Pfam Name: DUF966 Pfam Description: Domain of unknown function (DUF966)
AGAPRGGGRSRTSGSPGLQEFVSPLEKKGTERLHPVPPPALLDAAAASSSSSGSQETPTSSSSAGWEARGRTAHRMKSASACGAADAELGEYVAYKGEERAADAATHTEDGGRGHGHSHSQRRVLAPAAQEELSRAETTSPPTASTSPETLEALIRADGRVVAAVSGSGRARASSVLMQLISCGSVSVRDASVVPRAQAQAQVHHHHHHHHRACRPPRPPASAAVDLP

SEQ ID NO: 52990 - DNA, 687 bp, Zea mays
  misc_feature: Ceres CLONE 1471562-F
  misc_feature: Encodes the peptide sequence at SEQ ID NO. 52991
aaagctggagctccccgcggtggcggccgctctagaactagtggatcccccgggctgcaggaattcgtctcacccctagaaaaaattcctgcctgacgccaaggcctccccatcctcctcttgctatggtgcccagccgagctccctccccttcctgccatggccgacgccactccctgccgcagctcgacgccctcccctgcagcaagccgccatggagctcgccctggccctgcgtttttttttcctgcagctcgccccctgatctgcacgcaggggtttcttccatggcgctctggacaccagccgcttccccctggtggtcgagttccctcctgcatttctgctcgcccaaactccacttccctgttccagccaccttccatggacgccagccctcatctcaaggtcgccctcccatggcgtttgtctctgcgccgttgctgagctcgccctgcccccagccatggacgtcgtcgggccacctgtttcctatcttccatggacgccaatagcagcagcccactccttttgttctccatggatgaaagcccaagcatctgcgcctcccctaggtttttgtacaatcgcagcagcacgtcggacctttgcaaccccggtgagaccaactgcttgcgctatgtttattccccaccaattcctatatttgattatttactgtgtatg

SEQ ID NO: 52991 - protein, 129 aa, Zea mays
  misc_feature: Ceres CLONE 1471562-F
MVPSRAPSPSCHGRRHSLPQLDALPCSKPPWSSPWPCVFFSCSSPPDLHAGVSSMALWTPAASPWWSSSLLHFCSPKLHFPVPATFHGRQPSSQGRPPMAFVSAPLLSSPCPQPWTSSGHLFPIFHGRQ

SEQ ID NO: 52992 - DNA, 662 bp, Zea mays
  misc_feature: Ceres CLONE 1471568-F
  misc_feature: Encodes the peptide sequence at SEQ ID NO. 52993
  misc_feature (425)..(425): n is a, c, t, g, unknown, or other
  misc_feature (475)..(475): n is a, c, t, g, unknown, or other
agagctggagctccaccgcggtggcggccgctctagaactagtggatcccccgggctgcaggaattcgtctcacccctagaaaaagcacccagaggaggcaaggagcccatccacatccacctggtcctgctctcaccacaccgccgcgccaatggcggctcgccggcagcaccgccgcggcttcccgctggtcccgctcctgctctcccctctggccgcgccgcgtacggccgcctcatctccgacggcggcccgtccgcgcagctccctctcgtgatccgcctctcggggtcctcgccggccgcgggggcggccgcaaggccgaagagaagtgcgagcagtcctacgggttcctcccctgcaccacaccgtgctcgggaaacctctcctcgtgctgacgtacggctacctcatgtacaaggcngccacgtacctgtcggcgggagcgagctgctgctcgagacatggggcccngcctcgtcggcggcctcctcctccccatctcggcgccctcccggacgcgctcctcgtgctcgtatctggcctgtcgggaataaaaaggaggcacagagtcaggtactgatccggaatgggctgctttcttggtccacacgtcttcctctccacctggtttggggggacctgtgtcttttttggaaaa

SEQ ID NO: 52993 - protein, 56 aa, Zea mays
  misc_feature: Ceres CLONE 1471568-F
  misc_feature (21)..(21): Xaa is any aa, unknown, or other
MYKAATYLSAGASCCSRHGAXPRRRPPPPHLGALPDALLVLVSGLSGIKRRHRVRY

SEQ ID NO: 52994 - DNA, 890 bp, Zea mays
  misc_feature: Ceres CLONE 1471570-R
  misc_feature (1)..(1): n is a, c, t, g, unknown, or other
  misc_feature (8)..(8): n is a, c, t, g, unknown, or other
  misc_feature (890)..(890): n is a, c, t, g, unknown, or other
ncgattgngtacctcgagcgtctcgtttttttttttttttttttcagaactgaaagattactcaattcctgggcccggggaaacaatataaactgcccctaaaccatatgaaccgcctttacactgattgctgcgactaaaaaggtcccccaaagctaaagatcccccgaagtaatctccccccccgggattcaaagatgaggatccttgtaaccaaagctcactcccaggaattatttattctgtcaagcaaatgagctttgggccttagggaacccccccatccccttcttgaacgcagccatgggaggggcggcctttgaattcaagggctgcctctcctcgccgctaagttccttccatttcaccgggatgagcgcgttcagggttaagttattgatgcccgggcgttcctcaataagctgtttcctctcttccttgctaaaaaaaaaaaaggaaaaggctggcctcttgggccggttgggatcagcgttcccctgtttcttcttctggcgcttttctttggttttcttgaagatattatcggccttccccttcttcttgagcagctggaaagcctcaggcttcaggattttctaatgccccggctcttccttccaaaaattagaggttcctaagccttttttggtgtgaacacctcccatcggcttggggaaacttttccttcgggttcccggggacctccttaaaggggagcccttggaacctctgggcagggtcctcccattccttcccccgggggatcttggccaatcctcgggggaaatttctttcttttccccgaaaccagaggggggacaacccctctttccgggggagatacaacaaaataagggccccaaacatggggccctcccttgtgggctttn

SEQ ID NO: 52995 - DNA, 732 bp, Zea mays
  misc_feature: Ceres CLONE 1471570-F
aaagctggagctccccgcggtggcggccgctctataactagtggatcccccgggctgcaggaattcgtctcacccctagaaaaaacgaaaacacaccatactctcctcatcaccgttgctcgtatttcgttctaggtcaccctgttgggatccatggtcaccggtgcggtggagagcactaggggcatcgtccggggccgcaaggcgctcgtggtcgtgttcgacgacgatgctaacatctccaccggcaaggccgcccaggacgacgatctctcgtcctgctcgttccagaccattgagaagcatcacgccgtagatcagcatcaaggccaaggccgcagagaagtcggtcgccgtgctcatttacgacatagacgagatgcacgcgatgataaagcgccttgccgctgaagaaaagcccaccccccagcatatgggttacgtattgggactaagtcatccccgacgacggagggatgaaaatcgatatccccaaacaatgtaacaggaatctcctccatgtccaaagatgaaggaaggtttatacctcctttggatttccaggcctatagtgggatttccccttcgccatttccattgctttgggaaacgtcttataaccgtaattaacatgcctaaaaaaaaaaagaaaggatttgggtcgcctatgaaaataaaaaaaacccctctccgaaaaaattgtcttcttggctaaaggtgacacaggttaat

SEQ ID NO: 52996 - DNA, 689 bp, Zea mays
  misc_feature: Ceres CLONE 1471571-F
  misc_feature: Encodes the peptide sequence at SEQ ID NO. 52997
aagctggagctccccgcggtggcggccgctctatactagtggatcccccgggctgcaggaattcgtctcacccctagaaaaaagcccatccatccaatacgcccaccagccaccacacatcctctctccctcccagtcccaggagcgtggcctcactctcctcgtcgcatcccctctcctcatcttcaaagcgcgggcggcggcaatggcgatggcctccacctacgcgccgggcggaggcgcgggggcgctcgcgcagggaagatgcagggtccgcggtcccgcggggctgggcttcctcggcccctccaaggccgccggcctcccccgccccctcgccctcgccaggcggacgagcagccccgtcgcggtgggcgccacgctgcgatgcgcggcgtcgtcgtcccccgcgcccgcgcggcccgccacggcgccgcgcttcatccagcacaagaaggaggccttctggttctaccgcttcctctccatcgtgtacgaccacgtcatcaacccgggccactggaccgaggacatgcgcgacgacgcgctggaacccgccgacctcttcagccgccacctcacggtcgtcgacatcggcggcggcacggggttcaccacgctcggcatcgtcaagcacgtcaacccggagaacgtcacgctgctcgaccaatccccgcaccagctcgaca

SEQ ID NO: 52997 - protein, 161 aa, Zea mays
  misc_feature: Ceres CLONE 1471571-F
MAMASTYAPGGGAGALAQGRCRVRGPAGLGFLGPSKAAGLPRPLALARRTSSPVAVGATLRCAASSSPAPARPATAPRFIQHKKEAFWFYRFLSIVYDHVINPGHWTEDMRDDALEPADLFSRHLTVVDIGGGTGFTTLGIVKHVNPENVTLLDQSPHQLD

SEQ ID NO: 52998 - DNA, 794 bp, Zea mays
  misc_feature: Ceres CLONE 1471578-F
  misc_feature: Encodes the peptide sequence at SEQ ID NO. 52999
  misc_feature (310)..(310): n is a, c, t, g, unknown, or other
  misc_feature (334)..(334): n is a, c, t, g, unknown, or other
  misc_feature (365)..(365): n is a, c, t, g, unknown, or other
  misc_feature (390)..(390): n is a, c, t, g, unknown, or other
  misc_feature (395)..(395): n is a, c, t, g, unknown, or other
  misc_feature (397)..(397): n is a, c, t, g, unknown, or other
  misc_feature (553)..(553): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
aaagctggagctccccgcggtggcggccgctctagaactagtggatcccccgggctgcaggaattcgtctcacccctagaaaaagtcgaacacagagtcacttcgccacgaacaaaagcgcatcgatctcgctgtcgtcactcctcgtcacccagccacgaacagaggcaccacccagcatggccctgcaggcggcgctcctcccatccaccctctcatccgtccccaagaagtgcagcatcgccgtcgcggcgaaggacacggcattccttagcgtatcctagaagaagtgcaggctgcgtcgctgtcngtgagaacgctggtggcgacgacngcgcctgtggccacgcggggtccagcacggncgccaaggatggaaagaaaactttncgcangncttggtggttaaccccggccccctccttcggtgatgggcccctggggggggcaaagggccttggggaaaaccggaaagtgggcccggtgtatagccctccccccaaatttctcaaggggccaaagggcccccaagggctcccccttgtgaaaaagnaaaaaaccccttttggggcgggggggggggccccccccacaaaaggggggggatttttttgagagaaattgggcgggcggggggggccccccaaaccttttttttagaggagcgccctcttttcccgcccccgggggggagacccctccctcctcggggaagaagaaaaaaaaaacagggnnnaaaaaaaggggggggttcttcttttgcgcggcgcgcctcctttaaagaaaaaaaaaaa

SEQ ID NO: 52999 - protein, 34 aa, Zea mays
  misc_feature: Ceres CLONE 1471578-F
MALQAALLPSTLSSVPKKCSIAVAAKDTAFLSVS

SEQ ID NO: 53000 - DNA, 697 bp, Zea mays
  misc_feature: Ceres CLONE 1471581-F
  misc_feature: Encodes the peptide sequence at SEQ ID NO. 53001
aaagctggagctccccgcggtggcggccgctctagaactagtggatcccccgggctgcaggaattcgtctcacccctagaaaaaatctcaaacctgtgcgtctgcccctttccagctttcctctcaaacggagagatgtactcggatcagatctccaccgggcgcaagcgctccatccatgaccgccttgacggcgacctccctgccggcacgggcgccggcggctgtgtccgtcacacggtgtccaagaggcaacgacagatagatgaaaaatggaagcatgatctgtatcgggaagatgatgaaccagcttcaaaatcaacagatccgaaggatttgcgattgaagcttcagaggcgaagttttcaacaagattttaccagcacaagaagttctggtgtgcgtgatctacgtgagaagctatctggtataatgaacccacagccatcaaatgctgacccaccaaagccaaagccaaagccagtatcggaggttgttaacatctcaaggcgtcaaattgctgatgaaatgcatgcacgccaaaataagaaaccaccaaagcagacttcatcgaagaaggcatctcagcccagaccagagcaggaaagtatcctattgcaggcacaacaacaggtgcagttgcagaaacttgtgtatcaagttggagcgcttcctacaaaggttgtatgcctcacac

SEQ ID NO: 53001 - protein, 187 aa, Zea mays
  misc_feature: Ceres CLONE 1471581-F
MYSDQISTGRKRSIHDRLDGDLPAGTGAGGCVRHTVSKRQRQIDEKWKHDLYREDDEPASKSTDPKDLRLKLQRRSFQQDFTSTRSSGVRDLREKLSGIMNPQPSNADPPKPKPKPVSEVVNISRRQIADEMHARQNKKPPKQTSSKKASQPRPEQESILLQAQQQVQLQKLVYQVGALPTKVVCLT

SEQ ID NO: 53002 - DNA, 685 bp, Zea mays
  misc_feature: Ceres CLONE 1471582-F
  misc_feature: Encodes the peptide sequence at SEQ ID NO. 53003
  misc_feature (286)..(286): n is a, c, t, g, unknown, or other
aaagctggagctccccgcggtggcggccgctctagaactagtggatcccccgggctgcaggaattcgtctcacccctagaaaaaaggccacttacctgcagtcaccactcccaagccagtacccacagtcctacgagcagtcgcacgcaagtgtcaagagacgaaacggtcgacatggctcgcacgcaatctgccgtagcggtcgccgtggtggccgcggtgctgctgctggcagcggcggcaacaacctcggaggccgccatcacctgcgggcaggtgagctccngcatcgcgccctgcctctcctacgcccgcgggacggggtccggcccctccgcgtcctgctgtagcggcgtcaggaacctcaagagcgccggcagcaccgccgccgacaggcgcgccgcctgcaactgcctcaagaacgccgccaggggcgtcagcggcctcaacgccgggaacgccgccagcatcccctccaagtgcgggggtcagcatcccctacaccatcagcaccctcacggactgctccgagggtgaactaaaaacctaagaccacgcgcgaacgacggggccgcctgattaattcgaccaaaccttttcccgcgtcggccggccgggcggaataattcggggccgccggcattgaagaatatctatccaatcccccgccgtgagggagcggtgg

SEQ ID NO: 53003 - protein, 120 aa, Zea mays
  misc_feature: Ceres CLONE 1471582-F
  misc_feature (32)..(109): Pfam Name: Tryp_alpha_amyl Pfam Description: Protease inhibitor/seed storage/LTP family
  misc_feature (38)..(38): Xaa is any aa, unknown, or other
MARTQSAVAVAVVAAVLLLAAAATTSEAAITCGQVSSXIAPCLSYARGTGSGPSASCCSGVRNLKSAGSTAADRRAACNCLKNAARGVSGLNAGNAASIPSKCGGQHPLHHQHPHGLLRG

SEQ ID NO: 53004 - DNA, 676 bp, Zea mays
  misc_feature: Ceres CLONE 1471583-F
  misc_feature (676)..(676): n is a, c, t, g, unknown, or other
ctagctggagctccccgcggtggcggccgctctagaactagtggatcccccgggctgcaggaattcgtctcacccctagaaaaaaagaagcgtgaccacttccttatcgtctcctcctttcctcccctcaactccaatcgaatcgctcgaaccattcccaggtttgtgcgtcgatgtaggcttgcgcgaggatccaattgcatcccgctccccttttgagcttgtgatcttcggagccggagttcttcccaagcctcccccaaccccacccccgacccccccaatttttttttgggttattgagggggaattttcctcaagagctttataagggtagtttgtcaattcccggggcaacggcgggccttttttttttctccccccccccccggggggggggggggggggggggccctctttctttcttaccctctattaacatcttccccccccccctcacttaaaaaaaaagtttgggttgggtgtgttctcctcgcgggtggggagagaaatccgcccccaaaaccccgcggctcgcgtcccctcaacagacgctaagaagtttgtagtttactccctcgtgcttctttggtgtgttggttcctgattctctttggtgtatggctggtctcgctgttccgtgcctctcgtactttgtcacttttggcggtgtgcn

SEQ ID NO: 53005 - DNA, 710 bp, Zea mays
  misc_feature: Ceres CLONE 1471590-F
  misc_feature: Encodes the peptide sequence at SEQ ID NO. 53006
ccccgcggtggcggccgctctagaactagtggatcccccgggctgcaggaattcgtctcacccctagaaaaagcctttgccggccttcccattcccccgtctcctcttcccttccgccaaggcccagcccgctatcctctcgtctcacggatctcgcctctgctccgcggcgccgaccccgacgaaccatcgcctccatgcctaggagcggctacctcgtagagctccgggttcgcgaaaaagcgcttttggaggacgatgctgctttctacaggttcaaatcatacataagcagtgtgcaatcggtctcgaagatcggtaatgctctcactttagctagcctacttgcttgtggctacaagattgctacgcccgagacgaaaagacaatgaagttaataatccccacccttctggcaaaagttattaggggaaagtgatccctccgcatgcacaggcacccacttctatctagtagcttccccccaacctgctccacaggccttaccttgtacacaaagcctaactagggttggcggtgcatggtaaaaacaagatacctaggcccatggacatgcgtggattcttagctcctcgaaccattctttgcctgggctaactccacatatattaacgccggccccccttttcctaccacctagcctggagccttatgtaaacgcatcgatccaggatctcggattctttcac

SEQ ID NO: 53006 - protein, 64 aa, Zea mays
  misc_feature: Ceres CLONE 1471590-F
MPRSGYLVELRVREKALLEDDAAFYRFKSYISSVQSVSKIGNALTLASLLACGYKIATPETKRQ

SEQ ID NO: 53007 - DNA, 717 bp, Zea mays
  misc_feature: Ceres CLONE 1471605-F
  misc_feature: Encodes the peptide sequence at SEQ ID NO. 53008
  misc_feature (387)..(387): n is a, c, t, g, unknown, or other
  misc_feature (389)..(389): n is a, c, t, g, unknown, or other
  misc_feature (391)..(391): n is a, c, t, g, unknown, or other
  misc_feature (394)..(394): n is a, c, t, g, unknown, or other
  misc_feature (399)..(399): n is a, c, t, g, unknown, or other
cagagctggagctccccgcggtggcggccgctctagaactagtggatcccccgggctgcaggaattcgtctcacccctagaaaaactcttcccctaaaacctcctcctctctcctgctgccacgaggtacggcccagctcttcctcaaagcgggcgaaatccacgccgcgcggcggcggcggcagaggaggaggggggatgatggggtgcctcttcgcctgcttccgcgcgtccggcggcgatggcgaggtgaagggcaccggcggccagctcgcgcatccgtcccagccccccgcgacgacgactacgaccagccgccaggtccaggatggcgcgggcaggagggccaggccgctgtcgaggaacgcgctctcggcggtgtgccancnanaanatganggatcaacgaccccccacgtggtgagctcgtgagctgacgaaagtggcgagaggaaggacatggatcaggagcttgtgcatcaggccattatccaaaaaagctgtggtggcgtgttgcaaactacaaataacattctagggagcgctcatcaaatatgctgattccagtccccccgaagggaaacacctcggggacggccccccgggctgggtccgaagaacctacctctcatggaaaggccccaaaggaggcgaaaaggggaatacccctttcagggtctccctcagagttcccaccgttttcaccatggacccagt

SEQ ID NO: 53008 - protein, 77 aa, Zea mays
  misc_feature: Ceres CLONE 1471605-F
  misc_feature (63)..(63): Xaa is any aa, unknown, or other
  misc_feature (64)..(64): Xaa is any aa, unknown, or other
  misc_feature (65)..(65): Xaa is any aa, unknown, or other
  misc_feature (66)..(66): Xaa is any aa, unknown, or other
  misc_feature (67)..(67): Xaa is any aa, unknown, or other
MMGCLFACFRASGGDGEVKGTGGQLAHPSQPPATTTTTSRQVQDGAGRRARPLSRNALSAVCXXXXXGSTTPHVVSS

SEQ ID NO: 53009 - DNA, 670 bp, Zea mays
  misc_feature: Ceres CLONE 1471608-F
  misc_feature: Translation starting site: 314
  misc_feature: SWISSPROT Homolog: EC 2.7.11.1 Non-specific serine/threonine protein kinase
  misc_feature (465)..(465): n is a, c, t, g, unknown, or other
  misc_feature (590)..(590): n is a, c, t, g, unknown, or other
ctggagctccccgcggtggcggccgctctagaactagtggatcccccgggctgcaggaattcgtctcacccctagaaaaaaagtgacgcgagcacgagcacacatcccctcccttcttcggttattcctcgttgcgtgccctcgccgcagacctctgccatggcggaccagctcaccgacgagcagatcgcggagttcaaggaggccttcagcctcttcgataaggatggcgacggctgcatcactaccaaggagcttggaacggtgatgcgctcccttggccagaacccctaccgaggcagagctgcaggacatgatcaacgaggtcgatgcggatggcaatgggaccatcgacttcccggagttcctgaacctgatggcgaggaagatgaaggacacggactcagaggaggagctcaagggagccttccgcgtcttcgactaggaccagaacggtttcatctncgctgccgagctcccgcatgtcatgaccatccttggcgagaagctgaccgacgaagaggtcgacgagatgatccgtgaggccgacgtcgacggcgacggccagatcaactacgaggagttcgtcnaggttatgatggccaagtgaggagcggtccccgtgaaataagtatctatggattgaagcgaattatcaggcacccaagcg

SEQ ID NO: 53010 - DNA, 693 bp, Zea mays
  misc_feature: Ceres CLONE 1471610-F
  misc_feature: Encodes the peptide sequence at SEQ ID NO. 53011
  misc_feature (448)..(448): n is a, c, t, g, unknown, or other
  misc_feature (470)..(470): n is a, c, t, g, unknown, or other
  misc_feature (494)..(494): n is a, c, t, g, unknown, or other
  misc_feature (509)..(509): n is a, c, t, g, unknown, or other
  misc_feature (536)..(536): n is a, c, t, g, unknown, or other
aaagctggagctccccgcggtggcggccgctctagaactagtggatcccccgggctgcaggaattcgtctcacccctagaaaaaggatgattccagtcctcctcctgttctttgtttcccgtcccatcgtgtgtgagcgcgtctgctggtctgccaagaggaggaaaggaaggagagagatggcttgccctgcgcagtccatgctctccgccagcggctgcatcttcctgaggagcaagcctcaggcggcatcccaagtgcgagggggcatcatcggcggtggccgcagcagcaggccgttcctgctcacctgcaacgcttcctcttctccgtccccttcctcgccggcgccggcgcaggaagaccccgactgcaactgagaggagtgcgccccggagaagggagtcgggagcctgagcgctgagtggctggccgaagagaggaccangtcgtcggcactttccctcctnagaagagaggttggactggcttantgagaaggaaactgncggtcagaaccaacttttattccgttnaagcccatggggtaccttggcccaaaacgcccatcagtttccgggacggggggggaactttcgggggggaaggggccccacaaaaaaaaagggcccccctctcctcccggggggggttgttttcctcctccacaaaaaaaccgcgcccccccccccc

SEQ ID NO: 53011 - protein, 97 aa, Zea mays
  misc_feature: Ceres CLONE 1471610-F
MIPVLLLFFVSRPIVCERVCWSAKRRKGRREMACPAQSMLSASGCIFLRSKPQAASQVRGGIIGGGRSSRPFLLTCNASSSPSPSSPAPAQEDPDCN

SEQ ID NO: 53012 - DNA, 639 bp, Zea mays
  misc_feature: Ceres CLONE 1471611-F
  misc_feature: Encodes the peptide sequence at SEQ ID NO. 53013
ctggagctccccgcggtggcggccgctctagaactagtggatcccccgggctgcaggaattcgtctcacccctagaaaaaccctagaaaaaatgagtgccttcttctaccttatgagcaagcgctcactcgtgaggattccaccacgggcctctattatgactgctctgcccacttcctatgggtcggagagcgcactcgccagcttgatggtgctcacgttgagttccttcgaggcattgccaaccctcttggtatcaaggttagtgacaagatggacccagcagaacttgtgcggttgattgatatattgaatcccgaaaacagggctgggagaataaccatcatcacaagaatgggacctgaaaacatgagggtgaaacttccacacctgatacgcgctgtccgtggggccggtcagatagtaacatgggttactgacccaatgcatgggaacactatgaaagccccttgcggactcaaaacccgctcgttcgataggattttgggtgaggtgcgtgcgttctttgatgtccacgaacaagaggaagcaaccctggaggagtgcatctagagatgactggacaaaatgttacagagtgcatcggcggggtcacgtacggtgaccttcaatgatctg

SEQ ID NO: 53013 - protein, 99 aa, Zea mays
  misc_feature: Ceres CLONE 1471611-F
  misc_feature (1)..(100): Pfam Name: DAHP_synth_2 Pfam Description: Class-II DAHP synthetase family
  misc_feature: SWISSPROT Homolog: EC 2.5.1.54 3-deoxy-7-phosphoheptulonate synthase
MDPAELVRLIDILNPENRAGRITIITRMGPENMRVKLPHLIRAVRGAGQIVTWVTDPMHGNTMKAPCGLKTRSFDRILGEVRAFFDVHEQEEATLEECI

SEQ ID NO: 53014 - DNA, 705 bp, Zea mays
  misc_feature: Ceres CLONE 1471615-F
  misc_feature: Translation starting site: 528
  misc_feature (418)..(418): n is a, c, t, g, unknown, or other
  misc_feature (705)..(705): n is a, c, t, g, unknown, or other
aaagctggagctccccgcggtggcggccgctctagaactagtggatcccccgggctgcaggaattcgtctcacccctagaaaaagcgccacacacagtacgtacaagcctctcatcagaaatggagtccaccaagctctccgcgctgctggtgctcgacatgctcgcactctcctcatcaccgctggctctagcgtgggagaaggcggaaccggagtgccactcgtgcgagtccggctcgccaccctcgaccggcggcgtccccctgcctcccgtcagcataccgtcagtcccgctgccccctgtcagcataccgatcggtccccctgccccctgtcagcataccgtcagtgcccctgccgccggtgaccctccctcccattccgatcgttgggggaagcccgagcccgaccaagaanggacaccggaaggcgtgcccaccgcctccgtctcccccgacaccgacacccacgcccacgccgatcctcggacaagtgccccatcgacacgctcaagctcggcgcctgcatggacgttctcgggaacgaggtgcacgtcagcaactccgacgtccagtgctgcccactcgtgaagggcatcgccgggctctccgcggcggcatgcctttgcaccgccatcaatgccaaagagctcgacatctccaactacttgctcatcgcgctcgaggtgctcgtcaactgcggcn

SEQ ID NO: 53015 - DNA, 636 bp, Zea mays
  misc_feature: Ceres CLONE 1471621-F
  misc_feature: Encodes the peptide sequence at SEQ ID NO. 53016
aaagctggagctccccgcggtggcggccgctctagaactagtggatcccccgggctgcaggaattcgtctcacccctagaaaaaggcttttgcttgcttgcttcctcctctcccgtcgggcactcgggctcgtcagactgcgcccgggcgccgaatctccagacgggatcgcgccccccatctgacgccaccggcgccggagcccacggcgaccgcccgcctctgcctccgatctataagaaacattggagaaccgtactgaacaaaataagtactggtatttcatcgtttgtctcggtattccaataatgtggaaactcaatccctttggaggtaaagcacagagcgtgttggatggtcgtactattgatgttggaaatttgatgatcacagtacatgatgccgttgcgcaaggaggtttctcttgtgtatatctagcatgtgacacagtacatccatcatagatgtatgcactatggcacattatttgcaatgactcagactcgcttgatcttgcctgaaggagatccaggtttttgaccctcctcaagggcattcgaatggcggtccacttgttgcccctgaggtttttgacttgggtcgttcaaaaagagcacttcttgaaatgcagctccg

SEQ ID NO: 53016 - protein, 51 aa, Zea mays
  misc_feature: Ceres CLONE 1471621-F
MWKLNPFGGKAQSVLDGRTIDVGNLMITVHDAVAQGGFSCVYLACDTVHPS

SEQ ID NO: 53017 - DNA, 463 bp, Zea mays
  misc_feature: Ceres CLONE 1471634-F
  misc_feature: Encodes the peptide sequence at SEQ ID NO. 53018
  misc_feature (220)..(220): n is a, c, t, g, unknown, or other
  misc_feature (233)..(233): n is a, c, t, g, unknown, or other
tggagctccccgcggtggcggccgctctagaactagtggatcccccgggctgcaggaattcgtctcacccctagaaaaaagccaagcaaataagacgacttgtttcattgattcttgaagagatcgagcttcttttgcaccacaaggtcgaggatgtcttgcactgcggatcaagctgcggctgcggctcaagctgcaacaagagtaccctgacctggangagacgagcaccngccgcgcagggccaccgtcgtcctcggcgtgccccccgaagaagaaaggccgcgcccgagttcgtcgagccgcccgcgaattcgggcaagccccccacggttgcactgcggtggaaattgaatgcaaccctggaactgctgatccattgatcgacaaccgggaatgaatatttccctcccacctgggggggggggtgaaaaaaaaaaaacggggccaatttggtttccaa

SEQ ID NO: 53018 - protein, 38 aa, Zea mays
  misc_feature: Ceres CLONE 1471634-F
GAPRGGGRSRTSGSPGLQEFVSPLEKSQANKTTCFIDS

SEQ ID NO: 53019 - DNA, 660 bp, Zea mays
  misc_feature: Ceres CLONE 1471662-F
  misc_feature: Encodes the peptide sequence at SEQ ID NO. 53020
  misc_feature (418)..(418): n is a, c, t, g, unknown, or other
  misc_feature (419)..(419): n is a, c, t, g, unknown, or other
aaagctggagctccccgcggtggcggccgctctagaactagtggatcccccgggctgcaggaattcgtctcacccctagaaaaaagcagcctcccaaatccccaaagcctccgacccccttcctctctccctccgccgccgctgcgcacgcagggaacaagcgacatgggcgtctacacctttgtgtgccgcaacaacggcggcgagtggaccgccaagcagcactccggcgagatcgaggcttccgccgctaccccatacgagctgcagcgccgcctcgtcgctgccgcctccgcggccgactctgcctacggcgtccagtcgtccttctccatggtcacccccagctccgccgtgttccaggtgatcgtcggtgctgtcggtggtggtgcaatgatggtgagcggaggtggcggcnngcgtgctgctgcatctggtggtgctgctgccgaggctcccagggagagaagaaggaagaggagaaggaagagagcgacgacgacatgggattctcccctgtcgactagagtggtgtgtgtcatctggatctcaaaagtggtggtttggccctgttggcgtaattaattttggctgccctgcctggaaccctgaaaaactcttgggaattggtataaaccacctgttcccagttatgggaaa

SEQ ID NO: 53020 - protein, 139 aa, Zea mays
  misc_feature: Ceres CLONE 1471662-F
  misc_feature (85)..(85): Xaa is any aa, unknown, or other
MGVYTFVCRNNGGEWTAKQHSGEIEASAATPYELQRRLVAAASAADSAYGVQSSFSMVTPSSAVFQVIVGAVGGGAMMVSGGGGXRAAASGGAAAEAPRERRRKRRRKRATTTWDSPLSTRVVCVIWISKVVVWPCWRN

SEQ ID NO: 53021 - DNA, 762 bp, Zea mays
  misc_feature: Ceres CLONE 1471670-F
  misc_feature: Encodes the peptide sequence at SEQ ID NO. 53022
  misc_feature (310)..(310): n is a, c, t, g, unknown, or other
  misc_feature (639)..(639): n is a, c, t, g, unknown, or other
  misc_feature (671)..(671): n is a, c, t, g, unknown, or other
caaagctggagctccccgcggtggcggccgctctagaactagtggatcccccgggctgcaggaattcgtctcacccctagaaaaaatccactccaaacccccaccccaccgagccacgcgacgagccgcgccgccatgtggccactctcctacctgccgccggcaccggcgcagcagttgcgagcgcaccccggtcccggctccggccgcgggcccaggccgcagccgtgcgggctgccgttccccgacaccctccgcgcggctgcagttgcggccgccgtctccctttctctcatctatggaaacggcntgggcgcggcccttccgtcatcagcggtgccaaccaatggaggtgtgccggaacggggggcgcggaaatggaaaagaaattcaacgccctaatgtggttaattaaacacccccccccccccaccaacgccctggggatcgtggccaaaataaaagcttttccctccccaaaaacccacccagccttcttgtaggacctctcaagagaatttgaaagctaagcgggacactccgcatagtcctctcccccggcaaaaattaaaatcctccaccccccaaatggcgcataataactacctttccccaagaacgcccccccacccacccccnggcgcccccttacaccacccacttccccaacncgcccgcccagaaattatcttcacccacctccaacaagccgggttggacacggcccctacctccctgtaccctctcgcgtaagacccaccc

SEQ ID NO: 53022 - protein, 88 aa, Zea mays
  misc_feature: Ceres CLONE 1471670-F
  misc_feature (59)..(59): Xaa is any aa, unknown, or other
MWPLSYLPPAPAQQLRAHPGPGSGRGPRPQPCGLPFPDTLRAAAVAAAVSLSLIYGNGXGAALPSSAVPTNGGVPERGARKWKRNSTP

SEQ ID NO: 53023 - DNA, 769 bp, Zea mays
  misc_feature: Ceres CLONE 1471688-F
  misc_feature: Encodes the peptide sequence at SEQ ID NO. 53024
  misc_feature (548)..(548): n is a, c, t, g, unknown, or other
  misc_feature (740)..(740): n is a, c, t, g, unknown, or other
aaactggagctccccgcggtggcggccgctctataactagtggatcccccgggctgcaggaattcgtctcacccctagaaaaaagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcatcggcgaggcccgcgtgacgatgcgcaagacggcggtgaaagcaaagccggcggcgagctccagcagcccgtggtacggcctcgaacgcatgctctacctggagaccgatgtccggcgcagccacaagctacctgacggacgaagtccctggctgactacggctgggacaccgcggggtctgtcggacggaccctggacaccttctcccattaacccgggagctggaaggccatcaacttcccgctgggccaatggcttgacccgtttggagttggcttgttccccggaacttgttcccccctccgcggaagcttaaaaaacggcccccntccgcccgggattcccccaggatccgggtttttttcttccaggaccataaacacccgggaaagggccccccctcaaaaaaaatttgggaaaacacaattttcaaaaaccccgtgaaaaaaaagaaacagtggggcacaaaatcccccccacttttttaacccccgccaagaggggggggggggggagggggngccttttccccccctcgccacccgtgggg

SEQ ID NO: 53024 - protein, 129 aa, Zea mays
  misc_feature: Ceres CLONE 1471688-F
MASSTMALSSTAFAGKAVNVPSSLIGEARVTMRKTAVKAKPAASSSSPWYGLERMLYLETDVRRSHKLPDGRSPWLTTAGTPRGLSDGPWTPSPINPGAGRPSTSRWANGLTRLELACSPELVPPSAEA

SEQ ID NO: 53025 - DNA, 687 bp, Zea mays
  misc_feature: Ceres CLONE 1471692-F
  misc_feature: Encodes the peptide sequence at SEQ ID NO. 53026
aagctggagctccccgcggtggcggccgctctagaactagtggatcccccgggctgcaggaattcgtctcacccctagaaaaaaaacctcctacagacatagtggctgtatcagactccttggtatctagcctcggcggctcctccctggccagccgcacgtgcgttctccaccaggttcatcctcgaggaaacatggtgccgcacgaagaaccccctgatgagcaggaacctgcgagaggaatggtaggattacttgcatgacgtatccccgagactggctgcagatggacctaagcgtcatcggcttccggctcatgggttggatggggccgtgcaacgtcctcagggtcctccgcaacatgctcacggggctcttcttctctcaaatcggccagcagctggcccacttacccacccccccctctcgtcacctcccaagactggctgtgcctagtgacggggcacctaggcccggtacatcccgctcaacttctcccagatccggcattcagggtcaggtacaaaaacaactcctaccacctaatggctctaaagataactgtacatcttaaactaacgactacgcctgccctggggtcgccgtgaataaccatccataatttatacccttctgtctgtataggggcctcccgatttccggaccaatcgtaaacgccatgctgcc

SEQ ID NO: 53026 - protein, 104 aa, Zea mays
  misc_feature: Ceres CLONE 1471692-F
MTYPRDWLQMDLSVIGFRLMGWMGPCNVLRVLRNMLTGLFFSQIGQQLAHLPTPPSRHLPRLAVPSDGAPRPGTSRSTSPRSGIQGQVQKQLLPPNGSKDNCTS

SEQ ID NO: 53027 - DNA, 759 bp, Zea mays
  misc_feature: Ceres CLONE 1471693-F
  misc_feature (211)..(211): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (225)..(225): n is a, c, t, g, unknown, or other
  misc_feature (226)..(226): n is a, c, t, g, unknown, or other
  misc_feature (542)..(542): n is a, c, t, g, unknown, or other
  misc_feature (546)..(546): n is a, c, t, g, unknown, or other
  misc_feature (547)..(547): n is a, c, t, g, unknown, or other
  misc_feature (550)..(550): n is a, c, t, g, unknown, or other
  misc_feature (551)..(551): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (578)..(578): n is a, c, t, g, unknown, or other
  misc_feature (583)..(583): n is a, c, t, g, unknown, or other
  misc_feature (588)..(588): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (606)..(606): n is a, c, t, g, unknown, or other
  misc_feature (643)..(643): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (652)..(652): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (692)..(692): n is a, c, t, g, unknown, or other
  misc_feature (693)..(693): n is a, c, t, g, unknown, or other
  misc_feature (697)..(697): n is a, c, t, g, unknown, or other
  misc_feature (726)..(726): n is a, c, t, g, unknown, or other
ctggagctccccgcggtggcggccgctctagaactagtggatcccccgggctgcaggaattcgtctcacccctagaaaaagtcttctctccgcctcgcgcacccggttccgcgtgcctttccccacctactctcgcggctctcgccagccagtctagggtttcggtcccggcgtgcttatccgcccccgccggccatgtcgaagcaagganaannnggggggggnnaaaaaaaaaggggggggggcccccccaaaaaaaaggccccccccccggcccccttttgggaaaaaaaaggggggggggggccccccccccccaaaaaaaggggggggcccccccgggccaaccccaccaaaggggaaaaaaagggggggggggagaatttttttttttaccccccggcaaaaaaaaacacccaaaaaaaaaaaacacccccccccccgcgcgggtgaaaaaaaaataaacctttttttgtttgtgtggggggagaaaaaaaaaataaaaaataaaaaccgggggggggggggggtggggggggggnagannggnnggnnnnaaaaagagaaaaaaagaaagnagaanagagnaaaaannnnaaaaaaaanctttttttttttttttgtttggttggtgggggggggncnnncgggngtaaaaaaaaaaaaaaaaaaaaaaaaaaaannnnnnnncnncccnccccccccccccctccctccttttttttntatttttttaaggaaaagagagggagaaagggg

SEQ ID NO: 53028 - DNA, 637 bp, Zea mays
  misc_feature: Ceres CLONE 1471718-F
  misc_feature: Encodes the peptide sequence at SEQ ID NO. 53029
  misc_feature (431)..(431): n is a, c, t, g, unknown, or other
aaactggagctccccgcggtggcggccgctctagaactagtggatcccccgggctgcaggaattcgtctcacccctagaaaaaacccgtggccgcttcctcccgttagactaggttaggctaggctatggtgtcgaccagctcgcggtaatggtggccttcaagttgcatcaataccaggtggtggggcgcgcgctgctcgagcccatgcgacgagcaccccaagatctaccgcatgaagctctgggccaccaacgaagtccgcgccaacaacaagttctggtacttcctgaagaacttgaataaggttaagatcagcaacggtcgagtcctagacgtcaacgagatcttcgagcgtaacccgacgacgatcaataactatggcatctggctgcactaccatagcctagcaggctaccacaacatgtacgntgagtacagtgacacaaccctgaacggcactgtagatcagatgtacatcgagatggcttctcagccacagcgtgaagtcttcctgcatgccgatcatcatgaccgccgcagtactcttcaagctgtgcaagaaggaaaaacaccaaggcgtgttccccaccttgggaataaattccccccccctgaaccccaaaggtgtaaggccc

SEQ ID NO: 53029 - protein, 134 aa, Zea mays
  misc_feature: Ceres CLONE 1471718-F
  misc_feature (1)..(133): Pfam Name: Ribosomal_L18ae Pfam Description: Ribosomal L18ae protein family
  misc_feature (66)..(66): Xaa is any aa, unknown, or other
MKLWATNEVRANNKFWYFLKNLNKVKISNGRVLDVNEIFERNPTTINNYGIWLHYHSLAGYHNMYXEYSDTTLNGTVDQMYIEMASQPQREVFLHADHHDRRSTLQAVQEGKTPRRVPHLGNKFPPPEPQRCKA

SEQ ID NO: 53030 - DNA, 671 bp, Zea mays
  misc_feature: Ceres CLONE 1471723-F
  misc_feature: Encodes the peptide sequence at SEQ ID NO. 53031
aagctggagctccccgcggtggcggccgctctagaactagtggatcccccgggctgcaggaattcgtctcacccctagaaaaaaaatttcccaaacgcaaaaccgcatcctctcatcagcttccttccacattcgtctcgagatctcgccccgtcgccatggacgcgatcgacagcgtggtggatcccctccgcgacttcgccaaggacagcgtccgcctcgtcaagcgctgccataagtccgaccgcaaggagttcaccaaggtggcggcgcggacggcgatcgggttcgtcgtcatgggcttcgtcggcttcttcgttaagctcatcttcatccccatcaacaacatcatcgtcggttccggctaggcttacaggagtacagggcgactagcatgggagtagtgcaatacttttgggagcaatagataacgaggatcctggtctttcgaattgtattgttaatgaaatttttcgttcggttgtgtttctaatgtaatcgttgtactgagtagagcttctggataccggattctgagtagaccttgaatccttgatggatcagccaatctcggaaaggaagtttcgtattttgttgttccgttgagctgtttgctgtctgtagctctaaaaaaaaaaaaaaaacgagacgctcgatgtaccaagtacgcc

SEQ ID NO: 53031 - protein, 69 aa, Zea mays
  misc_feature: Ceres CLONE 1471723-F
  misc_feature (10)..(66): Pfam Name: SecE Pfam Description: SecE/Sec61-gamma subunits of protein translocation complex
MDAIDSVVDPLRDFAKDSVRLVKRCHKSDRKEFTKVAARTAIGFVVMGFVGFFVKLIFIPINNIIVGSG

SEQ ID NO: 53032 - DNA, 663 bp, Zea mays
  misc_feature: Ceres CLONE 1471726-F
  misc_feature: Encodes the peptide sequence at SEQ ID NO. 53033
gaatagctggagctccccgcggtggcggccgctctagaactagtggatcccccgggctgcaggaattcgtctcacccctagaaaaaacacctcccaaaccctacactcccggcggcggcggcggcggcgcagcagcggcagcagcatccgaagatggtgaagttcctcaagcccggcaaggccgttatcctcctccagggccgcttcgccggcaggaaggcagttatcgtgcgcgtgttcgaggagggcacccgcgaccgcccctatggccactgcctcgtcgcaggcctcgccaagtacccaaagaaggtgatccgcaaggactccgccaagaagactgcgaagaagtcgcgcgtcaagtgcttcatcaagctcgtcaacttcactcacctcatgcccacccgctacaccctcgacgtcgatttcaaggatgtcgccaccggtgggcccgacgcactctctacccacgacaagaaggtcgccgcctgcaagacggccaaagcgcgccttgaggagaggttcaagaccggcaagaacaggtggttctttaccaagctccgcttctagatgctcggcctcccgaatagtcctgcttaagctgtcgatttgttgtatcggacacactccatctctgttttcgtattaccatggatatttcggcgt

SEQ ID NO: 53033 - protein, 137 aa, Zea mays
  misc_feature: Ceres CLONE 1471726-F
  misc_feature (52)..(137): Pfam Name: Ribosomal_L27e Pfam Description: Ribosomal L27e protein family
  misc_feature (7)..(40): Pfam Name: KOW Pfam Description: KOW motif
MVKFLKPGKAVILLQGRFAGRKAVIVRVFEEGTRDRPYGHCLVAGLAKYPKKVIRKDSAKKTAKKSRVKCFIKLVNFTHLMPTRYTLDVDFKDVATGGPDALSTHDKKVAACKTAKARLEERFKTGKNRWFFTKLRF

SEQ ID NO: 53034 - DNA, 742 bp, Zea mays
  misc_feature: Ceres CLONE 1471730-F
  misc_feature: Translation starting site: 187
  misc_feature (408)..(408): n is a, c, t, g, unknown, or other
  misc_feature (592)..(592): n is a, c, t, g, unknown, or other
  misc_feature (595)..(595): n is a, c, t, g, unknown, or other
acagctggagctccccgcggtggcggccgctctagaactagtggatcccccgggctgcaggaattcgtctcacccctagaaaaaacaaaatctcatttgagcgtgcaagctccttcgcctcgaaccctctcgcgcttggcttgctttcactctccagggccccactcccacctcgccgccgcagccatggcgatcacagcgccaactcccgacatcctcggcgagcgccagtccggccaggacgtccgcacgcagaacgtgatggcttgcggggcggtggccaacatcgtcaaatcctcgctcggccccgttggtctcgacaagatgctagtggacgatattggtgatgttacaatcactaatgatggagcaaccatacggagatgttggaagttgagcatccacccnccaagccccccgttgagttggctgagctccaagatcgtgagggaggagagggaactacttccgttgtcatcatagcgggcagagttactcaagagaggcaatgatcttgtgaaaaataaaatccatccaccctctataatcaggggctaccggcttggctatgccctgaaacctgcaaattttnttnaggaaaaagttagccagtcaaaggctgaacaaacttgaaaaaaaaaacccttaatcacctcctgccaaaaaaataaccaggtccttcctaaaattaatttaaaaagcgcgccgccattttcccttggcaacctttggtcggggaaag

SEQ ID NO: 53035 - DNA, 669 bp, Zea mays
  misc_feature: Ceres CLONE 1471733-F
  misc_feature: Encodes the peptide sequence at SEQ ID NO. 53036
atagctggagctccccgcggtggcggccgctctatactagtggatcccccgggctgcaggaattcgtctcacccctagaaaaactcttgtttccgctaaccgctgtccctggcttccctcgttgcggcggagagacgggaataggttactggctgcgatccaactatgagaagcgattatcagacgtttcgccgggtgactgcggaacccttctacgacaagaaggaggccgcctagctcgccgcgcaggccgccgccctatctgctgccccgctccgggtccgcgggacctctccatcccctgatgccagctgctcccgcgcaactagctcggcctcgtgtatggatgtggagatgactgatgcatggaacaactcgtctgagaccttcttgacgccacttggcaccattacctccaagaaggagcccttcatttgaagatccatacagacggatatatgagtgggatagatggcatagttgtcttttgagaactacaagagtgtatgattgatcatgcattcttctatcccagatggtacttcacacgcactgctgtcatgtcatgtggtgcacctatctacatccattcgtgggtgacatactatcaaatatgttgaaatggatacgactgaatgatagtgctgacctctcagctgattctgttct

SEQ ID NO: 53036 - protein, 31 aa, Zea mays
  misc_feature: Ceres CLONE 1471733-F
MDVEMTDAWNNSSETFLTPLGTITSKKEPFI

SEQ ID NO: 53037 - DNA, 682 bp, Zea mays
  misc_feature: Ceres CLONE 1471739-F
  misc_feature: Encodes the peptide sequence at SEQ ID NO. 53038
ccccgcggtggcggccgctctagaactagtggatcccccgggctgcaggaattcgtctcacccctagaaaaaaagagcagccacttggatccggtgctcagcggaacagctagctatagcctgtagctagaagctagtttcagtcacaggccggacggtcggctcacacacagctagccgccgccgctgctagcttagccaccagtagtccgatctgatctacaggcagggggccagcaggggcagctagctagctagccgcgcgccggcgccatgatgaacctgaacctgaagcagcctctggtgctgcccgcgcaccacagcaatgtcgtcagctcgcgcctgtcgtcgtcgtcgccctcggcagccgccgccagcaggaggaccggcggcggccccccccccccgtccggctcccggcggcccgtgcggctgccgaggatcagctgctgcgccaccgaggaggtcagcggcgccgtgtcttccgtcaccgaggagaggaagcttaccgtgacggcttcggtggaaagcgtccccggccatccggtagatatacttccacggcggccgtcaaaaacttctgcgaactattccgaaaaaaacctgctgtatggaagctcgacagctcccgagctcaaacccaaagttcgggctttggaaaaacacccggggtgaccggcct

SEQ ID NO: 53038 - protein, 133 aa, Zea mays
  misc_feature: Ceres CLONE 1471739-F
  misc_feature: SWISSPROT Homolog: EC 1.13.11.12 Lipoxygenase
MMNLNLKQPLVLPAHHSNVVSSRLSSSSPSAAAASRRTGGGPPPPSGSRRPVRLPRISCCATEEVSGAVSSVTEERKLTVTASVESVPGHPVDILPRRPSKTSANYSEKNLLYGSSTAPELKPKVRALEKHPG

SEQ ID NO: 53039 - DNA, 685 bp, Zea mays
  misc_feature: Ceres CLONE 1471746-F
  misc_feature: Encodes the peptide sequence at SEQ ID NO. 53040
  misc_feature (637)..(637): n is a, c, t, g, unknown, or other
aagctggagctccccgcggtggcggccgctctagaactagtggatcccccgggctgcaggaattcgtctcacccctagaaaaaatctcccttcggttccccaattcgaaatcgaatcgggtcggtcttgccgtgcgtgcgtggctgcgcgagcgactcgactgcaccccccgctcctcccagtccccacacactgcgcgccgccgccgggtcctcctagggtttcgccgcgatgtcgctccggccgagcgagcgggagcagatgcggaagggcaactacaagcagacggtggacgcggaggagagccgccgccgccgcgagggccagatggtggacatccgcaaggccaagcgcgaggaaagcctccagaagaagcgccgcgatgggtttcccgcctccgccgctggtgtgccgccgatggcccactccaccgcgctccagcagaagctcgatggcttgccggcgatggtgcaagccgtccactccaacgacccctccgtgcagcttgaggccaccacacagttcaggaagctgctttctatagaacgtagtccctcaatcgaagaggtgatcagcacaggagtggtgccgcgattcattgagtttcttacacgtgaggaccatccccaactccagnttgaggctgcatgggcactcaccaacattgcatcaggcacatcagaga

SEQ ID NO: 53040 - protein, 151 aa, Zea mays
  misc_feature: Ceres CLONE 1471746-F
  misc_feature (4)..(97): Pfam Name: IBB Pfam Description: Importin beta binding domain
  misc_feature (106)..(147): Pfam Name: Arm Pfam Description: Armadillo/beta-catenin-like repeat
  misc_feature (136)..(136): Xaa is any aa, unknown, or other
MSLRPSEREQMRKGNYKQTVDAEESRRRREGQMVDIRKAKREESLQKKRRDGFPASAAGVPPMAHSTALQQKLDGLPAMVQAVHSNDPSVQLEATTQFRKLLSIERSPSIEEVISTGVVPRFIEFLTREDHPQLQXEAAWALTNIASGTSE

SEQ ID NO: 53041 - DNA, 711 bp, Zea mays
  misc_feature: Ceres CLONE 1471747-F
  misc_feature: Encodes the peptide sequence at SEQ ID NO. 53042
  misc_feature (400)..(400): n is a, c, t, g, unknown, or other
  misc_feature (427)..(427): n is a, c, t, g, unknown, or other
  misc_feature (432)..(432): n is a, c, t, g, unknown, or other
  misc_feature (433)..(433): n is a, c, t, g, unknown, or other
  misc_feature (461)..(461): n is a, c, t, g, unknown, or other
  misc_feature (464)..(464): n is a, c, t, g, unknown, or other
atagctggagctccccgcggtggcggccgctctagaactagtggatcccccgggctgcaggaattcgtctcacccctagaaaaagtgctctctcagaggtgggctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagaacgggaagtctcgcggcttcggcttcgttaccttctccctcgagaaactcatgctcgacgctatcgagaacatgaacgggcaggagctcgacggnccgtacatcacccgtaacccagcccantcccnntggcgtgagcgtggggcgcgttgctacngcngcggtccccgccggcggcgcttttggtggcgggcccgtgaccgcggtttatgggggggggtgggggctaagcggtctcgcccaaggggtgggggccgccctaaccaaaggggggggggtttccggggtcccccccaaggggtggggggggcggtttccgggggggggggggggggtggggaggaacataatttgggccccctccctgggccttcccccaattttttttttttctctaaagagggggg

SEQ ID NO: 53042 - protein, 179 aa, Zea mays
  misc_feature: Ceres CLONE 1471747-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (85)..(85): Xaa is any aa, unknown, or other
  misc_feature (87)..(87): Xaa is any aa, unknown, or other
  misc_feature (97)..(97): Xaa is any aa, unknown, or other
  misc_feature (98)..(98): Xaa is any aa, unknown, or other
MAAADVEYRCFVGGLAWATSNESLENAFASYGEILDSKVITDRENGKSRGFGFVTFSLEKLMLDAIENMNGQELDGPYITRNPAXSXWRERGARCYXXGPRRRRFWWRARDRGLWGGVGAKRSRPRGGGRPNQRGGGFRGPPQGVGGAVSGGGGGGGEEHNLGPLPGPSPNFFFFSKEG

SEQ ID NO: 53043 - DNA, 655 bp, Zea mays
  misc_feature: Ceres CLONE 1471749-F
aaactggagctccccgcggtggcggccgctctagaactagtggatcccccgggctgcaggaattcgtctcacccctagaaaaattcctcccttcttacagccgccgccgccgcatcccagcctccatcaccgtttccgtctcgttgccatgggtaaggtgcacggatcgttggcgcgcgccgggaacgtccgcggacagaccccctaggtggcgaagcaggacaagaataataagccccgcggccgcgcgcacaagaggatgcagtacaaccgccgcttcgtcaccgccgtcgtcggcttcagcaagaagcgcgggaccaactcctcctagaagtaggcgccgctcggctcgtaccggttcctcatccttcctgctctccgtatgcttatgctcttgatggtactagtttcgttgttcgcaagcagaggaagaaccttctgtagattcggttttgttgtccatgtgctcagatggcaacttgagattgtatgaatttgagatctggtgacatgagctgatgatttttattatgcttattgctgctcctctgagctgttatttttgaacgctatccaaataaatttgaaaccagattgctgatgcgtaaactaaacaaatagatcgagacgctcgaggtacccgaatctgcctatt

SEQ ID NO: 53044 - DNA, 695 bp, Zea mays
  misc_feature: Ceres CLONE 1471750-F
tccccgcggtggcggccgctctagaactagtggatcccccgggctgcaggaattcgtctcacccctagaaaaaccgttctcttctccctaatcctggtaatcagtagtagccactagcgctgctgccgttctcttcccctacccgacacaagctccaccacctctatctaccacacgccaccactgtaggagctcctccacgatcattcccgccctagagccataataattcgttgaagaggagggggttcttagaaccagagggcggctacctgtgaaggatacccgtgctgctggctgctgctgttcctcagctacagccgtgtgtgggctgtgcagattggagagcgcagattccagtttaaggatagctcccaagggggaggaactcctgctgttacaagcaaaaccccaccaaggggctctggtctccctgaggaagatgagaacctcatgacccacataaccaaccccggggcatggctgctggaacactgtcccccaagcctgcagggcttttagaaggggttggaaaaacctgcagggcttgagttggaataatttacctgaaggcctggacctttaaaagaggccctttctctcgagggaggaggaaaaacctcgtccttcaaaccttccatgctcgactgggggaaaaaggtgggttctcaaacttccaaccggggtgggccggg

SEQ ID NO: 53045 - DNA, 705 bp, Zea mays
  misc_feature: Ceres CLONE 1471755-F
  misc_feature: Translation starting site: 408
aaagctggagctccccgcggtggcggccgctctagaactagtggatcccccgggctgcaggaattcgtctcacccctagaaaaagacaagcacgacgtcttttcggcggacttcaccgcatacaccgctgcccgcgcgcagccgcgcaggtgcatatgcgccgccaccggtcgcgccgcacccgcacgtctccatatacccatccggccatctacacacggcagtccacgctcgtggcaccgcactcactccgaatcctgaagcaacaaacaccagaagcgcaccaactccccaaccaccggagaccgcaccccagcaaaggatggcatctgactccacggccgccgtgacggtgggactgcagctcgcttgcagggcgcgcgctggccgcggcaggcacacggcacatgttcccccccccaggcatccccgtcacctcactcgcgtaccgtgccgccgcggccggggtcggcttcctcgctttccgcaacgagcaatccgcgcggatacgccgccgccgcctacggattcctcgcgggctccccgggcgccctactcaccgtctcaggaccatgatgcgtacacgggctcgggggcctctcccacgcaacgccaacagcctggccgctcctcatgaactccgggatcctgcaatcaggctgaccccagatggggccaccttccagagctcgacccagatcgccg

SEQ ID NO: 53046 - DNA, 617 bp, Zea mays
  misc_feature: Ceres CLONE 1471756-F
  misc_feature: Encodes the peptide sequence at SEQ ID NO. 53047
tggagctccccgcggtggcggccgctctagaactagtggatcccccgggctgcaggaattcgtctcacccctagaaaaataagcccttcgagaagctgtccaccatcagtactggaattaatatgttggaagaggatggagaagttgatgcatatgtatcccctcataaggagatagacccacacaatgcagcacccaagcgaaagaaagccaggttcatgataccaaagagtgctcaggtggacagtgaggtgcgccgcgagctgcaggagctcatggacgctagggaggcaggcatgtccttcatcctggggcactcgtacatgaaggcgaagagcgggtcgagtttcataaagcggattgtgataaacttcttgtacgagttcttgaggaagaacagccgtggccctgcatacgccgcaaacataccccatgcctccactctggaggtaggaatggtctaccaggtctgacacagttagcagctgtgtaaaggtagagagatgagacgacgcctgtcagccccacctgtatatacacttgttgctgccgataccggttaacaatcacagaatgacacaagtagggagtgacccttgagcacagccaatggtgaa

SEQ ID NO: 53047 - protein, 116 aa, Zea mays
  misc_feature: Ceres CLONE 1471756-F
MLEEDGEVDAYVSPHKEIDPHNAAPKRKKARFMIPKSAQVDSEVRRELQELMDAREAGMSFILGHSYMKAKSGSSFIKRIVINFLYEFLRKNSRGPAYAANIPHASTLEVGMVYQV

SEQ ID NO: 53048 - DNA, 723 bp, Zea mays
  misc_feature: Ceres CLONE 1471759-F
aaagctggagctccccgcggtggcggccgctctagaatagtggatcccccgggctgcaggaattcgtctcacccctagaaaaacccgccccaccaaacactcccgcagacccacccgtccccgtccgtccacagccagctccgcctcccatccagcgcccgtccacagccaccacagttccagtgagatcgagcgaggtaagcttagatctgagcgatttctctcgcgcgtcgcaagtaaagttcactcgacttcgactctctcatcctcttctggtcttcctgggtccggcctcttcctcaaccagacaccgagagacccgggggccttttagataccggggtttagatctggtgtttctttttctggttgggtttaaatcccagcaagggaacaaaaaaaaagcggttatcccccccaggcgagggggggggtgttcccccccccccccctcttggcaaggggagttttggcctgaagggaatttccccacccgggcgcctctggttttttaattgggggggtggggggccccccccggtttccccggtggtatctcccgtgcccgccgcggggggtgaaaacccttaaacccccaaaaacccgctttttaagggggggggccttcaaaaaacttccccggggggggggcgttttataaaaccctcccggggccttttttttccgggggaatttttttccttttgaagaaaaaaaaccccg

SEQ ID NO: 53049 - DNA, 704 bp, Zea mays
  misc_feature: Ceres CLONE 1471760-F
  misc_feature: Translation starting site: 293
  misc_feature: Pfam Name: Cation_ATPase_N Pfam Description: Cation transporter/ATPase, N-terminus
  misc_feature: SWISSPROT Homolog: EC 3.6.3.6 Proton-exporting ATPase
  misc_feature (381)..(381): n is a, c, t, g, unknown, or other
aaagctggagctccccgcggtggcggccgctctagaactagtggatcccccgggctgcaggagttcgtctcacccctagaaaaagccccatctcctcccgttccactcgacgcccaccaccactctctagtctcaccgccccccgtcccgctcattggacgagacgacggacccttcctttctcgcacgggaagagtagcgaggaggcgcggcgcccgtgcggcgtatgcccgtgcctgccgtcgggctccgcctctaggactagggcccgctccagcgccagccgtccgccatgggtgggctcgaggagatcaagaacgaagtcgtcgatctggagaacatccccatcgaggaggtgttcaagcagttgaaatgcacccnccaggggctgagctccagcgagggtcaccaccccccccacatctttggccccaacggctccaggagaaaaagagagcaaggcctcaagtccttgggttcatgtggaacccgctgcctgggtcatgaaaagggttcccatctgggctattggatcccccacgggtggggccacgcccccgactgggagggacttccccgggcctatcggggttttgggtaaaaaatccccccttttcccttttttggaggaaaactattgccgggaaaccccccgcccccccctttttgggccaatcttggcctccccaaaacccaggggtgtt

SEQ ID NO: 53050 - DNA, 680 bp, Zea mays
  misc_feature: Ceres CLONE 1471761-F
  misc_feature: Encodes the peptide sequence at SEQ ID NO. 53051
  misc_feature (598)..(598): n is a, c, t, g, unknown, or other
aagctggagctccccgcggtggcggccgctctagaactagtggatcccccgggctgcaggaattcgtctcacccctagaaaaaaccctcagcacggcgccgctacagcccgcacctcgtttcctctcccgtctccgatatgacgaatcgaaccacgaaggccggatttgttggcaaatatggaaccaggtatggtgtttgcttgcgtaagcaaatcatgaagatggaggtgtctcagcactccaagtatttctgtgagttctgtgggaagtttgctgtgaagagtaaagcggttgggattgggggatgcatagactgtgggaaggtcaatgcctgtgactgcttacaccatgaacactgctagtgcgtccactgccacgagcacgatccgtcgcttgacggagcagactgaagcatgatcggtcgcttgtcatgcatactgcgagtccactatattggctgtgctcacgatacagtactcctcatgttttgagctatgctctacgatctctaaaggatgaggctaagagttctactttgttccagaagtgatttcggaagtgatatctgactctatcacaatcatgatgacgtccgtnccaaattttgccaatagtcgtccttgagcttaagccctaaaaaaaaaaaaaaaacaagacgctcgaagtacccattccgcca

SEQ ID NO: 53051 - protein, 74 aa, Zea mays
  misc_feature: Ceres CLONE 1471761-F
  misc_feature (2)..(72): Pfam Name: Ribosomal_L37ae Pfam Description: Ribosomal L37ae protein family
MTNRTTKAGFVGKYGTRYGVCLRKQIMKMEVSQHSKYFCEFCGKFAVKSKAVGIGGCIDCGKVNACDCLHHEHC

SEQ ID NO: 53052 - DNA, 760 bp, Zea mays
  misc_feature: Ceres CLONE 1471768-F
aagctggagctccccgcggtggcggccgctctagaactagtggatcccccgggctgcaggaattcgtctcacccctagaaaaagccggaccaccttaacctccccaccacaagcccgcacacaccatcccgctccgctcaagtcgcctccgcattcctgccccctctacccgcccgccgccgcgcggacgacgggagacgccggcaccatgctctgcctctcgctgtgcgcaccgcaccttcacctccacctcccccgcagcccgaccgcacgacccgccgccgccacgtgcaggaacgcgcgctgcatcggcgtcacgctatgcctccggatgccgacgacaccggaggaacggcggtagaagcggggggtgccccatttcctggacttatcggccgggctgaaaattgggcccccccccgcccaagctcggggattctaacgttccggcggcaaaactggcgccgggtttctcccgggaaaaatgccccttgtttttggcgggtgtgccccggtttccggggaactgcggttgcccggggatcccccccgtcttctcccgggggttggggaacttcacttttccctcttcacagtggggggcgggggggtctcaagcccccgccgcgggtttgggcacttccttctacaaacgttttggggaccccctccccctctgtgcgtttaaacgcgtctcatctcgcggggtcctccccccgaaatgcgttttttactccggggtgcgcgcgccacgcccctg

SEQ ID NO: 53053 - DNA, 716 bp, Zea mays
  misc_feature: Ceres CLONE 1471769-F
aaagctggagctccccgcggtggcggccgctctattactagtggatcccccgggctgcaggaattcgtctcacccctagaaaaaaccgcacacatcatcggcatcactaaaaaccaccttcttgcggcacacgggctcgaccacttgactctctcaccatgcctgtttgtgttctcaggtaaagatgagtgcagatatgccggcgccatcatatgcgtcgacagcagcatgagcacgacattggcgtcatcaactcagccgcaacgcgccgctctttatagcggcggattcctcggcaggttcatgacttctcgcctgattggtgtgagtttgtcaacaccgctgcgtggttcaggtaccattgctgtcgggaaggctaggtccaccatgccttttgatacgacgtcgcggtttcctccccaccacctccttgaatcaacgatttcttctgccaaccgaaaaaagttgtcccccaacatggacagcccacctgccggaaaagaagcccttccagtactaagcgccccttaatcgtaaaaatccccaggttttacccccatttttattttaaaaaatttggccaatattgcttgaaggcccctccccccccccccgttttttgactatatggacccttaaaaagggttcccggttataagtttttcatggcccgcaaaaacactcaaggtgtggtatcccgcaaaccccgctccgcc

SEQ ID NO: 53054 - DNA, 742 bp, Zea mays
  misc_feature: Ceres CLONE 1471770-F
  misc_feature: Encodes the peptide sequence at SEQ ID NO. 53055
  misc_feature (378)..(378): n is a, c, t, g, unknown, or other
  misc_feature (742)..(742): n is a, c, t, g, unknown, or other
agagctggagctccccgcggtggcggccgctctagaactagtggatcccccgggctgcaggaattcgtctcacccctagaaaaaaaacgttgtgttaccaaagttatcgttgtcttctctagcgacggcgaggcttgagcgctcacgtccaggcgttcccgtgccggtggccaagccagcagccgacgagatggactacctcaggacggtggttccgtcacaactcttggcagagcgcggctccaatcttgtcgtcatcaacccaggatcgggaaatgtgcgaatggggtttgctagtcaggatgtgccattcaatataccacattgcattgcccgacacatcaatccacaagagggcgaagaacaaagatcctctgncccccatcagatgctcaactggcatgctatttcaccccccccatgcagagcgggagagtgcatatgaaattaattgcaccccctgatgaaaaccccttttttggaccaagaaaaaatgctttcacgaaaccaaccccttccccccaaaaaaggggacgcgtttaaaggctttttttttcccggcaacccgaaagccaataataaatttcctttggacccaaattggtccaaaaaaaaattttttaacccgccccccccccctctcccgaaaggggcctgttataccaagggattgtctgaagaaaaaaattcttccccccagacccccctttgctgttgtctgaatcggcgccccgccgccttn

SEQ ID NO: 53055 - protein, 84 aa, Zea mays
  misc_feature: Ceres CLONE 1471770-F
  misc_feature (63)..(63): Xaa is any aa, unknown, or other
MDYLRTVVPSQLLAERGSNLVVINPGSGNVRMGFASQDVPFNIPHCIARHINPQEGEEQRSSXPHQMLNWHAISPPPCRAGECI

SEQ ID NO: 53056 - DNA, 731 bp, Zea mays
  misc_feature: Ceres CLONE 1471771-F
  misc_feature (371)..(371): n is a, c, t, g, unknown, or other
ccaagctggagctccccgcggtggcggccgctctagaactagtggatcccccgggctgcaggaattcgtctcacccctagaaaaaacccaaaactccgctctcatcccaccccccctccactccactaccacggcggcacggcctgcctctgcagctctgccctgctccgcacccctcgctctccaaccccaacgcgcggcgttgctaaaattcaccgcagcgcttactccagtttggccacctcaccacccgccgccgctgtttaagaaggccccgcgcccgatcggggatcacgaaccttggccgccgctgccggagtgggggcgtagattcccggcggtccatgggggcgccgtgatggtcgccatcncgccctctatcggcaacttgttgcaggcgtggaaccacgcccccccatcctgaagccgttctgacataaaaaaagaattcaaccttcaaacgaagccctctaacgaaggccccatccgcccccaggcccctaatgggggcaaacgtcctacacaattttctcgggggaaccggcccaattcgtttgggaaggaggcccagggggggcccccccggggggtcccctactttttaaaaaggggcggggggaagttttttggggcccccaaaggtggaacacctttttctccccccaagggattttttattaggggcttccaaaaccgttttgcggtggacccacacttttccccccccccag

SEQ ID NO: 53057 - DNA, 743 bp, Zea mays
  misc_feature: Ceres CLONE 1471775-F
  misc_feature: Encodes the peptide sequence at SEQ ID NO. 53058
tccccgcggtggcggccgctctagaactagtggatcccccgggctgcaggaattcgtctcacccctagaaaaaaacccatcgtctcacggacgccgaacccagaagccgccgacccctttcccgccgcacggatccaaaaccctagcccctcctcggcgtttttcccctcccggcgacggcgaggcggcggagatgatgcggcagcagcagcagcagcttccacctccgccgcagcacccaccgccccaagcctcctccgccgcccgtggcggcggcggtggcgagttctaccgcggcccgccgatgcggcagctgtccgcggggtcctccaccaatcttctgccggaatacgcgggaaacccggcctcccctgtcaaagcatcacgcatcgacctgggtccccccccctatgggtaaaaattttggtggcaaaaaggaagcggaaggcttgtcccggggacaaaaaggggggaattccccaaggaggggtttggcccgttatttttccgggtctcaattgggggcagcggggcgccttggggaattaatttccagtttgccccccccccccccccaattgggccccgggaatatgttcccctttgggggggatatgcaaaacaaacccccccccacattttttttgcccacaatttttttttttgcctcaaaaaaaaaaaaaaccggggggccaataaaacggggtgtgtggggggccccccaaagggcgccataaattatg

SEQ ID NO: 53058 - protein, 74 aa, Zea mays
  misc_feature: Ceres CLONE 1471775-F
MMRQQQQQLPPPPQHPPPQASSAARGGGGGEFYRGPPMRQLSAGSSTNLLPEYAGNPASPVKASRIDLGPPPYG

SEQ ID NO: 53059 - DNA, 826 bp, Zea mays
  misc_feature: Ceres CLONE 1471777-R
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (38)..(38): n is a, c, t, g, unknown, or other
  misc_feature (390)..(390): n is a, c, t, g, unknown, or other
nnnnnaaaaaaannnnnnnnnccgaattgggtacctcnagcgtctcgtttttttttttttttttgccaatggacacacatggtttctatttctccagtatattatgatcagagcccgcatatggtacaactcagcaacatgagtgggattaaatgaacaccaccaacaacaataacggatcaaaactaagcaacacgttacgaatttcataagcctttgtgaagacgaacaccagtgtctcggcgacctcagtatgaaatgaatggatttgtaacacaattgtgatacataatgattcatctggggtagtttccccatgttggcagcaaccatccttcggtaaaatctgggggtagtttctctccaaggtgagcgccttatgtccatccnatacaaatgagataaaaaaaaacatgcttggccctggtgttttcaactcatttgtacaggctgaagtccaggcccccaatatacagaacagataccctcttgaagctcctccaatccaaggaactttccgaagaacaaccaaaagggggcaggtatttccaagaatgctcccggaaaggaaccaaggcctttttcccttgcggttattttgcaaagaaccaagggggaaaatttcccccccgaaaagggggccaccccccaattttaaaaatgggggttttaaacgggggcgggaaaacccccccgagggggaccgggccttttttccccccccaacaaagaaccccctgggaaaaaatttaccatttgggggttccccccaaaataaaacccccttttttttgggaaaacccctgggaaaaaaaattttttcctt

SEQ ID NO: 53060 - DNA, 713 bp, Zea mays
  misc_feature: Ceres CLONE 1471777-F
  misc_feature (416)..(416): n is a, c, t, g, unknown, or other
aagctggagctccccgcggtggcggccgctctagaactagtggatcccccgggctgcaggaattcgtctcacccctagaaaaaaaaaaaaaaaaaaaccctctcgccagatccccctacctccgcgtctctccgccggtcaattcccttcgctggtactcagagatcggcgccctcctcccgtcttcccacgcttgcgggcactaactcagagtagtgtcgctcaatgaatttcctctaccggactacgcagcctgcagcgactgagctgccaagaatttcagagcaagatcacaagaatgccttacaaaagacgacttcgacactggagggtctcattgcggacgattcacaccaccagccctcctctgcccacaccgaagatggagctgctaataatgggtccatggatatcantggggattcttcatctgttgatttgaaaagcccagtcccactgggggacacatgccgatgtcatggaagacgaaggatggatcacaattcccgtgcaaggcacttcctgaaagttggaacgacatatcagaaatggttcagttgcaggctctggaccgttccttccttttttccagggaggcaggtccctattactggcgtgcctggtcggcttctaagcaaagaagaacaggttagattccccctttaagaaattgcccgcagaaatggtcttaagaaatggaaacttcctattgc

SEQ ID NO: 53061 - DNA, 731 bp, Zea mays
  misc_feature: Ceres CLONE 1471782-F
  misc_feature: Encodes the peptide sequence at SEQ ID NO. 53062
aagctggagctccccgcggtggcggccgctctagaactagtggatcccccgggctgcaggaattcgtctcacccctagaaaaattctattcctccacaccgatcactcgctgctcccctctctcgccggagctccgggccggatggcggcggcagcagcagctcctcccgcctccgtgatcgcgtgatggacgcacacaccgccgcgctccgccgatggacgacgccggaaggccaccaccacacgctcccgtggcggtgaccgcctccgcctccgcctccgccaccgccgcgcccgcccctccccaaccctcagccactgctgccgtcgacaggtcctcccccgaccccgacgcgctctatgaaggttagggattacgcttctctctccgctcgcgcttcagctcgtgtcgcgcccccccgcgactggggggttcggtgctcaattccccgggaagtttaaagttcacccaggggctctgttttaccgtttttttcccttcttccggggaattcctggcttgcccctggaaaactcattttggaaaccaggggtgtaaaacccagatccctttggggtaaccgaacaagggtttgggggatttcccccttccccggaaaattggcccccatgggttttttttttccccggaacccggggtgtgggtatcacaccgggggggttgtttaatatataaaaaagggttttcccttttttgggggtctgagccg

SEQ ID NO: 53062 - protein, 51 aa, Zea mays
  misc_feature: Ceres CLONE 1471782-F
MDDAGRPPPHAPVAVTASASASATAAPAPPQPSATAAVDRSSPDPDALYEG

SEQ ID NO: 53063 - DNA, 677 bp, Zea mays
  misc_feature: Ceres CLONE 1472207-F
  misc_feature: Encodes the peptide sequence at SEQ ID NO. 53064
  misc_feature (268)..(268): n is a, c, t, g, unknown, or other
  misc_feature (271)..(271): n is a, c, t, g, unknown, or other
  misc_feature (299)..(299): n is a, c, t, g, unknown, or other
  misc_feature (401)..(401): n is a, c, t, g, unknown, or other
  misc_feature (405)..(405): n is a, c, t, g, unknown, or other
  misc_feature (407)..(407): n is a, c, t, g, unknown, or other
agagctggagctccccgcggtggcggccgctctagaactagtggatcccccgggctgcaggaattcgtctcacccctagaaaagcaacaccaacgcaaccacgttacgcaatatatagagaacatacccgtgagaagctaagacccggccgttgctcaccacagcatcatcgccgcgccgtgctagctcaaggatggagaacaacaggcagcagcagcagcaggcgccgccgccgccaggctacccgacggcggctgcaggctttgancangagcagggaggcaggaagggaccacccngggaaagacgacctcgcgcggggataaaggcttcatcgaaggatgcatcgcggcgctctgctgctgctggatctgcaaaatgtgctgcgactaggcacgcanctancnaatctagctctccgtcctcgggggccatacttacgaaatacggatgggagagcctgcaacagtttctgcttctggaagaaagatcctcttaaattattctaccggcaagagctgctccacacctgaatatgtttgttggggtgtttattattgggggggggggagggctccccccccttttattattggtaaaaaaaatccggggcgggacgtacctggcaagcataccttttgataccccgtattttttttttgttttaaaaaaaaaaa

SEQ ID NO: 53064 - protein, 101 aa, Zea mays
  misc_feature: Ceres CLONE 1472207-F
  misc_feature (25)..(25): Xaa is any aa, unknown, or other
  misc_feature (26)..(26): Xaa is any aa, unknown, or other
  misc_feature (36)..(36): Xaa is any aa, unknown, or other
  misc_feature (70)..(70): Xaa is any aa, unknown, or other
  misc_feature (71)..(71): Xaa is any aa, unknown, or other
  misc_feature (72)..(72): Xaa is any aa, unknown, or other
MENNRQQQQQAPPPPGYPTAAAGFXXEQGGRKGPPXERRPRAGIKASSKDASRRSAAAGSAKCAATRHAXXXSSSPSSGAILTKYGWESLQQFLLLEERSS

SEQ ID NO: 53065 - DNA, 667 bp, Zea mays
  misc_feature: Ceres CLONE 1472208-F
  misc_feature: Encodes the peptide sequence at SEQ ID NO. 53066
  misc_feature (255)..(255): n is a, c, t, g, unknown, or other
  misc_feature (395)..(395): n is a, c, t, g, unknown, or other
  misc_feature (401)..(401): n is a, c, t, g, unknown, or other
  misc_feature (406)..(406): n is a, c, t, g, unknown, or other
  misc_feature (429)..(429): n is a, c, t, g, unknown, or other
  misc_feature (437)..(437): n is a, c, t, g, unknown, or other
  misc_feature (438)..(438): n is a, c, t, g, unknown, or other
aagctggagctccccgcggtggcggccgctctagaactagtggatcccccgggctgcaggaattcgtctcacccctagaaaaaacggagaaaaagaaagaggagctcggacaaggcagcgccatcgttcggtttccttgctgaattcccgatcgctcgcccgctcgaaaagaaagaagctagcttttagcatggcgtctctggcgttcggcagcaccgtagcggcggcccgtgcggcgacctcggggaagacgcngccggcgcgccggtccgtgctggtcgtgccgcccgctgccagcaggggcggcccgccccccggccagggagagaagggcctcggcgagaccatcttcggcttcatctttcagaaagaccagctgggtggagacggacccnctcctncacanggtcggcgccgcgccggccgccncctcccgnngccagacgaccgcccggcagagggctgccgcggcaacaacagcggcagcgggggggggttcaccctcgggggcctcgggcgggctcttccccagaaaagcagctgaacggtggcgtggtttatggattggcaacctcaaagctggatttggcttttgagggggaaattgttccccctatttattttgtgacctggtggtgggtgtaaccagggatctttgatggcataa

SEQ ID NO: 53066 - protein, 117 aa, Zea mays
  misc_feature: Ceres CLONE 1472208-F
  misc_feature (22)..(22): Xaa is any aa, unknown, or other
  misc_feature (69)..(69): Xaa is any aa, unknown, or other
  misc_feature (71)..(71): Xaa is any aa, unknown, or other
  misc_feature (72)..(72): Xaa is any aa, unknown, or other
  misc_feature (80)..(80): Xaa is any aa, unknown, or other
  misc_feature (83)..(83): Xaa is any aa, unknown, or other
MASLAFGSTVAAARAATSGKTXPARRSVLVVPPAASRGGPPPGQGEKGLGETIFGFIFQKDQLGGDGPXPXXGRRRAGRXLPXPDDRPAEGCRGNNSGSGGGFTLGGLGRALPQKSS

SEQ ID NO: 53067 - DNA, 668 bp, Zea mays
  misc_feature: Ceres CLONE 1472211-F
  misc_feature: Encodes the peptide sequence at SEQ ID NO. 53068
  misc_feature (396)..(396): n is a, c, t, g, unknown, or other
  misc_feature (410)..(410): n is a, c, t, g, unknown, or other
  misc_feature (411)..(411): n is a, c, t, g, unknown, or other
  misc_feature (466)..(466): n is a, c, t, g, unknown, or other
  misc_feature (502)..(502): n is a, c, t, g, unknown, or other
  misc_feature (518)..(518): n is a, c, t, g, unknown, or other
  misc_feature (526)..(526): n is a, c, t, g, unknown, or other
  misc_feature (538)..(538): n is a, c, t, g, unknown, or other
  misc_feature (547)..(547): n is a, c, t, g, unknown, or other
  misc_feature (550)..(550): n is a, c, t, g, unknown, or other
  misc_feature (556)..(556): n is a, c, t, g, unknown, or other
  misc_feature (589)..(589): n is a, c, t, g, unknown, or other
aaagctggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggncaggagctggacgnngcgcacatcaccgtcaacgaggcccagtcccgcggcggccgtggaagcggcggcngtgggtacggtggtggccgtggaggcggcggctacngcggtggcgggcgccntgatggcngtggcggctacngcggtggcngcngctacngtggcggcggcggctacggtggtgggtggcgcngctacggcggtgggcaacggtggcggcggctaccgcaactccgacgggaaactgaggaactgagcggtgggggcccccc

SEQ ID NO: 53068 - protein, 161 aa, Zea mays
  misc_feature: Ceres CLONE 1472211-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (76)..(76): Xaa is any aa, unknown, or other
  misc_feature (95)..(95): Xaa is any aa, unknown, or other
  misc_feature (107)..(107): Xaa is any aa, unknown, or other
  misc_feature (112)..(112): Xaa is any aa, unknown, or other
  misc_feature (115)..(115): Xaa is any aa, unknown, or other
  misc_feature (119)..(119): Xaa is any aa, unknown, or other
  misc_feature (122)..(122): Xaa is any aa, unknown, or other
  misc_feature (123)..(123): Xaa is any aa, unknown, or other
  misc_feature (125)..(125): Xaa is any aa, unknown, or other
  misc_feature (136)..(136): Xaa is any aa, unknown, or other
MAASDVEYRCFVGGLAWATDDHSLHNAFSTYGEVLESKIILDRETQRSRGFGFVTFSTEEAMRNAIEGMNGQELDXAHITVNEAQSRGGRGSGGXGYGGGRGGGGYXGGGRXDGXGGYXGGXXYXGGGGYGGGWRXYGGGQRWRRLPQLRRETEELSGGGP

SEQ ID NO: 53069 - DNA, 656 bp, Zea mays
  misc_feature: Ceres CLONE 1472212-F
  misc_feature: Encodes the peptide sequence at SEQ ID NO. 53070
ctccccgcggtggcggccgctctagaactagtggatcccccgggctgcaggaattcgtctcacccctagaaaaaaccatggaagccctcgcctcggcgcctcgggcgctcttcccgcgcgcgtgcccagtcgcgacgccggccggcccggcccggcgccgcaccgccgctcctcacatctgcagggcctccgcggcggctggggaggagacgccgccgccgccggccgctcccaagaagatcctcaagaagaagcccgtctactcgatgaagaaagggcagattgtgcgcgtggacaaggagaagtacctgaacagcatcaattatctgtcagttggacacccgcccttctacaaggggctggactacatataccaagaccgcggcgaggtcttggatatcaggaacttcgaaacaggagaatacgccctgatcgcttgggtggggatcccgacgccaccggcatggctaccaacctacatgctcatcaagtcggacaagctcgactacaagaggatatgatggcccgcccgccggccggccgggcgccttgcagggcaccgtagcgccgccgccgaaatcatgcttcatttcgcatcaggagtcggcccatcaggacgcacctttgttgtgacttgttgtaggtatatacgtacc

SEQ ID NO: 53070 - protein, 147 aa, Zea mays
  misc_feature: Ceres CLONE 1472212-F
MEALASAPRALFPRACPVATPAGPARRRTAAPHICRASAAAGEETPPPPAAPKKILKKKPVYSMKKGQIVRVDKEKYLNSINYLSVGHPPFYKGLDYIYQDRGEVLDIRNFETGEYALIAWVGIPTPPAWLPTYMLIKSDKLDYKRI

SEQ ID NO: 53071 - DNA, 676 bp, Zea mays
  misc_feature: Ceres CLONE 1472216-F
  misc_feature: Encodes the peptide sequence at SEQ ID NO. 53072
  misc_feature (191)..(191): n is a, c, t, g, unknown, or other
  misc_feature (199)..(199): n is a, c, t, g, unknown, or other
  misc_feature (273)..(273): n is a, c, t, g, unknown, or other
  misc_feature (322)..(322): n is a, c, t, g, unknown, or other
  misc_feature (331)..(331): n is a, c, t, g, unknown, or other
  misc_feature (337)..(337): n is a, c, t, g, unknown, or other
  misc_feature (342)..(342): n is a, c, t, g, unknown, or other
  misc_feature (477)..(477): n is a, c, t, g, unknown, or other
  misc_feature (488)..(488): n is a, c, t, g, unknown, or other
aagctggagctccccgcggtggcggccgctctagactagtggatcccccgggctgcaggaattcgtctcacccctagaaaaatcctactgtcacacacacacagagagagacaagtggtttccaaagccaagtgtgtactagcagtctagcaaccagctagctcgggcggcagcaggcagccatcatgtcngaagaaangcaccaccacttcttcaccaccacaagaaggacgaagagcagcccgccggcgagtacgggtactccgagaccgnatgtgtcaccgcccaccgcgagggcgagtacgagaggtacaagaaagangagaaggancacaancacangcagcacctcgggcgagggccggcgccatcgcccgcggcgccttcgcactctacgagaagcacgagggcgaagagggaccccgagcacgcgcacaggcacaagatcacggaggaggtccctgccgcggcggccgntcggccccggntgctacgtattccccgaccaccccgataagaagaaggaccccagggacgccgaggaggctagcggcaaaaaaaaacccccaccaccttctccggctgacccgtagtacccggcgggcggcccaaccaaaagctatactgcttccgggcacacacaaccacaccccctgttttaattccggaactggcg

SEQ ID NO: 53072 - protein, 135 aa, Zea mays
  misc_feature: Ceres CLONE 1472216-F
  misc_feature (5)..(5): Xaa is any aa, unknown, or other
  misc_feature (30)..(30): Xaa is any aa, unknown, or other
  misc_feature (46)..(46): Xaa is any aa, unknown, or other
  misc_feature (49)..(49): Xaa is any aa, unknown, or other
  misc_feature (51)..(51): Xaa is any aa, unknown, or other
  misc_feature (53)..(53): Xaa is any aa, unknown, or other
  misc_feature (98)..(98): Xaa is any aa, unknown, or other
MSEEXHHHFFTTTRRTKSSPPASTGTPRPXVSPPTARASTRGTRKXRRXTXTXSTSGEGRRHRPRRLRTLREARGRRGTPSTRTGTRSRRRSLPRRPXGPGCYVFPDHPDKKKDPRDAEEASGKKKPPPPSPADP

SEQ ID NO: 53073 - DNA, 645 bp, Zea mays
  misc_feature: Ceres CLONE 1472225-F
  misc_feature: Encodes the peptide sequence at SEQ ID NO. 53074
  misc_feature (325)..(325): n is a, c, t, g, unknown, or other
  misc_feature (333)..(333): n is a, c, t, g, unknown, or other
  misc_feature (343)..(343): n is a, c, t, g, unknown, or other
  misc_feature (355)..(355): n is a, c, t, g, unknown, or other
  misc_feature (376)..(376): n is a, c, t, g, unknown, or other
  misc_feature (437)..(437): n is a, c, t, g, unknown, or other
  misc_feature (438)..(438): n is a, c, t, g, unknown, or other
  misc_feature (476)..(476): n is a, c, t, g, unknown, or other
ggcggccgctctagatctagtggatcccccgggctgcaggaattcgtctcacccctagaaaaactgccatcagaatcagaccaccacacgcccgaggcccgactgcaagcgcctgagcccaagacccatggccatggccgccgccaccgtcgcagcgtcactgcccgtggcgcaagggctcgggaagcccctctgcgccggcagcaacgcgccgtcgctccgggccgtcgcgggcgcgccccgtcgtcggtcggccaggacccaggatggcgtcgtccgggcgtccgcgcaaaagcagcactcggccaaggagtgggcggccgcngctgccgntggcgcggcnctggtgctgccngaggtcgcggaggccgcgccnggaatctccccgtcgctcaagaacttccctctcagcatcgtctccggtggggtcgtgctcnntcccatcgtcgggcgcgtcgtcgccgtctctaacttcnatcccgtcaggcggggttgagctgcatgcgtcgttgggggttggttaaatggacccaatgtactgagatccctccccccgtgtgcttcccaataaaaacagtgtttaatgcgggaatggtgaaaatttcatttcctgccctctggatggataaaacggattcaaccgcg

SEQ ID NO: 53074 - protein, 120 aa, Zea mays
  misc_feature: Ceres CLONE 1472225-F
  misc_feature (67)..(67): Xaa is any aa, unknown, or other
  misc_feature (102)..(102): Xaa is any aa, unknown, or other
  misc_feature (115)..(115): Xaa is any aa, unknown, or other
MAAATVAASLPVAQGLGKPLCAGSNAPSLRAVAGAPRRRSARTQDGVVRASAQKQHSAKEWAAAAAXGAALVLPEVAEAAPGISPSLKNFPLSIVSGGVVLXPIVGRVVAVSNFXPVRRG

SEQ ID NO: 53075 - DNA, 666 bp, Zea mays
  misc_feature: Ceres CLONE 1472226-F
  misc_feature: Encodes the peptide sequence at SEQ ID NO. 53076
  misc_feature (413)..(413): n is a, c, t, g, unknown, or other
  misc_feature (456)..(456): n is a, c, t, g, unknown, or other
  misc_feature (554)..(554): n is a, c, t, g, unknown, or other
aagctggagctccccgcggtggcggccgctctagaactagtggatcccccgggctgcaggaattcgtctcacccctagaaaaagctgcagcttctcaaccggataggtagcaccggagcaggtagaacgctgcacaatccccttcgccgccgccaagatggtgaacgttcctaagaccaagaagacgtactgcaagaacaaagagtgcaagaagcacacactccacaaggtgactcagtataagaagggcaaggatagcctgtctgcccagggaaagcgccgttatgaccgcaagcagtcaggatatggtggtcagaccaagcctgtcttccacaagaaggccaagaccaccaagaagattgttctgaagctgcagtgccagagctgcaagcactactcacagcacgccatcnagagatgcaagcattttgagattggtggagacaagaagggcangggcacatctcttttctaagcttctcgtccacctgtctggttgttgagttgaaactgtgggtctactactactgtataaaaacatgtcgccaaatttncatgttaatgtacaattgaggcagaccatgctatgtatcaaattccatgcctgacatttgttctggggtgtgggcaacttttggcaaatgaaagtttgtaaaaaaaaaaaaa

SEQ ID NO: 53076 - protein, 105 aa, Zea mays
  misc_feature: Ceres CLONE 1472226-F
  misc_feature (19)..(95): Pfam Name: Ribosomal_L44 Pfam Description: Ribosomal protein L44
  misc_feature (86)..(86): Xaa is any aa, unknown, or other
  misc_feature (100)..(100): Xaa is any aa, unknown, or other
MVNVPKTKKTYCKNKECKKHTLHKVTQYKKGKDSLSAQGKRRYDRKQSGYGGQTKPVFHKKAKTTKKIVLKLQCQSCKHYSQHAIXRCKHFEIGGDKKGXGTSLF

SEQ ID NO: 53077 - DNA, 663 bp, Zea mays
  misc_feature: Ceres CLONE 1472238-F
  misc_feature: Encodes the peptide sequence at SEQ ID NO. 53078
  misc_feature (165)..(165): n is a, c, t, g, unknown, or other
  misc_feature (183)..(183): n is a, c, t, g, unknown, or other
  misc_feature (223)..(223): n is a, c, t, g, unknown, or other
  misc_feature (235)..(235): n is a, c, t, g, unknown, or other
  misc_feature (448)..(448): n is a, c, t, g, unknown, or other
  misc_feature (453)..(453): n is a, c, t, g, unknown, or other
ctccccgcggtggcggccgctctagaactagtggatcccccgggctgcaggaattcgtctcacccctagaaaaacctagcttcagaacgaactaaaacccgcgatctgaagcgactagtcgaaggcggcggcggcgatggggagcgaccaggagacggagaaagngaagaccccggtggcacntatgcccatcgcgaagcccctcgcaggaaagaagctctgncagcggaccctncagctcgtgcgacgagcctctgagggccagtgcctcaaagcgcgagtcaaagaggtagtcaagagcattcgccgcgggacaaagggttgtgtgtgattgctagaaaatatttctcctattgatgtgattacacacgtgccaatactatgtggagaaatctatgttccttacatatatgttccatcaaaagaggatcttgcgaccgcgggaccnactangagggccatcttgttgccgtctggttctgaccaaacccaaacaaggggggagcttcagtgaggaggtgagggataaactggaagtcagactatgacccaatttgtaccggaaagtggctgaagctaccttctggcatggttctagggaccatttccggggaccacctcccccttgagaatccttcgccccttcgctggtgccccattctt

SEQ ID NO: 53078 - protein, 64 aa, Zea mays
  misc_feature: Ceres CLONE 1472238-F
  misc_feature (10)..(10): Xaa is any aa, unknown, or other
  misc_feature (16)..(16): Xaa is any aa, unknown, or other
  misc_feature (29)..(29): Xaa is any aa, unknown, or other
MGSDQETEKXKTPVAXMPIAKPLAGKKLXQRTLQLVRRASEGQCLKARVKEVVKSIRRGTKGCV

SEQ ID NO: 53079 - DNA, 660 bp, Zea mays
  misc_feature: Ceres CLONE 1472241-F
  misc_feature: Encodes the peptide sequence at SEQ ID NO. 53080
  misc_feature (163)..(163): n is a, c, t, g, unknown, or other
  misc_feature (187)..(187): n is a, c, t, g, unknown, or other
  misc_feature (323)..(323): n is a, c, t, g, unknown, or other
  misc_feature (328)..(328): n is a, c, t, g, unknown, or other
tggagctccccgcggtggcggccgctctagaactagtggatcccccgggctgcaggaattcgtctcacccctagaaaaatctcccagtccgatcccagctgcgcgcgcccgtggacttgtcctgccatggaaggcctcatcccgttcatctacaggggcgtcntgcggtacaggaaggaggaagggncggtctccctcggcgacctcttcttcgacgagtcctccctcgcgacgtcctacttccgtctcccgggcggcgcctactcccggccgtaccagcaggtgacgtcgagcgacttgttgtcttccagacgactacttcnacggncagctccggtgcagccgggcgtggcacaacaacgctctccgatgaggtgcccgtcgcacccgccggccccggtctccccggaccggtgactcaatcgtgaagtaaactagccccccgtgaggcaaaaaaagaaaaccagggaagggttgttttgctcctggccctcaataacatatggagcgtgtgggacttagtatgaagataatccttaaataatttgaaatttcacccctctaagggggtgcgtggaaagtgcacaaaaatttcttccctttttttttaacgggggccttctttaaagaaaatgaagggggaggggggcccccgcgtcc

SEQ ID NO: 53080 - protein, 96 aa, Zea mays
  misc_feature: Ceres CLONE 1472241-F
  misc_feature (13)..(13): Xaa is any aa, unknown, or other
  misc_feature (21)..(21): Xaa is any aa, unknown, or other
  misc_feature (66)..(66): Xaa is any aa, unknown, or other
  misc_feature (68)..(68): Xaa is any aa, unknown, or other
MEGLIPFIYRGVXRYRKEEGXVSLGDLFFDESSLATSYFRLPGGAYSRPYQQVTSSDLLSSRRLLXRXAPVQPGVAQQRSPMRCPSHPPAPVSPDR

SEQ ID NO: 53081 - DNA, 661 bp, Zea mays
  misc_feature: Ceres CLONE 1472259-F
  misc_feature: Encodes the peptide sequence at SEQ ID NO. 53082
  misc_feature (469)..(469): n is a, c, t, g, unknown, or other
ctccccgcggtggcggccgctctagaactagtggatcccccgggctgcaggaattcgtctcacccctagaaaaagacgcgacgcctcaaatcgctccctgcctctgccctctggtcacctcgcttccgctcccggctcccctccggccacccagacatcgtccgttcgctcgccaagagacaggaccggagaccatggcggaccagctcaccgacgaccagatcgccgagttcaaggaggccttcagcctcttcgacaaggacggcgacggttgcatcacaaccaaggagctcggaactgtcatgcgatcactgggtcagaacccaaccgaggctgagctccaggacatgatcaacgaggtcgatgcggacggcaacggcaccatcgacttcccggagttccctcacctcatggccccgcagatgaaggacaccgactccgaggaggagctcaaggagggcgtcagggntgtcgacaaggaccagaacggcttcatctctgcggcggagctcccgcacgtgatgaccaacctcggcgagaagctgaccgacgaggaggtcgatgagatgatccgcgaggccgacgtcgatggcgatggtcagatcaactacgaggaggtcgtcaggtcatgatggccaagtgagtaagcctgcgggtacgt

SEQ ID NO: 53082 - protein, 145 aa, Zea mays
  misc_feature: Ceres CLONE 1472259-F
  misc_feature (12)..(40): Pfam Name: efhand Pfam Description: EF hand
  misc_feature (48)..(76): Pfam Name: efhand Pfam Description: EF hand
  misc_feature (121)..(146): Pfam Name: efhand Pfam Description: EF hand
  misc_feature (85)..(113): Pfam Name: efhand Pfam Description: EF hand
  misc_feature: SWISSPROT Homolog: EC 2.7.11.1 Non-specific serine/threonine protein kinase
  misc_feature (92)..(92): Xaa is any aa, unknown, or other
MADQLTDDQIAEFKEAFSLFDKDGDGCITTKELGTVMRSLGQNPTEAELQDMINEVDADGNGTIDFPEFPHLMAPQMKDTDSEEELKEGVRXVDKDQNGFISAAELPHVMTNLGEKLTDEEVDEMIREADVDGDGQINYEEVVRS

SEQ ID NO: 53083 - DNA, 736 bp, Zea mays
  misc_feature: Ceres CLONE 1472265-F
  misc_feature: Encodes the peptide sequence at SEQ ID NO. 53084
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (310)..(310): n is a, c, t, g, unknown, or other
  misc_feature (315)..(315): n is a, c, t, g, unknown, or other
gggtggccccnnnnnnnnnnnnnnnnnnnnnnnnnnnnnnntttnnnnnnccatactggagctccccgcggtggcggccgctctagactagtggatcccccgggctgcaggaattcgtctcacccctagaaaaactactaccctacccgtccgcctctctcgaaggcgcagcaccagcgagcatgtcgcctgtcaccgcactcgtggcgggcacgggtggtgccgcggactcggccccgggcccgtcgccggcgaagcacgcccgccattactccgtcggcttctcccccgctcacggccggcgggcgcncggcnctggcggtggaatgctcctcgcggccccagaaaaggggaccaaccacaacttggagacgcggccccaaaaaacgcagccgtggggacatcagcgccccccccagaagtacccggcggtgccggcggctcccgccggactggactcttcttcccctccggcgccacggttcgacgtgggaggaggcggaagccccggggacccgccgcaactctcctccttcaaagtggccgcggcccccaaatggagccgcccccgggggtgcccccaaagttggtccccctgaaccccccccaaaaagctgtttttcctttgaaattttttttttaaaaaaacaaggggccgccccaaatttttgggaattaaaaaaataaaaaaaccttttttttggcgggcccacaaaaaaaagaaccccttagccgg

SEQ ID NO: 53084 - protein, 138 aa, Zea mays
  misc_feature: Ceres CLONE 1472265-F
  misc_feature (43)..(43): Xaa is any aa, unknown, or other
  misc_feature (45)..(45): Xaa is any aa, unknown, or other
MSPVTALVAGTGGAADSAPGPSPAKHARHYSVGFSPAHGRRAXGXGGGMLLAAPEKGTNHNLETRPQKTQPWGHQRPPQKYPAVPAAPAGLDSSSPPAPRFDVGGGGSPGDPPQLSSFKVAAAPKWSRPRGCPQSWSP

SEQ ID NO: 53085 - DNA, 655 bp, Zea mays
  misc_feature: Ceres CLONE 1472267-F
  misc_feature (494)..(494): n is a, c, t, g, unknown, or other
  misc_feature (614)..(614): n is a, c, t, g, unknown, or other
ctggagctccccgcggtggcggccgctctagaactagtggatcccccgggctgcaggaattcgtctcacccctagaaaaaattgcttggcgaacctttcatctcatgccaccagtggtgaggataattttgttatggagctgtgacagctcatttattgtggctggccaccagggttgttttactttgagcagccgtagcaggatgccatcgaagctcatctattgttgatgggctgatggttggcaattttgccgcagtggttcgtgtgggattttgtttctgcaggctcctggggttgtatatgcgctgctgtaagcaatgaatgaattgtgagctattccacattcttagagtcaattcatctcaggtttgatcaaatttatataataaaacactaatatttatgatacccactatgtcattagattctttatttaactacattttatagtatatctatttgatgttatcgatctttgtaatttcctctancagtttggtctaaattgagatgttttggctcactagtaaagttgtaatcactttgcatttcaaatgaggggagtatcttgcactaaaaaaaaaaaaaaacgagacgctcgaggtacccanttcgccctatagtgagtcgtattacgcgcgctcactggccg

SEQ ID NO: 53086 - DNA, 675 bp, Zea mays
  misc_feature: Ceres CLONE 1472269-F
  misc_feature: Encodes the peptide sequence at SEQ ID NO. 53087
  misc_feature (330)..(330): n is a, c, t, g, unknown, or other
  misc_feature (367)..(367): n is a, c, t, g, unknown, or other
  misc_feature (374)..(374): n is a, c, t, g, unknown, or other
  misc_feature (438)..(438): n is a, c, t, g, unknown, or other
aagctggagctccccgcggtggcggccgctctagaactagtggatcccccgggctgcaggaattcgtctcacccctagaaaactcggtagcagctggctcacttctccaggaaagtgttcgtcctcatggcgccgccgcagccgaagtcgggcctcttcgtgggcatcaacaagggccatgtcgtcaccaagcgcgagctgcctctgcgcccgtcccaccgcaaggggaaagcaacgaagagggtgtccatggtcaggggcctgatcagagaggttgctggctttgctccttatgagaagcgtatcaccgagcttcttcaagggtgcaanggacagcgcgctctgaagcttgccagagaaagcttgnaactcancagagggcaaagagaagagagagagatgatgggcgtcctcaggaagatgagatcggctggtacncacactgacaagaagaaataaacatttcaagttcatgaatgtggcacccagagattatcaactgttgtttttccctacctctaaaaactagacatggcaaaattatttttgaccgaaccattgtttggttagtaatggattgaacccacctcgtgggtatttgccccacacttcaagtgcatcaaatggttttgcaaaaaaaaaaaaaaaaaacgagacgctcgagggacccaattc

SEQ ID NO: 53087 - protein, 110 aa, Zea mays
  misc_feature: Ceres CLONE 1472269-F
  misc_feature (5)..(102): Pfam Name: Ribosomal_L36e Pfam Description: Ribosomal protein L36e
  misc_feature (68)..(68): Xaa is any aa, unknown, or other
  misc_feature (81)..(81): Xaa is any aa, unknown, or other
  misc_feature (83)..(83): Xaa is any aa, unknown, or other
MAPPQPKSGLFVGINKGHVVTKRELPLRPSHRKGKATKRVSMVRGLIREVAGFAPYEKRITELLQGCXGQRALKLARESLXLXRGQREEREMMGVLRKMRSAGTHTDKKK

SEQ ID NO: 53088 - DNA, 645 bp, Zea mays
  misc_feature: Ceres CLONE 1472273-F
  misc_feature: Encodes the peptide sequence at SEQ ID NO. 53089
  misc_feature (123)..(123): n is a, c, t, g, unknown, or other
  misc_feature (159)..(159): n is a, c, t, g, unknown, or other
  misc_feature (408)..(408): n is a, c, t, g, unknown, or other
  misc_feature (409)..(409): n is a, c, t, g, unknown, or other
ctggagctccccgcggtggcggccgctctagaactagtggatcccccgggctgcaggaattcgtctcacccctagaaaatttcgagtggcgcatatgggcttcgctggtccctatagtttggnggatactcctgacttcgggtgacagagcttaccttncacattttcgggttctgtgctgccatggttggctgccctgctacgtctacaaagaccatcttggcagagtccctactccatggatacaagtttgacagcataaacacggtgtactacatggcaccctttgccacatgatactggctctaccagcgatggtgctttgaggaggaggtgtaatgaactggttctacacacatgattcatcgttcctgcgctgactatcatcctaggtcggggggtgctgcnntctgccttacttctcatctctacgtcatccatcaacacaggagtgacgttcacgttgcagcaaccttaagccccgggggcatggtaggggcctggtcaatcttcgggaaccaatcccttcatgaatgcaaccgggggtggaaccccccgggtgggtccccctttcaaggggtccggggggaattcaaatcccccaagcggcggggtgccccccccgggaattctaggacccacccc

SEQ ID NO: 53089 - protein, 37 aa, Zea mays
  misc_feature: Ceres CLONE 1472273-F
MVGCPATSTKTILAESLLHGYKFDSINTVYYMAPFAT

SEQ ID NO: 53090 - DNA, 661 bp, Zea mays
  misc_feature: Ceres CLONE 1472282-F
  misc_feature: Encodes the peptide sequence at SEQ ID NO. 53091
  misc_feature (159)..(159): n is a, c, t, g, unknown, or other
  misc_feature (162)..(162): n is a, c, t, g, unknown, or other
  misc_feature (165)..(165): n is a, c, t, g, unknown, or other
  misc_feature (302)..(302): n is a, c, t, g, unknown, or other
  misc_feature (305)..(305): n is a, c, t, g, unknown, or other
  misc_feature (398)..(398): n is a, c, t, g, unknown, or other
  misc_feature (399)..(399): n is a, c, t, g, unknown, or other
  misc_feature (407)..(407): n is a, c, t, g, unknown, or other
tggagctccccgcggtggcggccgctctagaactagtggatcccccgggctgcaggaattcgtctcacccctagaaaaaaacggcgccacggcggcgacgagaagtggcgagccccgagagcgggtttagttagaggctacgggcggtcgggcgcggcngcngcngcggccatgagcagcgggagcgagagcactaccgccagcaggtggcccgagctggccacgctgcgcgccctggcgcgcgacgccccggagcagctgcggctgccgcgggccgcacgtcggcgtcggcgtcggcgtcntcntcgccgtggcgcgggcgcgaggccacctccacggccacgcaagacggccaaggtgatgcacctgctgctctggggaccaaagtgaaccgcaannagccaccntaccggccgggttgctcggtttggtctgcctgcaatcggccccgcaaggactgtactggactgtacctataccctatatactacaacgtgcccatgtacgagtctacgacgtgctgctggaaccaaacaaaaagagggggggtggggccccccttggccttcttggtgggaagttgccccagcccccccccgcttttttttccctcaaacgaacgaatgcttgctcgggggggggccagggccgggtctttatt

SEQ ID NO: 53091 - protein, 72 aa, Zea mays
  misc_feature: Ceres CLONE 1472282-F
  misc_feature (44)..(44): Xaa is any aa, unknown, or other
  misc_feature (45)..(45): Xaa is any aa, unknown, or other
MSSGSESTTASRWPELATLRALARDAPEQLRLPRAARRRRRRRXXRRGAGARPPPRPRKTAKVMHLLLWGPK

SEQ ID NO: 53092 - DNA, 659 bp, Zea mays
  misc_feature: Ceres CLONE 1472284-F
  misc_feature: Translation starting site: 169
  misc_feature (372)..(372): n is a, c, t, g, unknown, or other
aaagctggagctccccgcggtggcggccgctctagaactagtggatcccccgggctgcaggaattcgtctcacccctagaaaaaacggaagtttcggcggcgccggcgtgctcgtgatctcaacccaaggcgtgcctccgctccggtcacccgtcgctccacgcaaccatgtcgaggaggaagacaaggagcccaagggagagaacgtcacccttggacccactgtcccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgacaagtcntcaccttacgctgctatgcttgctgctcagacatcacacagcgctgcagggagcttggcatactgcactgcacattaagcttcccccccccggaggcaacaagaccagacccctgaacctgtgcccagtctgccctcagggcgtttgctcgttccgggatgaaaatccgacgcattgaggacttacccccggtccccattgacagcaccccaaaaaagggcggaggaagggaaaggaggctttaacctcctccccctccttgggatttgcccggttcttggccagga

SEQ ID NO: 53093 - DNA, 655 bp, Zea mays
  misc_feature: Ceres CLONE 1472510-F
  misc_feature: Encodes the peptide sequence at SEQ ID NO. 53094
  misc_feature (527)..(527): n is a, c, t, g, unknown, or other
ctggagctccccgcggtggcggccgctctagaactagtggatcccccgggctgcaggaattcgtctcacccctagaaaaacccccgccacctgagtacctgacacacagcgaaacgccgaaaccgcgtcaagttccccatctccgatcccccaatcgccctaaccctagactcgccaccgccgccgcgatgctccgctcgccgggcaattcgccccgccgcctctcaccgtcgcccacacccgcgccctccacccctcgcccggcctccccgcccccctccaccgccccctcctcgaagcgccgccggtcggaggtgctcgacgaggacacctacgtcgccgccatcgagcgcatcatcgagcgcgactacttccccgacctgccccgcctccgggaccgcctcgactggctgcaggccgtgcggtcccacgacccgctcatcctccgcgacgcgcagctcaaaatcctagaccgccgccgccgcgcccagcgccacgcggcgggggcccgtccccacgccgacggngggcacctccaccgcgctccgctccccgtcctttctcacaccccccgcggatcccgtcgcggcggcgtgggaggtcccgacgccgaccacgacgacgacgtcgcgggcgcgctctccctggacggctt

SEQ ID NO: 53094 - protein, 155 aa, Zea mays
  misc_feature: Ceres CLONE 1472510-F
MLRSPGNSPRRLSPSPTPAPSTPRPASPPPSTAPSSKRRRSEVLDEDTYVAAIERIIERDYFPDLPRLRDRLDWLQAVRSHDPLILRDAQLKILDRRRRAQRHAAGARPHADGGHLHRAPLPVLSHTPRGSRRGGVGGPDADHDDDVAGALSLDG

SEQ ID NO: 53095 - DNA, 711 bp, Zea mays
  misc_feature: Ceres CLONE 1472515-F
  misc_feature: Encodes the peptide sequence at SEQ ID NO. 53096
tggagctccccgcggtggcggccgctctagaactagtggatcccccgggctgcaggaattcgtctcacccctagaaaaagcggacgccaacgacgcgacggcccaagtcgcgacgccaccagctccccatcccctcggacgccatggaggaagctcgcgaccacaggctctcctccaccgccggccgccccttcctctctggcttctgcgccgcggcgctccgacgtaagcccctcggcgcccgcgcctccgccgccgccgccgccaccggcgagggccttgtgcggcagctcggcgtcctcgacctcgtgctgctcgggatcggtgcgtccatcggcgccggcatattcgtcttctctggcaccgtcgcccggggagggcgggcccagtgtcacaatccattttgctcttccccccacctgcctgagccgtccccgctccgctgctttgctgaactggccttccccccttctcttgccgccgtccggcggtagccaactttggcacccgttccttacccgcttccttgaacatcacccggccgctccgggtcttccactccaccctgatggtgggaatccccaatattcctgtcgcccccatgtgatggcttggtcaggtctaccgccagccctcgtgttgcgcggaggtcgccgggcaggctaacccttcgcgttctggagggggccccacacaccgcctagctctggg

SEQ ID NO: 53096 - protein, 116 aa, Zea mays
  misc_feature: Ceres CLONE 1472515-F
MEEARDHRLSSTAGRPFLSGFCAAALRRKPLGARASAAAAATGEGLVRQLGVLDLVLLGIGASIGAGIFVFSGTVARGGRAQCHNPFCSSPHLPEPSPLRCFAELAFPPSLAAVRR

SEQ ID NO: 53097 - DNA, 654 bp, Zea mays
  misc_feature: Ceres CLONE 1472518-F
  misc_feature: Encodes the peptide sequence at SEQ ID NO. 53098
ggagctccccgcggtggcggccgctctagaactagtggatcccccgggctgcaggaattcgtctcacccctagaaaaaagatcgagcactgatagacgggcaggggagagggaaaaaaaatctaaccctagcatccgcagcgctagggttcgggggttgcgatggcggcggcggcgatacagcgggggacggtgaactggttcaacgacacgaagggcttcgggttcatctcccccgaggacggcagcgaagatctcttcgtgcaccagtcgtcgatcaagtcggagggcttccgctcgctcgcggaaggagaggaggtggagttttccgtctcggagggtgacgacagccgcactaaggccgtacacatgaccgggcccgacggatccttcgtcaggggcggaggaacgcagaccgagcggctgctggagcatatcgtccacggccgtggccgcgatctgcgcctcgcccgcccgctcctctcgctcgacgacttccaccgctacctcttctcgcacgacctcgacccggccatccgtcacccggaggtgcaccacgacatgaggcgcgggatctcccaatacttcatctacaacggagataactcctacctcaccggcgaccaggtcagcagcgactgggagggattccccc

SEQ ID NO: 53098 - protein, 164 aa, Zea mays
  misc_feature: Ceres CLONE 1472518-F
  misc_feature (6)..(73): Pfam Name: CSD Pfam Description: 'Cold-shock' DNA-binding domain
  misc_feature: SWISSPROT Homolog: EC 3.1.4.11 Phosphoinositide phospholipase C
MAAAAIQRGTVNWFNDTKGFGFISPEDGSEDLFVHQSSIKSEGFRSLAEGEEVEFSVSEGDDSRTKAVHMTGPDGSFVRGGGTQTERLLEHIVHGRGRDLRLARPLLSLDDFHRYLFSHDLDPAIRHPEVHHDMRRGISQYFIYNGDNSYLTGDQVSSDWEGFP

SEQ ID NO: 53099 - DNA, 626 bp, Zea mays
  misc_feature: Ceres CLONE 1472520-F
  misc_feature: Encodes the peptide sequence at SEQ ID NO. 53100
  misc_feature (414)..(414): n is a, c, t, g, unknown, or other
  misc_feature (425)..(425): n is a, c, t, g, unknown, or other
  misc_feature (435)..(435): n is a, c, t, g, unknown, or other
  misc_feature (626)..(626): n is a, c, t, g, unknown, or other
agtggatcccccgggctgcaggaattcgtctcacccctagaaaaaagcaacaagacccccctgcctcgcctcgattccacccacacccacatcctcacctccctccgcctccgagtgccaccaaaccctagatctcgcaccggcggcagccatgtccaagccatggggtggcgtcggcgcgtgggcgctggatgccgagcgcgccgaggaggaggagcgcgagcaggtcctggccttcccggcgcccgagccacccgcggccgcgggcggcgccgccagcttcccgagcctccgcgaggcggcctctgctggcggcaagggcaaatcgaagaagaagaacaagggcaccacgctgtccctgtccgagttaacaaccttcggcgcggccgcggcccagcggcgcgtggtgtcccnacattccttgncctgacccanaaggagatgatgctgctgcccacggggccccggggacgcttcggccgaggagctggacccgttctcgcgggttccgctcctaccgggggggggggcggctttggggcaggcgcttgaagggagcgccgccggcggttccaacaacaaggcccccccggggccgggaaaaacctcccactttgaattggctn

SEQ ID NO: 53100 - protein, 91 aa, Zea mays
  misc_feature: Ceres CLONE 1472520-F
  misc_feature (88)..(88): Xaa is any aa, unknown, or other
MSKPWGGVGAWALDAERAEEEEREQVLAFPAPEPPAAAGGAASFPSLREAASAGGKGKSKKKNKGTTLSLSELTTFGAAAAQRRVVSXHSL

SEQ ID NO: 53101 - DNA, 726 bp, Zea mays
  misc_feature: Ceres CLONE 1472521-F
  misc_feature: Encodes the peptide sequence at SEQ ID NO. 53102
  misc_feature (23)..(23): n is a, c, t, g, unknown, or other
  misc_feature (35)..(35): n is a, c, t, g, unknown, or other
  misc_feature (36)..(36): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (53)..(53): n is a, c, t, g, unknown, or other
  misc_feature (467)..(467): n is a, c, t, g, unknown, or other
cctatttctattcccccctcggngggccattaacnnaacacaaaannnnnttnccaagctggagctccccgcggtggcggccgctctagactagtggatcccccgggctgcaggaattcgtctcacccctagaaaaagctaccgctagccgccgcgctgctcatctggtggcggctcgcctccctccccccatccgccgccgccggctcctcctctagctccctccttaccccgagctttaagctcgtgctacctgcctacctatccgtagggagagagagagagaggggagaaggttcggtcggtcggtcgggggctctcggatctcgccgctgcctccccgtttcttcgttgggatctcgctcgcttcgcgccatggccgccgtcgcgacgccaccggcccccgcgcccgccgcgccggcaccggcaccggcaccggctgctgctccggctcccgtcaccgtaanaacacccccggagcagaccacggatctgctgcagaagttggcgctggattcgcaccccaaggcggcggggtgcgacaaagcctgctgctgctgccgctgccgccaaagagggcgctgtgacaaaccagccgcctgagggtggccattcccgccaggagcgggctatcacgcccggtgctttcagacttttatggatccccaaccttgttcctatccaccctgcgggattacctatgggagggctaacaacacggttccg

SEQ ID NO: 53102 - protein, 75 aa, Zea mays
  misc_feature: Ceres CLONE 1472521-F
  misc_feature (31)..(31): Xaa is any aa, unknown, or other
MAAVATPPAPAPAAPAPAPAPAAAPAPVTVXTPPEQTTDLLQKLALDSHPKAAGCDKACCCCRCRQRGRCDKPAA

SEQ ID NO: 53103 - DNA, 725 bp, Zea mays
  misc_feature: Ceres CLONE 1472525-F
  misc_feature: Encodes the peptide sequence at SEQ ID NO. 53104
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (464)..(464): n is a, c, t, g, unknown, or other
tttccccccttcccttttccccccccccactatccccttnnnnccccacattcttaacctggaactcaccgcggaggcggccgctctatactagtggatcccccgggctgcaggaattcctctcacccctagaaaaaagcggcatccgccacttcgtcgtcgtcgtcgcacggattggcattggctgccccccggccctgttcctcgtcctcctcatcaattcccgtctctcagtcctcccaataatggtggcgtggtgagaaatccttccgtccggccgtcgtcttagaagatgaactgttcctcttgctgcgccgctgccactccatcttctccggcgcttctcgccaggccgcgggggggtttagctgctagctgctccacgacgacagcaaatcagaacgtgcttttcctgggctcaaaacagtttccacggatcacgtatatccctgcgactttaaggntgtttttttaccacaggtaatagcttttgccggccaacaaccttgggacatccccatactcgtctacacgcttgatttttttcaacgggcattctaaaccttctcaaacattgtaaaatctatcatcaacaattttccacgggaccctgccttctagtgaaagtgccccaaaaaaaaatggaaaacgtccggtatggtgggtgcttgggttactgggaaacccccccggtagttgctcggccccaaccgggttcgatggcg

SEQ ID NO: 53104 - protein, 63 aa, Zea mays
  misc_feature: Ceres CLONE 1472525-F
  misc_feature (58)..(58): Xaa is any aa, unknown, or other
MNCSSCCAAATPSSPALLARPRGGLAASCSTTTANQNVLFLGSKQFPRITYIPATLRXFFYHR

SEQ ID NO: 53105 - DNA, 779 bp, Zea mays
  misc_feature: Ceres CLONE 1472527-F
  misc_feature: Encodes the peptide sequence at SEQ ID NO. 53106
  misc_feature (36)..(36): n is a, c, t, g, unknown, or other
gttcctctgtcccacttaccccctccttcccttttnttttccccccccccaaactggaactccccgcggtggcggccgctctatactagtggatcccccgggctgcaggaattcgtctcacccctagaaaaaattgcaagccttcccggttacttgttcactaacaaggtcgggacggcatggcccttggagctgcgtaccatcactacctgcagctcgccggcgaccatggcaccgccacacacgcactgctcctcggcgtacttatcttcctcgtcatccgcctagtatccgcaaggcgaaccggcacaacctcagccaacaaacgtaagcagcaacagcggcttccgctcccgccttcgcccccgggcaagctgcccatcatcggccacctccacctcatcggcgccgagacccacatctcgatccgggacctggacgccaagcacgggcgtaaaggattgctacacctccgcatcggcgccgtgcccaccctgttcgtgttctcgcccagcgccgccgacgctggcctgcgaacccaggaaccacctcttccacgtcgcggtcgcccgtccctgggccgcccgagatcatcccgctatagaggcccttcggaacgacgcgtttcggcggccctacagggcgaaattactgggcgcggcagggggcggggaaaactacccttcgaccggggccacgagggcttccggccgaccaaagaaagggttgggcgagttccttttcgcccgttcgcgggggacgaagacaaaagcgaagga

SEQ ID NO: 53106 - protein, 200 aa, Zea mays
  misc_feature: Ceres CLONE 1472527-F
MALGAAYHHYLQLAGDHGTATHALLLGVLIFLVIRLVSARRTGTTSANKRKQQQRLPLPPSPPGKLPIIGHLHLIGAETHISIRDLDAKHGRKGLLHLRIGAVPTLFVFSPSAADAGLRTQEPPLPRRGRPSLGRPRSSRYRGPSERRVSAALQGEITGRGRGRGKLPFDRGHEGFRPTKERVGRVPFRPFAGDEDKSEG

SEQ ID NO: 53107 - DNA, 633 bp, Zea mays
  misc_feature: Ceres CLONE 1472529-F
  misc_feature: Encodes the peptide sequence at SEQ ID NO. 53108
agtggatcccccgggctgcaggaattcgtctcacccctagaaaaaactccctccccttgcgtttagcctcccgctgttgtggagccgcgggccattcccaaccatcgttgcggtggtggccggtattggccgagacccatgggcatccaggtcgcggcggtcgtgatcccgccgccctgctcttctccttcctcctctccggcgtcgccttcgtcctcggccattgccacgtcgccgcagcatgccgttcttggcgccaggctggcgaggagccagtcgtcgctggcttgctggaacgccgccggtctcggccggcggcgcggcggggagcacacgatcaggcgcgctctcagcgcgagcatcgacagcgtcgtgtttccacctccgggacgatgatgagttctcgaggaggatccaggagctcgcggtgggtcagcacccctgcgcccgttgctgctggtggccggtgagcgtggatcggagcgcgagcagcgtcggtttgccgctgtccctgccgatgctcaaccggaagaagcacccccagctggagcatgggcggtgggacaagcggctggtccaaagcgccggcgagtccgcgcgccccggggtggggcgcgccttctcctcaaggtg

SEQ ID NO: 53108 - protein, 130 aa, Zea mays
  misc_feature: Ceres CLONE 1472529-F
MPFLAPGWRGASRRWLAGTPPVSAGGAAGSTRSGALSARASTASCFHLRDDDEFSRRIQELAVGQHPCARCCWWPVSVDRSASSVGLPLSLPMLNRKKHPQLEHGRWDKRLVQSAGESARPGVGRAFSSR

SEQ ID NO: 53109 - DNA, 892 bp, Zea mays
  misc_feature: Ceres CLONE 1472530-F
  misc_feature: Encodes the peptide sequence at SEQ ID NO. 53110
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (20)..(20): n is a, c, t, g, unknown, or other
  misc_feature (21)..(21): n is a, c, t, g, unknown, or other
  misc_feature (50)..(50): n is a, c, t, g, unknown, or other
  misc_feature (505)..(505): n is a, c, t, g, unknown, or other
  misc_feature (892)..(892): n is a, c, t, g, unknown, or other
gttggttcggtnntnatggnncactattcatacccctgttacgaacccgncgaagctggagctcaccgcggtggcggccgctctataactagtggatcccccgggctgcgagagttcgtctcacccctagaaaagactcactcacttagccactcttcttcctcctgatcactccgctctccattacttgttcggaagaccaagaaggtaaaacacgctaacgagacaacaaggatcatggggcgcgggcgcggccacctcctgctgccggtagcagccgcctgcctgtggacgctgtcgtgggtactgatgcttgtcgcgtccccttcccgtgctggctgcggtgacaggtgaggtgcgtgagggcggggctccacatgcggcggcggccgggaatccaacacgcccgtcgctgcccccctctctcatctggctcgcaaatgttatcagggaggggggagggcggcttcacccgtacttccccgccccccctgggtgaagatantatgtattggagcgaaccaagtctaccaaatacccgtagacacctacgccggtggttaactcggccgccattctgggcccagcggtgtttcttgtccggcaatatctattgcgccggtggggggtctcttatactcggcctgtggtagggttttgtcagccacgtccctaggaagtacaacggcccctataaaagataaggtccgccctcgtacccatttggaacccagttccgcctatacgaccccccccccgatatcaacgatgcggctccgctaatcgatctacaagttcagccggtgccctctaccgcggaaaaaaccggccgcaaaaacttcaaataccgcggccccacaaacaccagaagcgctagtcaaccccgcccccn

SEQ ID NO: 53110 - protein, 38 aa, Zea mays
  misc_feature: Ceres CLONE 1472530-F
MGRGRGHLLLPVAAACLWTLSWVLMLVASPSRAGCGDR

SEQ ID NO: 53111 - DNA, 744 bp, Zea mays
  misc_feature: Ceres CLONE 1472532-F
  misc_feature: Encodes the peptide sequence at SEQ ID NO. 53112
aatccccacttccctttgcgcccccttgccttttcgcttccgcgacccaatacctaaactgcgactccccgcgggggcggttggtcttttctaaagagagcgccgggctgcaggtttgccccacaccggtagaaaaaattccctctcttcctcccgaaatttcccgccttttactccgagagacgcagacacgagacgaagaacaaaaaaaaccgtccgcacaaaaaagaaaacggcagcgccagccagtgaggagaaaagcttcagatccagctccagctccaggtccccctcctccccaatgcctcgcccgtagccgcgtccgccgcacgtcgcaatggccggccccagcgtgcccgcagcggcgctggcggttttgctcgcggtcgccgctctcacgtgctgcgccgtcgcggagacgccgccgagcgagcgggccgctctgctggagccccttaccgtgaccccgggggagcgccgcttaggggggaacgcctcccccccggcgtgcgtttggggcggtgtcgattgcaacagtgccaccttcctcgcccctaacgtgggtggtttgggccgcgggctcttggcgggagcattctgggccgggcgatgtcttcggtccaggcttgaatagacctttcccgggagcccaccgcatcccgtgtccacaaccggttgcacgcgcggggcaacccggtcgcgctgaatgcagcgcctggcccccctgctctttggcccaagggg

SEQ ID NO: 53112 - protein, 98 aa, Zea mays
  misc_feature: Ceres CLONE 1472532-F
MAGPSVPAAALAVLLAVAALTCCAVAETPPSERAALLEPLTVTPGERRLGGNASPPACVWGGVDCNSATFLAPNVGGLGRGLLAGAFWAGRCLRSRLE

SEQ ID NO: 53113 - DNA, 650 bp, Zea mays
  misc_feature: Ceres CLONE 1472534-F
  misc_feature: Encodes the peptide sequence at SEQ ID NO. 53114
  misc_feature (489)..(489): n is a, c, t, g, unknown, or other
tggagctccccgcggtggcggccgctctagaactagtggatcccccgggctgcaggaattcgtctcacccctagaaaaacctgtaaactaaccaccaaagccgaagaaggcggcttgccctgcccgtcgccttggtgccgcgcgcgccatggccaagagcaagtcgtccgccaaggccggctccccgctactcggcaagtacgagctcggccacctcctcggccggggcaacttcgccaaggtataccacgcgcgctgcctcggcggaggcgaccccgtggccgtgaaggtgctggacaaggccgggctggccgccacgggcatggcggcgcgggtcctgcgcgaggtgtccgccatgcgccgcctgagccaccccaacgtgctccgcctccacgaggtgctggcgacgcgctccaaggtgtacctcgtgatggagctggccccgggcggggacctcctgacccggctggcgtccctgccgtcgcgcangctccccgagcacgcggcgcggcgcgtgttcctccagctggcgtcggcgctcatctacagccacgcgcgcggggtgttccaccgcgacgtgaagccgcaaaacgtgctgctggacgccgaagggcacctcaaggtgtccgacttcggcctcgcggcgctcc

SEQ ID NO: 53114 - protein, 167 aa, Zea mays
  misc_feature: Ceres CLONE 1472534-F
  misc_feature (18)..(167): Pfam Name: Pkinase Pfam Description: Protein kinase domain
  misc_feature: SWISSPROT Homolog: EC 2.7.11.1 Non-specific serine/threonine protein kinase
  misc_feature (114)..(114): Xaa is any aa, unknown, or other
MAKSKSSAKAGSPLLGKYELGHLLGRGNFAKVYHARCLGGGDPVAVKVLDKAGLAATGMAARVLREVSAMRRLSHPNVLRLHEVLATRSKVYLVMELAPGGDLLTRLASLPSRXLPEHAARRVFLQLASALIYSHARGVFHRDVKPQNVLLDAEGHLKVSDFGLAAL

SEQ ID NO: 53115 - DNA, 732 bp, Zea mays
  misc_feature: Ceres CLONE 1472535-F
  misc_feature: Encodes the peptide sequence at SEQ ID NO. 53116
  misc_feature (20)..(20): n is a, c, t, g, unknown, or other
  misc_feature (39)..(39): n is a, c, t, g, unknown, or other
cccaaaaaaaatttcttctngtattttgccgcgcctccnccaccaaaaaaataaaaactggaactccacgcggtggcggccgctctataactagtggatcccccgggctgcaggaattcgtctcacccctagaaaaatccgccccgctccttgcctccgatccccaattcctccttcggatctcgcattccgcgcagcgcaggtgtgaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactggctgggatgtcgggggttacgaccagatcagacctctttggaggtgcccaccccagaacacccagggccttatcttctgttgtgcacaataatgaccgtgaccgtgttgctcgaaccccgagatgaactcctcagggatgctgaacgaggatgagctacgtggatgctcgtgctggcttgtcctttgccaacaagccaaaatcttcccccatgccatgcaatgctgcgtgagattactcgaaaaggtttggaattaccccccccttggaaccagccaagcttggcaaccctccagaagcgctttggggg

SEQ ID NO: 53116 - protein, 94 aa, Zea mays
  misc_feature: Ceres CLONE 1472535-F
  misc_feature (5)..(95): Pfam Name: Arf Pfam Description: ADP-ribosylation factor family
MGLAFGKLFSRLFAKKEMRILMVGLDAAGKTTILYKLKLGEIVTTIPTIGFNVETVEYKNISFTGWDVGGYDQIRPLWRCPPQNTQGLIFCCAQ

SEQ ID NO: 53117 - DNA, 627 bp, Zea mays
  misc_feature: Ceres CLONE 1472537-F
  misc_feature: Encodes the peptide sequence at SEQ ID NO. 53118
agtggatcccccgggctgcaggaattcgtctcacccctagaaaaaatttccaagggctctacacgaagttaggcggccaagtgttcgcaaccaacccctcttcctcgcccactgaaaggttcagaggctcccgttttagcatagcgaccgagacgaaggagtgggggggcggagagctttgggccctggccaggatgaagtttatgagactcggcacccggccggacaccttcttcaccgccgccgactccgtgaggtctgtctgcacggaggtggccacggacctgcagatcctcgtggataactgcctctaccatctccacaagttccccctgctctcgaaatgcatgctcctgcaagcgctgtgcgccgacgccggcgacgtcgtcgtcgagctcccggggttcccgggcggcgccgaggcgttcgaggcctgcgccaagtactgctacggcatcaccatcacggtgagcgcgcgcaacctggtcccgctgcggtgcgcggcgggcgcacctcggaatgtcggaggcccgccgacaggggcaacctcgggggccaagctcggagcggttactcggcctcctgcctccctgcgccgcctggaaaggacccgcctgggcccgcctc

SEQ ID NO: 53118 - protein, 144 aa, Zea mays
  misc_feature: Ceres CLONE 1472537-F
MKFMRLGTRPDTFFTAADSVRSVCTEVATDLQILVDNCLYHLHKFPLLSKCMLLQALCADAGDVVVELPGFPGGAEAFEACAKYCYGITITVSARNLVPLRCAAGAPRNVGGPPTGATSGAKLGAVTRPPASLRRLERTRLGPP

SEQ ID NO: 53119 - DNA, 659 bp, Zea mays
  misc_feature: Ceres CLONE 1472539-F
  misc_feature: Translation starting site: 186
tggagctcaccgcggtggcggccgctctagaactagtggatcccccgggctgcaggaattcgtctcacccctagaaaaaactgctcgcactcactcacagtcgccgccgctgcccagtgcccactgctcgccgctagaggaatctgagagagagaggggaaagggcgaaggaggcgcaggcaggcatgggctccccttcctccctccccgccgcggcggcgctcgtgctcctggccctgctcgccggagcccagtgccgcgaggcccagttcgacgccgcggacgccggcgcggagaacttcaacaccagcgaggccgccgtgtactggggcccctggcagaaggcccgggccacctggtacggccagcccaacggcgccggcccggacgacaacggtggtgcgtgcggcccccccacaccaaccagtaccccttcatgtccatgggctcctgcggaaaccagccattgttcaaggacggcaagggatgcggctcctgctacaaggtacagtgaaacacagccagtatatatggatcttttttttaccagaaacctctatcaaaaatcagtagtataacagtatgatctatgttttctttagcggaaacatttttttctactggttctccacttgttttagaaagaaaaaaatcgttct

SEQ ID NO: 53120 - DNA, 852 bp, Zea mays
  misc_feature: Ceres CLONE 1472547-F
  misc_feature: Encodes the peptide sequence at SEQ ID NO. 53121
  misc_feature (38)..(38): n is a, c, t, g, unknown, or other
  misc_feature (43)..(43): n is a, c, t, g, unknown, or other
tcttggtgtaagtcttttttcctcacgccacctcaaanaaatncccctccccttccacgctggagctccccgcggtggcggccgctctataactagtggatcccccgggctgcaggaattcgtctcacccctagaaaaagctagcctgcttgcttcgagcctagctgtctccgtccgtctagctccagctctccctcgaggcccggaacgcgaggacgacgaagagcagagcagggcagagccccagccagccacaatgccgtcgtcggggatcaccgcggtggacgcggccgccaaggggatgaagctggagcggtacgccagcgggggcgcgctgctgctgcgccgggcgaccagcgcccagctcgtgtccccgtcgtcgcacctgctcttacgcgctaccgcggctgggccatgtctcgcgctctgtctttcttctgcgcggctgaattaaattgtacctgcctcctcccgcttccttgtaaccttcgccaggcccggccagctggtcggacggcttcacgacccaacgggttgcccaaaaacccgtctcgaccttcgccagccgcccccttttgcttccctggctcttgcggcaggtccgtaccggcggggcgcccaccagcgtgtcctaaaaccagtgccgccgtggcgccagagaagccttcccactgcttctaccccccgcgaaagaggaggatctattcccggcgggctgggacaccaccgtgcctagcggacggtggttgtccctctgtcggacccgtttaactgtcctctgcttgctgcgtgcgcgataggcctcttcgcgcgcataaccgggcgcctcacttggcatactctgcaacaact

SEQ ID NO: 53121 - protein, 65 aa, Zea mays
  misc_feature: Ceres CLONE 1472547-F
MPSSGITAVDAAAKGMKLERYASGGALLLRRATSAQLVSPSSHLLLRATAAGPCLALCLSSARLN

SEQ ID NO: 53122 - DNA, 634 bp, Zea mays
  misc_feature: Ceres CLONE 1472549-F
  misc_feature: Encodes the peptide sequence at SEQ ID NO. 53123
ggagctcaccgcggtggcggccgctctagaactagtggatcccccgggctgcaggaattcgtctcacccctagaaaaaccctactattcttcattctactgactctcctcctgacccccatccaccgcttaccaccatgctcttatctgccgctgatcgtctccgcggggtcttcctccgcaagccctctagtcgcaacgtgcttcaccaggcgctatcctccacaggcattggcactaccatggcactgtcgccagaggtgcttgcgaatgtcgtcaacaccagcaacctgaatggtgccgccaccgtgacctactttgattgggcagtcactaactccaagcctcccccatctgtccacacctgcaacatcgtcatcagggcattggggaggaagaaattttttgaccaccttgatgacgcccttcacatcatgcgcagaaacaacatctttccagacctgaccacattggagatcatcgtggatagcttagttgctgccaggcatgtcagtacggctgttgacgtgatcagtaccgatcaatttggatttgggattggaaaaacctggcacagaaaggatgcatttaccatcctcattaggtgtctttgccggaagtcacatgttggccct

SEQ ID NO: 53123 - protein, 166 aa, Zea mays
  misc_feature: Ceres CLONE 1472549-F
MLLSAADRLRGVFLRKPSSRNVLHQALSSTGIGTTMALSPEVLANVVNTSNLNGAATVTYFDWAVTNSKPPPSVHTCNIVIRALGRKKFFDHLDDALHIMRRNNIFPDLTTLEIIVDSLVAARHVSTAVDVISTDQFGFGIGKTWHRKDAFTILIRCLCRKSHVGP

SEQ ID NO: 53124 - DNA, 782 bp, Zea mays
  misc_feature: Ceres CLONE 1472552-R
  misc_feature: SWISSPROT Homolog: EC 2.7.11.1 Non-specific serine/threonine protein kinase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
nnnaacgattgggtacctcgagcgtctcgtttttttttttttttttgaacgaaatctaaccgccaatttacacacggctgaaaatggtcaacaagcttacacgcgctcgacgatctccggccgtcacgcacgtttctgaatgccaccggacatcacacgcacacgacgtttgcaccgaaaccacactttttttttggtcttctatgcggagtgcgactgctgctcgcctgctggccgcgacgccgccgcctccccgtcgctcaagaacgacgaggcggtgctgctgtcgtcagcgccagtgtcgcgctcccggagctcctcgatgcgcgcgagcgcttcctcgaggccccagcgccggtgtcacgtcgggctcgcagcacccgagcccgacctggagcagcttcaccatctccccctcgccgctccgcgtcccacgcatgtccttgtcgaacacctcgccggtccactcctcccgcaccaccgagttgacccagccggcgaggtcggtgtccgcgtggccccgccggagatagttggcggggaacttgcccgtcagcacctccaggatgaggatgcccaggctccacacgtcgctcttccgccccggccgcccgccctgcgccgcgcactcgggggacttgtacgccaccatcacctgcgccgcgtgctgcggcgtcaccacgggggccagcgcgtagtcgctcagcagcggctcgcatgtcgcgtccagcaagacgttgaaaggaactttgaggtgccccgtgcgggcaccatcagcatcg

SEQ ID NO: 53125 - DNA, 638 bp, Zea mays
  misc_feature: Ceres CLONE 1472566-F
ggcggccgctctagaactagtggatcccccgggctgcaggaattcgtctcacccctagaaaaaatcaccaaacaagcaagctagctggtcaccagttgttaacatatacatcagcaagctccacgaaagcaagaagaagaagaaacatgacgaccactgctgcggtcgtcaagctcctgacagccgtactcctcttcttcgccgtctctcttcggggtacgtaaggcctgcaaatcgacctgctcgttgtgcaaactttgtcagtagggcatgtttgcgtagtgacgaaatttcgacaaattctgagacgatttagttcgcttaaatttgaattaagcgccgtaaacacatgcatccaagaacatattgtacatataatctgtagacattattctttgcattggtacccagtacccctaattattgatcatatattcttgaaaggttccagcatttgttaattacgtactgagcaacaggtaccaagggcgagccatgcggcacgtccagcatccacgtgcagaccgtcaacacgggcgcgacggcggctgccggcgacacgctgttcgaggtccaggtgaaaaacctgtgcttatgcagcgtcaggaacgtgcgcgtggacggtggcggcttcgcga

SEQ ID NO: 53126 - DNA, 658 bp, Zea mays
  misc_feature: Ceres CLONE 1472567-F
  misc_feature: Encodes the peptide sequence at SEQ ID NO. 53127
acccgcggtggcggccgctctagaactagtggatcccccgggctgcaggaattcgtctcacccctagaaaaaacagcggcatctataggaaccggtccagcactttcacgatcagctccagcaatggctgcctccaccatggcgatctcctccacggcgatggccggcacccccatcaaggtgggctccttcggcgagggccgcatcaccatgcgcaagaccgtgggcaagcccaaggaggcagagtccggcaacccctggtacggccccgaccgcgtcaagtacctcggccccttctccggcgagcccccgaactacctcaccggcgagttccccggccactacggatggcacaccgccgggctgtccgccgaccccgagaccttcgccaacaaccgcgagctggaggtgatccactcccgctgggccatgctctgcgcgctcggctgcgtcttccccgagctgctctcccgcaacggcttcgagttcggccaggccgtctggttcaaggccggctcccacatcttcagcgaggacgggctggactacctcggcaaccccagcctgatccacgcgcagaggatcctcgacatctgggcctgccacgtcgtgctcatgggtgccgtccagggctacagcattgcctgcgggccgctcc

SEQ ID NO: 53127 - protein, 178 aa, Zea mays
  misc_feature: Ceres CLONE 1472567-F
  misc_feature (61)..(178): Pfam Name: Chloroa_b-bind Pfam Description: Chlorophyll A-B binding protein
MAASTMAISSTAMAGTPIKVGSFGEGRITMRKTVGKPKEAESGNPWYGPDRVKYLGPFSGEPPNYLTGEFPGHYGWHTAGLSADPETFANNRELEVIHSRWAMLCALGCVFPELLSRNGFEFGQAVWFKAGSHIFSEDGLDYLGNPSLIHAQRILDIWACHVVLMGAVQGYSIACGPL

SEQ ID NO: 53128 - DNA, 658 bp, Zea mays
  misc_feature: Ceres CLONE 1472569-F
  misc_feature: Encodes the peptide sequence at SEQ ID NO. 53129
  misc_feature (639)..(639): n is a, c, t, g, unknown, or other
  misc_feature (650)..(650): n is a, c, t, g, unknown, or other
ctccccgcggtggcggccgctctagaactagtggatcccccgggctgcaggaattcgtctcacccctagaaaaactcacaaacctctcctggcacgagatcacgcttctcgtcggatcgaacagctagggtttccaagatgttcgggcgcgcgccgaagaagagcgacaacacacggtactacgagatcctcggggtctccaaggacgcgtcccaggatgacctcaagaaggcctaccgcaaggccgccatcaagaaccaccccgacaagggcggcgatcccgagaagttcaaggagctagctcaggcctatgaggtcctcagtgatcctgaaaagcgagagatttatgatcaatatggtgaggatgccctcaaggagggaatgggaggtggtggagggatgcacgatccctttgacatattccagtcattctttggtggtggaagcccttttggaggtggtggcagcagtaggggcagaaggcagcgaaggggagaggatgtggttcatcctctgaaggtttctctggaggatttgtacaatggcacatcgaagaagctctctctgtcccgcagtgttctctgctccaagtgcaatggtaagggttcaaagtctggagcttcatcgaggtgtgctggnttgccaggttnctggcttt

SEQ ID NO: 53129 - protein, 173 aa, Zea mays
  misc_feature: Ceres CLONE 1472569-F
  misc_feature (13)..(71): Pfam Name: DnaJ Pfam Description: DnaJ domain
  misc_feature (171)..(171): Xaa is any aa, unknown, or other
MFGRAPKKSDNTRYYEILGVSKDASQDDLKKAYRKAAIKNHPDKGGDPEKFKELAQAYEVLSDPEKREIYDQYGEDALKEGMGGGGGMHDPFDIFQSFFGGGSPFGGGGSSRGRRQRRGEDVVHPLKVSLEDLYNGTSKKLSLSRSVLCSKCNGKGSKSGASSRCAGLPGXWL

SEQ ID NO: 53130 - DNA, 661 bp, Zea mays
  misc_feature: Ceres CLONE 1472571-F
  misc_feature: Translation starting site: 254
tagctggagctccccgcggtggcggccgctctagaactagtggatcccccgggctgcaggaattcgtctcacccctagaaaaagggcacgtagccgccgtcgccgcctcgctttctcctcttccgccccaccccggtgaggcgctgatccatcgcctcggacagcggctccagaacctccgcgttgcagtggttggggttggcttcgtgctattcagaaacacagtagcgagaactattcggtggggccgaagatggtgtcgctgaaggtgccaaagcgcctcgccgcaagcgttctcaagtgtgggaaaggcaaagtgtggcttgaccccaatgaagttagtgagatctccatggcgaactcccgccataacatccggaagttggttaaggatgggtttatcatcaagaagcctcagaaaatccactctagatctcgtgcaagaagggcgcacgatgctaagcagaagggacggcactcaggatatgggaagcgtagacgtaccagggaggctaggctcccaccaaggtactgtggatgaagaggatgcccgtgcttaagcgcctgctccgcaagtacggccaggcccaaaagatcgacagcacatgtaccacgatatgtacatgaaagtccaaagtaactccttcaaaacagaaggtgg

SEQ ID NO: 53131 - DNA, 684 bp, Zea mays
  misc_feature: Ceres CLONE 1472576-F
  misc_feature (554)..(554): n is a, c, t, g, unknown, or other
agatctggagctccccgcggtggcggccgctctagaactagtggatcccccgggctgcaggaattcgtctcacccctagaaaaaacaaagccttcttcccgccctcccgaatcgctccctctctgtccctccgctccagacgccgccggcggatccgccctccgaatcccggaggggtccgctgccgctcatccaacctccctctccctcacggccagcgcggacaccatggcacccaccgaccgcctcccccccgctgcgccggggaggactccccacagcctgtctatccgggatggcgttggggtttcccggattgtgttgggcggattctcggtcctctttggggccggatgttgtctttccccccccccccgggggggggggggggtggcaccccggctgaacagattcgtgaggccccccccagaagatgatcttacggtggaaagggggggttggtccgggctgtgctcctagaaccagccgaggagcaacgtaaacttcccggaagaacccccccgctacctgggtgcgggcggaggcgctggacngcgctccttgagccatagagaccttgcggccacgcggccgcccgcctcacgctgggccccccgtaagccggccacgcggatcacccccgcacgtctggtggaacttttgtctggcaataaaacaaagaaa

SEQ ID NO: 53132 - DNA, 682 bp, Zea mays
  misc_feature: Ceres CLONE 1472583-F
  misc_feature: Encodes the peptide sequence at SEQ ID NO. 53133
aagctggagctccccgcggtggcggccgctctatcctagaggatcccccgggctgcaggaattcgtctcacccctagaaaaagcgttgtgcgtcttttcctcagcagcaaccggagagcggctgctcgcctgctcctcctcctagggaaaggacagcggcggcggcggcggcggcgagaagttgggcctgaagcccggacgctttctcccgagataccgcaatactgctagagcactgtcactaatgtttgcttatgacaatggagtcacctacaactgccgctggtggtgaactggagagctacttctccttgggtttgacagtatcccactcacagaaagataatgctgaatttccagaggttctgttgcttctctcaacggatcttgacaagacagttcagcagaatgaagagttactagactccagtataataaaggagtcgaccactatctttcatggtcagagggtgcctgaacttaatataaagctgtatgcaaagcgtattttcaagtatgcatagtgcagcccatcttgctttgggctatgacttatctaactggagagatatctacaacacccaaacttttacatggacgcatttaatgttctccgcctgcttattaacaggggtggttgttcctccccaaatcctaagatgaagccgtttgtccataatgg

SEQ ID NO: 53133 - protein, 87 aa, Zea mays
  misc_feature: Ceres CLONE 1472583-F
MESPTTAAGGELESYFSLGLTVSHSQKDNAEFPEVLLLLSTDLDKTVQQNEELLDSSIIKESTTIFHGQRVPELNIKLYAKRIFKYA

SEQ ID NO: 53134 - DNA, 638 bp, Zea mays
  misc_feature: Ceres CLONE 1472584-F
  misc_feature: Encodes the peptide sequence at SEQ ID NO. 53135
tggcggccgctctagaactagtggatcccccgggctgcaggaattcgtctcacccctagaaaaaagtgcttccagagagcctgaccgaccatccacaagcagctagcgtagcgagcgatggccaccgaactccagtcgccgctgctccctccgccaccgctgccgccgcagcgacgactaagcccgcgggcagccgcatgggcggcgctcgccgtctcggcgacggtcctgctcctccccttcctgatcggcagcaccaccaggaccaccagcagcagcagcacgagacacccccggcctcgatcctccccaccatccaaccccgtggagctcacgctcctgaccgccgcccgcgacaagggcgcggtgtgcctggacgggagccccccgggctaccacctgcaggcggggtccggcgccgggtccggcagctggctcatccatctcatggggggcggctggtgcgacaccgtccgcagctgctccgaccgcaggacgacctacctcggctcgtccctcttcatgcagaaagtcatggacttcactggcattctcagcaacgacccggcacagaatcctgatttctacagctggaacagagtgttcgttaggtactgcgacggggcatcgttttcggg

SEQ ID NO: 53135 - protein, 173 aa, Zea mays
  misc_feature: Ceres CLONE 1472584-F
  misc_feature (46)..(173): Pfam Name: PAE Pfam Description: Pectinacetylesterase
MATELQSPLLPPPPLPPQRRLSPRAAAWAALAVSATVLLLPFLIGSTTRTTSSSSTRHPRPRSSPPSNPVELTLLTAARDKGAVCLDGSPPGYHLQAGSGAGSGSWLIHLMGGGWCDTVRSCSDRRTTYLGSSLFMQKVMDFTGILSNDPAQNPDFYSWNRVFVRYCDGASFS

SEQ ID NO: 53136 - DNA, 635 bp, Zea mays
  misc_feature: Ceres CLONE 1472588-F
  misc_feature: Encodes the peptide sequence at SEQ ID NO. 53137
  misc_feature (613)..(613): n is a, c, t, g, unknown, or other
gctctttactaaaggatcccccgggctgcaggatttcccctcacccctagaaaacctagaaaaaacagtacagtcgctgcagcgaatgggggatcgcgcgaggcgagatggagctctcgccggtggggaggtgggccgacctccccgaggacatcgccgtagccgtcgcctcctgcctccaggaggccgacgtctgcgcgctcggcggctgctcgcgctcctggcgcagagcctgcgacgctgactgcatctgggagcgcctcttccgctgccgctggccatctgccgtggcgtcggcgtcccctgtgcaggtaccgcaaagaagggtaaagggatggaaagctctctacatcagccagcacagaagaatggctgttgcaatatctaatgtggttgaatttgtgggcagcagcttaaataatgagtcacttgaatccgaatactatctgaaagctattgctgatttggccttgatacctgatataggattcctcgatgtccagtttttcttgttctcaaggaatcatagtgcgataatcaaccttattgaactgcactactccatcgcatctttgcatgtgctgccaactgatatcattatagcactccctgntcaccgagtatcacaatgggtt

SEQ ID NO: 53137 - protein, 176 aa, Zea mays
  misc_feature: Ceres CLONE 1472588-F
  misc_feature (7)..(54): Pfam Name: F-box Pfam Description: F-box domain
  misc_feature (169)..(169): Xaa is any aa, unknown, or other
MELSPVGRWADLPEDIAVAVASCLQEADVCALGGCSRSWRRACDADCIWERLFRCRWPSAVASASPVQVPQRRVKGWKALYISQHRRMAVAISNVVEFVGSSLNNESLESEYYLKAIADLALIPDIGFLDVQFFLFSRNHSAIINLIELHYSIASLHVLPTDIIIALPXHRVSQWV

SEQ ID NO: 53138 - DNA, 670 bp, Zea mays
  misc_feature: Ceres CLONE 1472589-F
  misc_feature: Translation starting site: 425
ccccgcggtggcggccgctctagaactagtggatcccccgggctgcaggaattcgtctcacccctagaaaaaacgccacgctctccaacgccacagcttgcgcccgcaatggcactcgtctccgcctcctcatcctccaccaccgccgtcgcggcgctccccaggaatgggcagcgggcgtcgtcctccttcctcggcggctagacgctgctgagacagggcgagggggcccggacgtcgatcgccgtgcgcgccgcgtgcggaccccaacaggccgatctgggtccccggcagcacccctccgccgtggtctcgacggcagccttcccggcgacttccgctttgatccctggaggcctcggatctgacccagagagcctgacgtggaacgtgcgggcggacctggcgcactgacggatgggcgatgctcggctcggcgggcatcttcatcccggagtgcctgaccaagatcggcgtcctcaacacgcccttcaggtacaccgccggcgagacagaatacttcaccgagacctccaccctctgcctcatcgagctcatcctcatcagctgggccgagggccgccgctgggatgacatcatcaagcccggaagcgtcatgaccgaccccatcttccccagcgacaggctcaccggtgccgacatccggtac

SEQ ID NO: 53139 - DNA, 659 bp, Zea mays
  misc_feature: Ceres CLONE 1472593-F
  misc_feature: Encodes the peptide sequence at SEQ ID NO. 53140
  misc_feature (501)..(501): n is a, c, t, g, unknown, or other
  misc_feature (502)..(502): n is a, c, t, g, unknown, or other
  misc_feature (577)..(577): n is a, c, t, g, unknown, or other
ggagctccccgcggtggcggccgctctagaactagtggatcccccgggctgcaggaattcgtctcacccctagaaaaaaccagccgcggcacacccgcggaaccgccgctcgagctcgcgcctgaaccccccaaactctgccaaatttcgccaaacccagccggtcggaccccgcaacacatcgccaaaccaaccgggccggccgacacaagccgcagcccgtggcgatggacctggcgtcgagcgaccttgcggcgctgggcgcggcggagctggtccgcgtctcggcgtcgatcccgcgcgcggctccccgcaccttcgcgctgctcaccgcctgcctcgtcttcccgctctccttcgccgtgctcgcgcactccctcttcacccaccccatcctgctccgcatccagggcgccacccactccgagctagcgcagtggctcaggctcttcgcctacccagtcctctacctcatcgtcctcttcgacttctccctcctcnntcacggacgcgccgtcttcaccgtcgcctcgctctacgccaacaagcccgcgtccatctcctcctcgatcaccgngctggccccccatcctgccccgcctccttccggaacttcctctgggtctcccttcccatgcctcccctaacaactcgtcttg

SEQ ID NO: 53140 - protein, 139 aa, Zea mays
  misc_feature: Ceres CLONE 1472593-F
  misc_feature (92)..(92): Xaa is any aa, unknown, or other
  misc_feature (117)..(117): Xaa is any aa, unknown, or other
MDLASSDLAALGAAELVRVSASIPRAAPRTFALLTACLVFPLSFAVLAHSLFTHPILLRIQGATHSELAQWLRLFAYPVLYLIVLFDFSLLXHGRAVFTVASLYANKPASISSSITXLAPHPAPPPSGTSSGSPFPCLP

SEQ ID NO: 53141 - DNA, 659 bp, Zea mays
  misc_feature: Ceres CLONE 1472594-F
  misc_feature: Translation starting site: 159
ctccccgcggtggcggccgctctagaactagtggatcccccgggctgcaggaattcgtctcacccctagaaaaaactcgccaatcctcaaatctgtccttgtcgccgccactgccctatccaggtgtggatactgctccctcctcctctccgctccgaatggcccgtacgaatcatacggagcgcaggtctaccggcggcttggcgccgcggaagcagctggccaccaacgcggcgcgcaagtccgccccggccacgggcggcgtgaagaagcctcaccgcttcctccccggaaccgtcgagctccgcgagatccgcaagtaccatatgagcactgacctgctcatccgcaagctccccttccagcgcctcgtccagcaagatcgctcaagacttctagacagacctgccgttccagtactcgggctcggtggcgctgcacgtacgcctcggacgcgtacctggtggggctcttcgaggaccttacctctgcgccatcctcgccaagagggtcaccatcatgccctaggacatccaactcgcccgtcacttcacgggcgatagggcttgaactgtcccgctgctgctgttcatcgtatgaatgtctgaagtagatgggggagggtgctttctatgacgtgactatttggctacttcgga

SEQ ID NO: 53142 - DNA, 647 bp, Zea mays
  misc_feature: Ceres CLONE 1472595-F
  misc_feature: Translation starting site: 168
  misc_feature: SWISSPROT Homolog: EC 5.2.1.8 Peptidylprolyl isomerase
ggagctccccgcggtggcggccgctctagaactagtggatcccccgggctgcaggaattcgtctcacccctagaaaaaggcagaaccgcagaagtgcagcagaacgatcggatctagcagaattctctcaacctcatcggcggcggcgaagagcgtgcggatcggagatggagacaagcgggtggaggaggagagcggcggcgcgggcctcctggagccccgccacggtgtacctgtggctcgcgctcgccgcagcagcactgacgctcgcccaggctaagaaggacctaacggaggttacccacaaggtctacttcgatgtcgagattgacggcaagcccgcaggtcggattgtcatggggctttttgggaagactgttcctaagacagcagagaacttccgagctctttgcacaggagagaaaggaattggcaagagtggcaaagctctccactacaagggaagtacattccacagaatcattcccagcttcatgctccaaggaggtgacttcactcttggggatgggagggggtggtgaatctatctatggcatgaagtttgctgatgagaacttcaagatcaagcacactggaccaggccttctgtccatggccaatgctgggagagatacaaacggatctcc

SEQ ID NO: 53143 - DNA, 682 bp, Zea mays
  misc_feature: Ceres CLONE 1472599-F
  misc_feature (310)..(310): n is a, c, t, g, unknown, or other
  misc_feature (362)..(362): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (389)..(389): n is a, c, t, g, unknown, or other
  misc_feature (415)..(415): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (431)..(431): n is a, c, t, g, unknown, or other
  misc_feature (435)..(435): n is a, c, t, g, unknown, or other
  misc_feature (459)..(459): n is a, c, t, g, unknown, or other
  misc_feature (461)..(461): n is a, c, t, g, unknown, or other
  misc_feature (475)..(475): n is a, c, t, g, unknown, or other
  misc_feature (478)..(478): n is a, c, t, g, unknown, or other
  misc_feature (496)..(496): n is a, c, t, g, unknown, or other
  misc_feature (519)..(519): n is a, c, t, g, unknown, or other
  misc_feature (579)..(579): n is a, c, t, g, unknown, or other
  misc_feature (610)..(610): n is a, c, t, g, unknown, or other
  misc_feature (658)..(658): n is a, c, t, g, unknown, or other
ggagctcaccgcggtggcggccgctctagaactagtggatcccccgggctgcaggaattcgtctcacccctagaaaaatccccgccccgggcaccgcgagctagctagctactgacacccggcgccggcgccgagtaccatacatggaaagcagcatggtgttcgagcagcatgaaaaggaggcggtggcgccggtcagcgtgaaaggacgtcggctctccaaggtgatgccaagctcgatgacgggggagggggactacgccctggaagacacagacaggatctattgattgctctaacagaaagaggngtaatgagaaggtgcgggggttgttgccggctggctggaggctgaagaacanctgctccatagtgtagnnnnnnnnatncactagggggtattttaaagagtcancaacnnnaaaagcggncccnagggctattacccaatggatatancntggggagagggccnaanccctaagggtgagacccntccaaggcttaggggttttccanaatgatattaaattgctgttcttggccgagcaggcttttcgccttcagtttgaaaaaaancttctggtgcccacgactcgtgaattttgtngaatcctcagggttgctcatatgttttgtttagacaagtccggagcangtggtaactaaaagccatagaaaa

SEQ ID NO: 53144 - DNA, 755 bp, Zea mays
  misc_feature: Ceres CLONE 1472600-F
  misc_feature: Encodes the peptide sequence at SEQ ID NO. 53145
  misc_feature (22)..(22): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (410)..(410): n is a, c, t, g, unknown, or other
  misc_feature (755)..(755): n is a, c, t, g, unknown, or other
aggtttttgtctccccctactngggaggttattttattattttnnnnnnnnntaatctgggggtccacgcgggggcggccgctctagaactagtggatcccccgggctggagggattccgctcacccctaggaaaaatagggggagagcaggtccggtatggcggtcccgtacctctctagattcacacggctcaggaggctcggttctgctcctcacctcgtcgccagccgtgggcgagatcttcgatcggaatcatcggctgcggagggatcggcttgctcggggccagggtcgccttgcagagataggatgtcgagctcgtaggcgtcaacgatcccttcgtcccggcgggtggcatgccctacatgttggagtgcgacaccgcggacggccaatggaatgagagcntcatcatcctcaaggactccaagacgcttctcttcggcgagaaggaggttgtcgtctttgcgatgcagacccccgacgacaccccgtggcgtgaggctggtgctgagtatagcgtggaggcgacctgtgtcttcgctggcaaggtcggggctgctgcacagctagaagggtggggccccggagggtagttgtccctgccccaagcggggatgcatcctttgtttagggggaggggggcaattgaggacatgttacacgctccgtatgttagcatttgtttcccggtgcttggttgtggctttgaacagcttttggctcccccttggttggggggcttttcctgan

SEQ ID NO: 53145 - protein, 79 aa, Zea mays
  misc_feature: Ceres CLONE 1472600-F
  misc_feature: SWISSPROT Homolog: EC 1.2.1.12 Glyceraldehyde-3-phosphate dehydrogenase (phosphorylating)
  misc_feature (18)..(18): Xaa is any aa, unknown, or other
MPYMLECDTADGQWNESXIILKDSKTLLFGEKEVVVFAMQTPDDTPWREAGAEYSVEATCVFAGKVGAAAQLEGWGPGG

SEQ ID NO: 53146 - DNA, 656 bp, Zea mays
  misc_feature: Ceres CLONE 1472607-F
  misc_feature: Translation starting site: 174
  misc_feature (1)..(1): n is a, c, t, g, unknown, or other
  misc_feature (293)..(293): n is a, c, t, g, unknown, or other
  misc_feature (352)..(352): n is a, c, t, g, unknown, or other
  misc_feature (615)..(615): n is a, c, t, g, unknown, or other
nagctggagctccccgcggtggcggccgctctagaactagtggatcccccgggctgcaggaattcgtctcacccctagaaaataccaccagtaccacaccactccgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagaagtcgtcgtcncagggcatccgctgcgactacatcggctccgccaccacctgatcatggtgacgacgacnacgctgatgctgttcgcggggcggttcgggctggcgccgtcggcaaaccgcaagcgacggcggggctgaagctggaggcgcgcgactccggcctgcagacgggtgacccccgcgggtcaccctcgcaacacgctgggctggcggcgcgtccggcacatcctcggggtcgggatcgtgctcgggctcaagaacaccgggcccctcaaccagatcatcgggtagaatcctacgtcctcgttgttaaaataagactcacagcttcnatcccccccccggccgggaagggcctgcaggtggtaacttt

SEQ ID NO: 53147 - DNA, 659 bp, Zea mays
  misc_feature: Ceres CLONE 1472612-F
  misc_feature: Encodes the peptide sequence at SEQ ID NO. 53148
  misc_feature (364)..(364): n is a, c, t, g, unknown, or other
  misc_feature (398)..(398): n is a, c, t, g, unknown, or other
aaagctggagctccccgcggtggcggccgctctagaactagtggatcccccgggctgcaggaattcgtctcacccctagaaaaaaggccaccaccacaccacaccacaccacaccaccggcggcggcggcgacccagtcgagaacacgaaggcgatggcgacagcgctgaaccgcgggctccgcctcctcgccgccggcgccgaggcgtccaagccagcttctcgtggattccatgccaccggcgtgaagagaatgggagggcatggccatgatgagccatactacatccatgccaagcacatgtataacttgcacaggatgaagcatcagggtttgaaggtgacactctccgtgctgggagcngttggcatcggtgttggagtccctgtgtatgcantcatattccagcagaagaagactgcctctggctgagatgatgcctctcgctgcctgcatatggagacttattttgagcgacatttttttgaggtaaaaagctggactcatcctatcttgggtgttgcctgatactgcattttctaccataagttgtaccctcgtttcttgcggtttgtgtaggaccaacttttctgtaataatgttgggggctggactttcagggttgtgaagatggggaaaacccgccctgatacatttg

SEQ ID NO: 53148 - protein, 92 aa, Zea mays
  misc_feature: Ceres CLONE 1472612-F
  misc_feature (82)..(82): Xaa is any aa, unknown, or other
MATALNRGLRLLAAGAEASKPASRGFHATGVKRMGGHGHDEPYYIHAKHMYNLHRMKHQGLKVTLSVLGAVGIGVGVPVYAXIFQQKKTASG

SEQ ID NO: 53149 - DNA, 683 bp, Zea mays
  misc_feature: Ceres CLONE 1472613-F
  misc_feature: SWISSPROT Homolog: EC 3.2.1.23 Beta-galactosidase
  misc_feature (224)..(224): n is a, c, t, g, unknown, or other
  misc_feature (227)..(227): n is a, c, t, g, unknown, or other
aaagctggagctccccgcggtggcggccgctctagaactagtggatcccccgggctgcaggaattcgtctcacccctagaaaaatttttccccatatttattgtgttgcgtctgctgtagtttctaattttctagatgtgctttcggtttggtctgtagaccctgcagcttgatttggtaaattttattttatccaagggaaatgggttggcggttatttcttnttnattccatgccacccgacataaaaaggaaaaaaaagaaatggaccgagacgctcgaggtacccaattccccctatagtgagtcgtattacccgcgctcactggccgtcgtttttacaacctcgtgactgggaaaaccctggctttacccaacttaatcgccttggagcacatcccccttttccccagctggggtaataccaaagagccccgcaccaatcccctttcccaaaatttggccaccttgaatggcaaaggaaattttgaaactttaaattttgttaaaaattccccttaaattttttgtaaaaccacctcatttttttaaccaaataggccaaaaatcgggaaaaatccccttataaaacaaaaaaaatacccccaaaataggggttgaggtgtttttccccattttgaaaaaaaaaaccccttttttaaaaaaaccggggactccacacg

SEQ ID NO: 53150 - DNA, 697 bp, Zea mays
  misc_feature: Ceres CLONE 1472614-F
  misc_feature: Encodes the peptide sequence at SEQ ID NO. 53151
  misc_feature (376)..(376): n is a, c, t, g, unknown, or other
aaagctggagctccccgcggtggcggccgctctagaactagtggatcccccgggctgcaggaattcgtctcacccctagaaaaaagcctccgcccatacacacacaggccccatcccgccgccgcaggcgagaaccagcgccaccttaggttaggggcggccgccgccggagaagtgcggcggttgcaagatgcagatcttcgtggagaccctgacggggaaagacatcacgctgggagtggagtcctcggacaccatcgacaacgtggaggccaagatccaggacaaggagggcatcccgccggaccagcagcgcctcatcttcccgggcaagcagctcgaggatggccgcaccctcgccgactacaacatccanaaagagtcgacgctgcacctggtgctccccctcaggggaggcccccacaaagcgcaagaagaggacttacaccaggccccaaaaagatccaccccaagccccaggaagggtgaagctcgcccttgctccatttctacaagggttgacgacccccaccgggaaaggcccccccgcctcccgaaggggagtgcccccaaccgcccaagtgcgggcgcggggggttcttcttgggccaaccatttttcaaaccgccaattatgggggggtaagtttggccctcacccttacttcttaaaaaccaaggggggggttatgaatccc

SEQ ID NO: 53151 - protein, 169 aa, Zea mays
  misc_feature: Ceres CLONE 1472614-F
  misc_feature (6)..(74): Pfam Name: ubiquitin Pfam Description: Ubiquitin family
  misc_feature (62)..(62): Xaa is any aa, unknown, or other
MQIFVETLTGKDITLGVESSDTIDNVEAKIQDKEGIPPDQQRLIFPGKQLEDGRTLADYNIXKESTLHLVLPLRGGPHKAQEEDLHQAPKRSTPSPRKGEARPCSISTRVDDPHRERPPRLPKGSAPNRPSAGAGGSSWANHFSNRQLWGGKFGPHPYFLKTKGGVMNP

SEQ ID NO: 53152 - DNA, 665 bp, Zea mays
  misc_feature: Ceres CLONE 1472617-F
  misc_feature: Encodes the peptide sequence at SEQ ID NO. 53153
  misc_feature (373)..(373): n is a, c, t, g, unknown, or other
aagctggagctccccgcggtggcggccgctctagaactagtggatcccccgggctgcaggaattcgtctcacccctagaaaaagaggatgcgacagcgagcagcggtgtcgatttttagggcattgtgatttgttgagaaattcgtagggtatacgaaaacctctccgccgaactcctgcagatcctaattaacctccaccagctgcaccaattgccgctggcgatggatggtagcggacgagctctcgattgccgcagcttctggaaggccggcgcgtacgaacccccactgctccgacaggggagttcaagatgtccttgagaccggagacttcgaccgcgcgcgcgtgcaccccaagttcctccacaccnacgccacctcccagaagtgggctttcggaggttcgtgatgccctcggatggttcaatcttattggggtaccttaataaggccaacgtttaggcaaaaaaaaaaaaaaaacgagacgctcgaggtacccaatttccccctaaagtggctcgtattacccgccgctccactgggcccttttttttaaacggtcgtggctgggaaaaaccctggggtttacccaactttaatccccttggaggaccttcccccttttccccggttggggaaataaccaaaaaggcccgcccccat

SEQ ID NO: 53153 - protein, 60 aa, Zea mays
  misc_feature: Ceres CLONE 1472617-F
  misc_feature (49)..(49): Xaa is any aa, unknown, or other
MVADELSIAAASGRPARTNPHCSDRGVQDVLETGDFDRARVHPKFLHTXATSQKWAFGGS

SEQ ID NO: 53154 - DNA, 664 bp, Zea mays
  misc_feature: Ceres CLONE 1472622-F
  misc_feature (436)..(436): n is a, c, t, g, unknown, or other
  misc_feature (443)..(443): n is a, c, t, g, unknown, or other
aaagctggagctccccgcggtggcggccgctctagaactagtggatcccccgggctgcaggaattcgtctcacccctagaaaaaattcatcagtccagcaggctccgcatccggctccgtaaaacgcacggcctgtacctgcactccccatttccacgctttctctctcctctccgcagctctctgcgtgcgcgcgcggctgctcgcgggccccaggtgtcatagactgcatgcggagtgggatgtggagtgttgctggaaacggagacggatacggagaggagagagaaactgttgaccgcgcgtcttatggatacggacaaggagtctgctggagttggtcttagagcccggagagctggagaagctagctagcgtgcttacagaataacagcagccaagcaaagccaagggtgtgtatataatagacatgccnttgagtngtgtcagctgccactgtatgtatagtttaaacgaagatgaaatggtactgatggtgatattccgtgttttaaaaaaacaaaaaaaacgagacgctcgatgtacccaattcgccctatagtgagtcgtattacgcgcgctcactggccgtcgttttacacggcgagactgggaaaccctggcgttacccaactaatcgccttgcagcacatccccctttcgc

SEQ ID NO: 53155 - DNA, 656 bp, Zea mays
  misc_feature: Ceres CLONE 1472624-F
  misc_feature: Encodes the peptide sequence at SEQ ID NO. 53156
  misc_feature (397)..(397): n is a, c, t, g, unknown, or other
ggagctccccgcggtggcggccgctctagaactagtggatcccccgggctgcaggaattcgtctcacccctagaaaaacctagaaaaaaagccgccgccgctcttccacctacctctccccggcctcgcacccatggccacggctttgatggttgcagccaccacctcctgctccccgggccgcgccgcgccgcgcctgaaaccggtggcctcctcctcctccagcagcagcagcagcagctcggcgcggacgcggcggcccttggcgcatcagctcccgcggctgctggcgacggcggcagcggcggcggtagcagccgcgccactcccggcgctggcggagcatatggagaacgccgcactgtttgacttcaacctgacgctcccggcgatcgcnaccgagttcctgctgctcatggtggcgctggacatgctctacttcacgccgctaagcaagttcatggatgagcgggacaccaatatccgcgatgagctctgcgatgtcaaggccgcttccgaggaggtgaaacatctggacgaccaggcggcggccatcatgaaagccggcgcgcgccgagatcgcagccggctcttaacaagatgaataatgatacacccgcggagctggaggccaacctggacaatggacgctgccg

SEQ ID NO: 53156 - protein, 156 aa, Zea mays
  misc_feature: Ceres CLONE 1472624-F
  misc_feature: SWISSPROT Homolog: EC 3.6.3.14 H(+)-transporting two-sector ATPase
MATALMVAATTSCSPGRAAPRLKPVASSSSSSSSSSSARTRRPLAHQLPRLLATAAAAAVAAAPLPALAEHMENAALFDFNLTLPAIATEFLLLMVALDMLYFTPLSKFMDERDTNIRDELCDVKAASEEVKHLDDQAAAIMKAGARRDRSRLLTR

SEQ ID NO: 53157 - DNA, 645 bp, Zea mays
  misc_feature: Ceres CLONE 1472641-F
  misc_feature: Encodes the peptide sequence at SEQ ID NO. 53158
tccccgcggtggcggccgctctagaactagtggatcccccgggctgcaggaattcgtctcacccctagaaaaatccgcgctccgccccccggaatcggaccaaagccgggcatacgcccccaagtccaaaagccctctccgccccgctctcccactcgtaggtgttctccccgtctccgcccgcactcgctcgtccgcgcgcaggaaggttgacctgtcgagggccggcgaacccggtaagtaagagtgaaaatggatggaagtagtaaagggagtgggcattctgaagcattaaggaactacaacctgggaagaactttaggtatcggtacatttggaaaagtgaagattgcagagcataagcttactggacatagggttgctataaagatcatcaactgccgccaaatgagtaatatgaaaaagaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgaagcacatccccctttcgccagctggcgtaatagcgaagaggcccgcaccgatcgccattccccacagttgcgcagcctgaatggcgaa

SEQ ID NO: 53158 - protein, 131 aa, Zea mays
  misc_feature: Ceres CLONE 1472641-F
  misc_feature (80)..(131): SWISSPROT Homolog: EC 3.2.1.23 Beta-galactosidase
  misc_feature (1)..(61): SWISSPROT Homolog: EC 2.7.11.1 Non-specific serine/threonine protein kinase
MDGSSKGSGHSEALRNYNLGRTLGIGTFGKVKIAEHKLTGHRVAIKIINCRQMSNMKKKKKNETLEVPNSPYSESYYARSLAVVLQRRDWENPGVTQLNRLEAHPPFASWRNSEEARTDRHSPQLRSLNGE

SEQ ID NO: 53159 - DNA, 689 bp, Zea mays
  misc_feature: Ceres CLONE 1472645-F
  misc_feature: Encodes the peptide sequence at SEQ ID NO. 53160
ggagctccccgcggtggcggccgctctagaatagtggatcccccgggctgcaggaattcgtctcacccctagaaaaatcatcatccagtgctctctcctcttgcgattcgctcgctcgatcctagcttcccttccaagaagcgcagcgcccatggccatggccacgcaagcctccgccgccacgcgccacctgctggccgccgcctgggcgccggcggcgaagccgcggcagctgagctcgcagctcgcgctgccgtcgtcgtcctcccgcgggcgggcccgctcggcgcgtccaccgaggaagcggttgaggcgcccaagggggttcgtggccccgcagctgggacccagcacgccgtccccgatcttcgggggcagcacgggccgggctgctccccaaaggcgcagggtggagaacttctacgtcatcacggggaacgtcccccaaaggagcagggtgttcaagatgcccacccgggggcccccgccatcattggggggagggcccccaaccctcttttaaacctgggcccccaaaggaacaattgccctgggcccctcggcaacccggtttgccgcttccaaggtaacaaaatcccccttaaccagtttctaaccggggtcctttcccccaaaggggggaaggggtggcaaatacccttccaccccccaaagggaacggggggtcc

SEQ ID NO: 53160 - protein, 123 aa, Zea mays
  misc_feature: Ceres CLONE 1472645-F
MAMATQASAATRHLLAAAWAPAAKPRQLSSQLALPSSSSRGRARSARPPRKRLRRPRGFVAPQLGPSTPSPIFGGSTGRAAPQRRRVENFYVITGNVPQRSRVFKMPTRGPPPSLGGGPPTLF

SEQ ID NO: 53161 - DNA, 651 bp, Zea mays
  misc_feature: Ceres CLONE 1472652-F
  misc_feature (227)..(227): n is a, c, t, g, unknown, or other
ggagctccccgcggtggcggccgctctagaactagtggatcccccgggctgcaggaattcgtctcacccctagaaaaagcagaatcaggtccgtctccaactcactagtactcagccgccgcaatcaggggggcaggtagctcgagcgcgcgctccacctgcgccgacgcgatgcgggccaagtggaagaagaagaggatgcggaggctcaagaggaagcgccgganaatgaggcagagatctaagtaggcgcatcttgtgaccgaggatggcgagcttctcctgcaccatggctgtgacgcgttgggatgattgtctccctttgtagacgtgctttgctgtagacgtacgcgatgtaacccgtcctttttgattaattctagtactgtctgagactgggttcataatgcacttgagggatattttttgaagctctaggttaataaaaagaaaaaaaaaagaagccgctcgagggacccctttcgccctaaagggagtcaaattacccccgctccctgggcggcttttttacacctcctggatggggaaaccccgggggtcccccattttaaggccctgggaaacatccccctttttccccagtggggaaaaaaaaaaaaggcccccccccttttcccctttcccaaaatg

SEQ ID NO: 53162 - DNA, 662 bp, Zea mays
  misc_feature: Ceres CLONE 1472656-F
  misc_feature: Encodes the peptide sequence at SEQ ID NO. 53163
  misc_feature (439)..(439): n is a, c, t, g, unknown, or other
  misc_feature (517)..(517): n is a, c, t, g, unknown, or other
aagctggagctccccgcggtggcggccgctctagaactagtggatcccccgggctgcaggaattcgtctcacccctagaaaaaaaaaaaatatgagaagtttgaagaagctcaggctgcaataaaagaactggatggagctgagctttatgaacaaaaaatgagtgttgattgggcctttagcagtggccctgctaagcgcagatttactcggaaaagatcaccaccaagggctcgttcaaggaccccacccaggagaaggcactgatgtttccccagcaagtcatgaatttactatgcgtgatgtagtgaaagaagtctggggatttcaattctcaaatgttagcttggtgtatgtgtatccggctttgagttgatggacacatggagttacttagccgcataccattacgttcggcatgccagttggagactattgnaagcgatgtttttttttttttttggtctttgacaagtggcggtgttggatttttatgttcgtgtgtcccttcactttngtatcgccattctgacaagtgatgctttgggttttcaaaaaaaaaaaaaaaacgagacgctcgaggtacccaattcgccctatagtgagtcgtattacgcgcgctcactggccgtcgtttttacacgtcgtgactggggaaaacc

SEQ ID NO: 53163 - protein, 35 aa, Zea mays
  misc_feature: Ceres CLONE 1472656-F
MSVDWAFSSGPAKRRFTRKRSPPRARSRTPPRRRH

SEQ ID NO: 53164 - DNA, 655 bp, Zea mays
  misc_feature: Ceres CLONE 1472657-F
  misc_feature: Encodes the peptide sequence at SEQ ID NO. 53165
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (559)..(559): n is a, c, t, g, unknown, or other
  misc_feature (560)..(560): n is a, c, t, g, unknown, or other
  misc_feature (617)..(617): n is a, c, t, g, unknown, or other
ggagctccccgcggtggcggccgctctagaactagtggatcccccgggctgcaggaattcgtctcacccctagaaaaagtctttcttctgctcttccatcgcgccagtgttttgagaagctggtcggcgctcctagatcccttcgcctctctcgcgttcgaggctaggtagccgccaccatgagccgctcggggcagcctccggatctcaagaagtacatggacaagaagcttcagattaagctgaatgcaaaccgtgttgttattggcacacttcggggattcgaccagttcatgaatctggtgatcgacaacactgtggaggtcaatggaaatgacaagacagatattggaatggtggttatcaggggaaacagtgttgtcatgatcgaggcactggagccagttgccaagtcgcagtgaatccttatttttcagctgatatagtcgcagcatgaaaactgatgtaaatgctatgagtgaaccctggtcgtactcggactcgtgcttttgcacagcaacataactcggctaccagcacccctgtttcgnnnnnnggnngctaagaaatttgagttttgggggtctcaagagatggatgggtttaaactggtgtanggggccagccggtgggagccacctgtccccctttgagg

SEQ ID NO: 53165 - protein, 80 aa, Zea mays
  misc_feature: Ceres CLONE 1472657-F
  misc_feature (8)..(72): Pfam Name: LSM Pfam Description: LSM domain
MSRSGQPPDLKKYMDKKLQIKLNANRVVIGTLRGFDQFMNLVIDNTVEVNGNDKTDIGMVVIRGNSVVMIEALEPVAKSQ

SEQ ID NO: 53166 - DNA, 670 bp, Zea mays
  misc_feature: Ceres CLONE 1472660-F
  misc_feature: Translation starting site: 105
aagctggagctccccgcggtggcggccgctctagaactagtggatcccccgggctgcaggaattcgtctcacccctagaaaaagtgtttgattccgaggcggggatgacgagcccaatggtggccaccccggtccagttccacacaaccggccgcctcagcttctgctccttttcctttcccagcgcatcagggaggcggcgattcgcggcggtgagggcgtccgcggagacgatggcgacggagaagctgggcatcaaggtggagcgcaacccgcccgagtcccgcctctccgagctcggcgtccgccagtggcccaagtaagtgagcgagcgtgcgagccgccctccctccctcccaggcggagtctcgatctcgaatctccccgccgccctccgcccgctccgtgcccgtgctgactgcggcctgctgatgaatgaatggaccgatcaggtgggggtgcgagaagagcaagttcccgtggacctactccgccaaggagacgtgctacctgctgcaggggaaggtgaaggtgtaccccgaacgcacggagaagagttcgtggagatcggcgcgagagaccttgtcgtcttcgccaagggcatgagctgcacctgggacgtcgccgaagtcgtcgactagcactacaacttcgagtagccgccgccgcc

SEQ ID NO: 53167 - DNA, 549 bp, Zea mays
  misc_feature: Ceres CLONE 1472663-F
  misc_feature: Translation starting site: 204
  misc_feature (138)..(138): n is a, c, t, g, unknown, or other
ttttcctagatccccgggctgcaggaattccctccccctagaaaaagtgctctctcagaggtgggctggcttctcctccccctcttaccagtcctcctcgggttagggttccttaggttttgtggaggggcgatggcngcggctgatgtggagtaccgttgcttcgtcggcgggcttgcctgggccaccacaacagcgctgagatgctcgctctacggaaatcccgatccagggattcccaccggaacgggaggctcccgggtttcggttttttaaccttcccccccgaaaaccccggcccccctttgaaaaaagaaggggaaaacccccccgccccaaaacctcccctttaaaaagcccccatttcgcgggggccgttgttttggcgacccttttatttatggggggcccccccgccggggcacctttttggggggggggcctttaagcccattttatggcgggggggggatcccataccggcccccccagaggggggggtgcccccggccacaaggggggggggcacctaagggggcgccgcgaggg

SEQ ID NO: 53168 - DNA, 613 bp, Zea mays
  misc_feature: Ceres CLONE 1472666-F
  misc_feature: Encodes the peptide sequence at SEQ ID NO. 53169
  misc_feature (519)..(519): n is a, c, t, g, unknown, or other
  misc_feature (520)..(520): n is a, c, t, g, unknown, or other
  misc_feature (613)..(613): n is a, c, t, g, unknown, or other
ggagctccccgcggtggcggccgctctagaactagtggatcccccgggctgcaggaattcgtctcacccctagaaaaatccccaaatcggcctacgcccacggttccacctcctcgtccacgaggtgaggaaaccctagcgaccgaccatggcgttgctcccgcgcaccgcgcggctggccctcctttccaccccgcgggcgtactccgctgccgctgctgcgggcgcctccccgacgtccccagcgccatacgggggcgcccccccaccggcgatgtcgaagacggccgagttcgtggtctctaaggtggacgacctgatgaactgggcgcgtaagggctcgatctggcccatgaccttcgggctcgcctgctgcgcggtggagatgatgcacgccggcgcgtcccgctacgacttcgaccggttcggcgtcatcttccgtccgtcgccgcgccagtccgattgcatgatcgtcgccggcacgctcaccacaagatggctccagccctccgcaggttnnatgacaaatgcctgagcctaggtgggttatttcatgggcagctgtgccaacgtggtgatactaccattactctactctgtgtacgtggatgtn

SEQ ID NO: 53169 - protein, 128 aa, Zea mays
  misc_feature: Ceres CLONE 1472666-F
  misc_feature: SWISSPROT Homolog: EC 1.6.5.3 NADH dehydrogenase (ubiquinone)
  misc_feature (124)..(124): Xaa is any aa, unknown, or other
MALLPRTARLALLSTPRAYSAAAAAGASPTSPAPYGGAPPPAMSKTAEFVVSKVDDLMNWARKGSIWPMTFGLACCAVEMMHAGASRYDFDRFGVIFRPSPRQSDCMIVAGTLTTRWLQPSAGXMTNA

SEQ ID NO: 53170 - DNA, 660 bp, Zea mays
  misc_feature: Ceres CLONE 1472673-F
  misc_feature: SWISSPROT Homolog: EC 3.2.1.23 Beta-galactosidase
  misc_feature (283)..(283): n is a, c, t, g, unknown, or other
  misc_feature (586)..(586): n is a, c, t, g, unknown, or other
  misc_feature (589)..(589): n is a, c, t, g, unknown, or other
aagctggagctccccgcggtggcggccgctctagaactagtggatcccccgggctgcaggaattcgtctcacccctagaaaatactgtagtacgtcgtcgtcttcatgcatgcgtggttcgtggtttcccctagctccatacgagcagtagttgggccttgcacgtaccgtacgtctagctagctatatatatagcttgtgttctactgctttttagtttaattacctgcctgcattggagagttggatctgtttcatttggtggtgtttgctttactattangtcagtatctgtttgtggagacttggtgtttaatttatttagccgtttgtgactggttgtagctagcgatgatgcagtgatgatgttcttgaggcatgaataatgctacatgcatgtgatgtatccatggtttgtgtgtcgtaaacctgatgttagtataagctgtatgcatgggtctttacttaaaggaaaaaaacaataaaaccgagacgctcgaggtaccccatttcgccctatagtgagtcgtattacgcgcgctcactggtcgtcattttacaacgtcgtgactgggaaaaaccctgncgntacccaacttaatcgccttgcagcacatctccctttcggcagctggcgtaatagcgaagagccccgcacga

SEQ ID NO: 53171 - DNA, 650 bp, Zea mays
  misc_feature: Ceres CLONE 1472674-F
  misc_feature (521)..(521): n is a, c, t, g, unknown, or other
ggagctccccgcggtggcggccgctctagaactagtggatcccccgggctgcaggaattcgtctcacccctagaaaaatctgcctgcgggatcagctcctgcggcagctgctcctgcggatgaggctgaggatgatgatgaccttgatcttttttggtgatgaaactggaggaggacaagaaggcagctgatggagcgtgctgcccgctgcccaggcctccttctaaaaaaaggaaggaaagtggtaaaatcctcccgtccttatggatgtaaaaccatgggacgatgagactgatatgaagaagctggaggaggctgtccgcagtgtccgatggagggtctgacttggggaagcatcaaagcttgtgctgttggataccgcatcagaagatgactatcatgttgacaatggccaccatttgtcccatccacctctaatggagaccaccttacgcagaaccctcatgagtactccaagttcgacattgtgctttcaccaaatccagagtccgtttccgagnttgggcacgggagcggctcacctcgccaggtttggcctggatcccctttatcccttcaagcctattacaaaaaccttgtcccgaacctaaactattataaaccttcctgggcctgagtttattggggag

SEQ ID NO: 53172 - DNA, 633 bp, Zea mays
  misc_feature: Ceres CLONE 1472675-F
  misc_feature: Encodes the peptide sequence at SEQ ID NO. 53173
  misc_feature (232)..(232): n is a, c, t, g, unknown, or other
  misc_feature (406)..(406): n is a, c, t, g, unknown, or other
  misc_feature (567)..(567): n is a, c, t, g, unknown, or other
  misc_feature (633)..(633): n is a, c, t, g, unknown, or other
tccccgcggtggcggccgctctagaactagtggatcccccgggctgcaggaattcgtctcacccctagaaaaaattacaaacccgtcctctgtccgtcctaccaccaccgctcacctcggtttggctttctcccctcttccgcacccgcttctcgctccggattccggattccctctgctctttccctaacgaaggtagccatggcggggagaggtaaggctatcggctcangcgccgccaagaaggccacgtccagcagctccaaggctggcctccagttccctgtgggaaagatcgccaggttcctcaaggccggcaagtatgccgagagagtcggcgccggcgcccctgtctacctcgctgccgtgctcgagtatcttgctgctgaggttcttgagctggacngcaatgcggcacgtgacaacaagaagacccgcatcgtactgcgccacatcgagctcgccgtccagcacgacgaagagctctcccgctggctgggcacggtgaccatcgctagcggtggtgtaatgcccatcatcataacctgctgctcccaaataaaggcnagcgcgcagctccaaggctgcggctggtgacaacgactaaatccttgactacgcctggtggcactn

SEQ ID NO: 53173 - protein, 131 aa, Zea mays
  misc_feature: Ceres CLONE 1472675-F
  misc_feature (19)..(92): Pfam Name: Histone Pfam Description: Core histone H2A/H2B/H3/H4
  misc_feature (11)..(11): Xaa is any aa, unknown, or other
  misc_feature (69)..(69): Xaa is any aa, unknown, or other
MAGRGKAIGSXAAKKATSSSSKAGLQFPVGKIARFLKAGKYAERVGAGAPVYLAAVLEYLAAEVLELDXNAARDNKKTRIVLRHIELAVQHDEELSRWLGTVTIASGGVMPIIITCCSQIKASAQLQGCGW

SEQ ID NO: 53174 - DNA, 659 bp, Zea mays
  misc_feature: Ceres CLONE 1472689-F
  misc_feature: Encodes the peptide sequence at SEQ ID NO. 53175
  misc_feature (180)..(180): n is a, c, t, g, unknown, or other
ggagctccccgcggtggcggccgctctagaactagtggatcccccgggctgcaggaattcgtctcacccctagaaaaacagtacaccatacaagggaacaagtaaagtgagtatgcatcaagtatgacattcgatatcgcatttgttatggttagaaagaaacgggaaagggtctcgcanggggttaaatcttatgcactaacgatcatttactattgtttcttaacaaaagaattctgttgcatatacactaatgcacacctaatcattttaagttggtcaacattgcacgacatatagcacaagctacttgaagtcattagcataacggaattatacattaaacttcctatgttcataacattaacaatgattagcctacctaaaataaaataactatgattactgaaagtacatgaactagatgcctaaaagaaaaaaaaagacgagacgctcgaggtacccacttcgccctatagtgagtcgtattacgcgcgctcactggacgtcgttttacacgtcgtgacgggaaaaaccctggacgtacccaattaactcgccgtgaaagcacatccactttttcggagctgggcttaatagcgaaagagccccgcatcgattcgcctttccccacagtttgcccacccctgaatggcgaa

SEQ ID NO: 53175 - protein, 58 aa, Zea mays
  misc_feature: Ceres CLONE 1472689-F
  misc_feature (19)..(19): Xaa is any aa, unknown, or other
MTFDIAFVMVRKKRERVSXGVKSYALTIIYYCFLTKEFCCIYTNAHLIILSWSTLHDI

SEQ ID NO: 53176 - DNA, 634 bp, Zea mays
  misc_feature: Ceres CLONE 1472698-F
  misc_feature: Encodes the peptide sequence at SEQ ID NO. 53177
cggccgctctagaactagtggatcccccgggctgcaggaattcgtctcacccctagaaaaagtggtgtgcaagtgcatgcagtcgtccatcacatcgatcgactggacacactgacaggatcacaagagtgacagcaagcgccgcccgcaatggcctccgcctcgcgcctcgtgtccttcgccgcgctctgcctgtgcctgggggcggcgctccaggcggcccggggcgccgacgcggccgcccgcgccttcttcgtcttcggcgactccctcgtcgacaacggcaacaacaactacctgctcacggaggcgcgcgccgactcgccgccctacggcatcgacacgcccgaccaccgcgccacgggccggttcagcaacggcaagaacgtgccggacatcatcagtgagcacctcggcgcggagcccgtgctgccgtacctgagcccggagctcgacggcgacaagatgctcgtcggcaccaacttcgcgtccgccggcgtcggcatcctcaacgacaccggaatccagttcgccaacatcatccatatctccaagcagctgcgctacttcgagcagtaccagaggcgcctggccgcgctgatcggcccggaggcggcgtcccgcgtggtgcgcg

SEQ ID NO: 53177 - protein, 161 aa, Zea mays
  misc_feature: Ceres CLONE 1472698-F
  misc_feature: SWISSPROT Homolog: EC 3.2.1.51 Alpha-L-fucosidase
MASASRLVSFAALCLCLGAALQAARGADAAARAFFVFGDSLVDNGNNNYLLTEARADSPPYGIDTPDHRATGRFSNGKNVPDIISEHLGAEPVLPYLSPELDGDKMLVGTNFASAGVGILNDTGIQFANIIHISKQLRYFEQYQRRLAALIGPEAASRVVR

SEQ ID NO: 53178 - DNA, 619 bp, Zea mays
  misc_feature: Ceres CLONE 1472699-F
  misc_feature: SWISSPROT Homolog: EC 1.11.1.11 L-ascorbate peroxidase
  misc_feature (394)..(394): n is a, c, t, g, unknown, or other
ccccgcggtggcggccgctctagaactagtggatcccccgggctgcaggaattcgtctcacccctagaaaaaggctggctcccaccgaattcattccacccccgtctcctccgatcggaccaccgggccagcagcggggcggatcgtgacgtcagcaggcatggtgaaggcctaccccacggtgaacgaggactacctcaaggcggtcgacaggccaagcgcaagctccgcggcctcatcgccgaagagaattgcgccccgctcatgctccgcctcgcatggcactccgcgggcaccttcgatgtggccaccaaaaccgggggccccttcggcaccatgaagaaccccgccgagcaggcgcacgggagcaacgccggactggaaattgcatcangctgctagagcccatcaaggagcagttccccatcctatcctacgctgacttctaccagctggctggagtcgtggcagtcgaggtaaccggcggacctgatgtcccctttcacccggggagcaggacaagcctgaggctccaccggaagcccgccttcctgatgccccccaggttctgatcactcagggaggtttctccaaaagatgggtttgagcaaaccagact

SEQ ID NO: 53179 - DNA, 643 bp, Zea mays
  misc_feature: Ceres CLONE 1472703-F
  misc_feature: Encodes the peptide sequence at SEQ ID NO. 53180
  misc_feature (285)..(285): n is a, c, t, g, unknown, or other
gcgctctagaactagtggatcccccgggctgcaggaattcgtctcacccctagaaaaaacgtacaagcctcatcagctcgctagcatagcagcaaccagcaatggactccaccaagttatccgcgctgctggcgctcgccatgctcgcgctctcctcgtcgccgctcgctcttgcgtgggagaaggcggagccggagtgcaactcgtgcgagtccggctcgcccccgtcgaccggcttccccctgcccccgatcagttttcccccaggggcgggggccccaatcngcttttctgtcgtcccactggccccggccagtataccgctttttttttttttcccacacccccgggggaacgcccaggggcccttactccctctttttaacaatctgggcccccccccaacttcaaaatatacccggcccgggagggggcgcgcggtgatgcgtccccccccgcccccatggggccctcgacccggtggcgcaggcctcgcgccccggcgccacagtaggggtcccgtcacggcccccgggggtttgtccaaaatgaccgggccatccactgggaccgcgagcggcaacatcctcccaccccccacccccccccggtgccctgccgccccgcttgctcgccgccggcg

SEQ ID NO: 53180 - protein, 180 aa, Zea mays
  misc_feature: Ceres CLONE 1472703-F
  misc_feature (62)..(62): Xaa is any aa, unknown, or other
MDSTKLSALLALAMLALSSSPLALAWEKAEPECNSCESGSPPSTGFPLPPISFPPGAGAPIXFSVVPLAPASIPLFFFFPHPRGNAQGPLLPLFNNLGPPPTSKYTRPGRGRAVMRPPPPPWGPRPGGAGLAPRRHSRGPVTAPGGLSKMTGPSTGTASGNILPPPTPPRCPAAPLARRR

SEQ ID NO: 53181 - DNA, 674 bp, Zea mays
  misc_feature: Ceres CLONE 1472705-F
  misc_feature: Translation starting site: 241
ccccgcggtggcggccgctctagaactagtggatcccccgggctgcaggaattcgtctcacccctagaaaaagcgtcctgcgttccattccaccctcctccgtctccgatcctcgccttcaactccactccctcgctctctcgggccttcttccctagcggcgacgacggggtgatcactgattcactgccgcccgcgccaggtcggccagaactagtgggcgcaaacatcatagcgatcatggaggtggtctctttgcagcactcctgctcggcattacatcaaacacccagcagcacatggagggctcggggcagtgctcttggcctttggtctgggcatgccaggcttccccggaccaaagataccaggtgggtggggaagaacccccaagggagcttccaatccgggggttcccggaagggcccttccccccagggttccctgtaaaccaacggggataccccccctgcagggatttccttccataaacccccggagggcccaaagggggttaaatttaagggccttccgggaggggcctaaaaccccccccaaaaaaaaatgggtttttgggagggaaaaaccaaaaaatttatttgtttttcaaagaggggggccgggtaaaaaaaaaaaagggggggcccggggggggttttcctcggggcgggggg

SEQ ID NO: 53182 - DNA, 706 bp, Zea mays
  misc_feature: Ceres CLONE 1472706-F
  misc_feature (59)..(59): n is a, c, t, g, unknown, or other
  misc_feature (201)..(201): n is a, c, t, g, unknown, or other
  misc_feature (279)..(279): n is a, c, t, g, unknown, or other
  misc_feature (338)..(338): n is a, c, t, g, unknown, or other
  misc_feature (429)..(429): n is a, c, t, g, unknown, or other
aagctggagctccccgcggtggcggccgctctagactagtgggatcccccgggctgcangaattcgtctcacccctagaaaaaatttttcttctctcgtggctccgacgctcctttctttctcggaggcgacagctcgaactcgaatccctcatccagcctggcgctggcgtcgccggtcgcccccgctcgattgcctccngctggatatcccttggccccataggcctgacctttaaagcctcgcctcttgatccccggcggcggcggagggagggcnatgcccaagccgaccacccacacctactccagcgaggacccactgcccggagggccccnagtcccaactttttcgtatactaactggaggcactggggcctcacatgtccctcatcaccgatacccaaatggcagaaaatgcccaacccnaaaagacttgccggaccccctttgttttagaacaaggtctaaccttcttttcaagggttaattggtaagggaggcaggaaaaattattgtttaaaacgttggtaaaaggaaaatttttaaaaaaccattttccccagggagctggggtgggaatgaaaccctttttggttttgtcccccaaataaaaaaagagattttggggaggttcccccttttccatatcccggttatttagcgggacccccttgatttccgtttccctcccaaaacacaaacc

SEQ ID NO: 53183 - DNA, 629 bp, Zea mays
  misc_feature: Ceres CLONE 1472711-F
  misc_feature: Encodes the peptide sequence at SEQ ID NO. 53184
  misc_feature (237)..(237): n is a, c, t, g, unknown, or other
  misc_feature (260)..(260): n is a, c, t, g, unknown, or other
  misc_feature (332)..(332): n is a, c, t, g, unknown, or other
  misc_feature (420)..(420): n is a, c, t, g, unknown, or other
  misc_feature (423)..(423): n is a, c, t, g, unknown, or other
  misc_feature (629)..(629): n is a, c, t, g, unknown, or other
ctccccgcggtggcggccgctctagaactagtggatcccccgggctgcaggaattcgtctcacccctagaaaaacccaagcctgtggacaccggtgacggtgagtgaacacagccgtcttggcctgctcctcccctgctgcagccatggcgacctccgcggcgctctcgaccgccgccaaccccacccagctctgccggtcccgcgctgcgctgggcaagccagtgaaggggcttgncctgggggatgggcgggagcgcncagcccagcgagcatcacgtgccaggcggcgagcagcatccccgccgaccgcgtccccgacatggagaagcngaagctgatgaacctcctccctctggggcgcatatcgctgcccaccgtcggcatggtcgtcccctacgggcgcttcttcgtccccgcnggntcggggaacggcgcggcgggacctacgccaagacaagctgggcaacgacatcacgtgggagaggtgctcaacacgcacggtccccacaaccgcacgctcgcgcaggggctcaagggtgaccccactacctggtggtggagcaagacaagaccctgggcaccctacgggatcaacgccgtgggcaccccccttcggctgcgtcgggn

SEQ ID NO: 53184 - protein, 102 aa, Zea mays
  misc_feature: Ceres CLONE 1472711-F
  misc_feature (1)..(34): Pfam Name: CytB6-F_Fe-S Pfam Description: Cytochrome B6-F complex Fe-S subunit
  misc_feature: SWISSPROT Homolog: EC 1.10.99.1 Plastoquinol--plastocyanin reductase
  misc_feature (4)..(4): Xaa is any aa, unknown, or other
MEKXKLMNLLPLGRISLPTVGMVVPYGRFFVPAGSGNGAAGPTPRQAGQRHHVGEVLNTHGPHNRTLAQGLKGDPTTWWWSKTRPWAPYGINAVGTPLRLRR

SEQ ID NO: 53185 - DNA, 620 bp, Zea mays
  misc_feature: Ceres CLONE 1472714-F
  misc_feature: Translation starting site: 164
  misc_feature: Pfam Name: Ribosomal_S5 Pfam Description: Ribosomal protein S5, N-terminal domain
  misc_feature (325)..(325): n is a, c, t, g, unknown, or other
  misc_feature (555)..(555): n is a, c, t, g, unknown, or other
  misc_feature (565)..(565): n is a, c, t, g, unknown, or other
ctccccgcggtggcggccgctctagaactagtggatcccccgggctgcaggaattcgtctcacccctagaaaaaactgttcgcgccgccgtagccccccaagcccccatcaccctccggagcgtcgcagcgatcccacccctccttctccccttcacccgtccatggcggagcgcggcggcgagcgtggcggcgagcgcggcgggtttggccgtggcttcgggcgcggcgggcgcggcgaccgtggcgggcgccgaggcggccgtcgcggcccgcgtcaggaggaagagaagtgggtccccgttacgaagctcggccgcctcgtncaggagaacaggatcaccaagatcgaggagatctacctccactcgctccccgtcaaggagcaccagatcgtcgagacactcgtgccggggctcaaggacgaggtgatgaagatcacgcccgttcagaagcagactcgcgccggacagcgcacccgcttcaggcctttgtcgtcgtgggcgacggcgacggccacgtcggcctgggagtcaagtgcgcccaaggagtgggnccacgcatcngcggcgccatcatccctcgcaagctctccgttggtcccgtcaggagaggctactg

SEQ ID NO: 53186 - DNA, 639 bp, Zea mays
  misc_feature: Ceres CLONE 1472725-F
  misc_feature: Translation starting site: 256
  misc_feature (327)..(327): n is a, c, t, g, unknown, or other
  misc_feature (335)..(335): n is a, c, t, g, unknown, or other
  misc_feature (533)..(533): n is a, c, t, g, unknown, or other
ctccccgcggtggcggccgctctagaactagtggatcccccgggctgcaggaattcgtctcacccctagaaaaccgcaactctgcacttggggttgggctcaaccgaatcgcccccgcgccaggccgttctcgtcgacgccgccgaccaataaggagcctcgcacgccacgccaccaccgccgccgcaacccacgcgatgggcgccaccggactccatctccacgtgctcctcccttcccctcgccgctgcgcccatgtccgaaccgacccccttccccttcgctgcgtcgccgcttccaaacccgctcgtagccaccgcctccttnctacagcnacacctctcccgtttggcttcccactgaaacgtcccgcgcccgcctcgctgcggcgggtgcgcgcacgccgggcccccaggggcgctccctatctctctctctcgcgcccgatgaggtcgcgcgcgctcttacggcactcccgtcttcactgtctgcaactccagcaacgagttcgtgctttgtctcgaccctgccancgggctccgctcctcgggcctctctgttccggtcggaggacgcggacgccctcctgtcccatgtgaggacgcggcaaccggtgctaggcaggggggaaaagtggtg

SEQ ID NO: 53187 - DNA, 635 bp, Zea mays
  misc_feature: Ceres CLONE 1472726-F
  misc_feature: Encodes the peptide sequence at SEQ ID NO. 53188
  misc_feature (373)..(373): n is a, c, t, g, unknown, or other
ctccccgcggtggcggccgctctagaactagtggatcccccgggctgcaggaattcgtctcacccctagaaaacccccacctccgcacaaactcgtcgcttccgctccacaggatcctctgcgccacccacaaccgtgcgaccgtccgtgctgccggcgaccccgatccgccgacccgtcccgtcccaccacaccctaccgccgctcgcagctatgtcgccgtcggagccgacgcgggaggagagcgtgtacatggccaagctggcagagcaggcggagcggtacgaggagatggtcgagttcatggagcgcgtcgcgcgctccgccggcggcgccggcggaggggaggagctatccgtgggagagcgcaccntgctgtccgtcgcctacaagaacgtcatcggcgcccgcagggcctcgtgggcgatcatctcctccatcgagcagaaggaggagggccgcgggaacgagggcacgccgcctccattccggcgctacgctcaagatcgagaccgagctcgcccgcatctgcgatgggatcctcgccctgctcgactcccacctcgtcccatccggcgggggcggcgagtccaggtcttctacctcaagatgagggtgactacaccggtaccttg

SEQ ID NO: 53188 - protein, 140 aa, Zea mays
  misc_feature: Ceres CLONE 1472726-F
  misc_feature (54)..(54): Xaa is any aa, unknown, or other
MSPSEPTREESVYMAKLAEQAERYEEMVEFMERVARSAGGAGGGEELSVGERTXLSVAYKNVIGARRASWAIISSIEQKEEGRGNEGTPPPFRRYAQDRDRARPHLRWDPRPARLPPRPIRRGRRVQVFYLKMRVTTPVP

SEQ ID NO: 53189 - DNA, 646 bp, Zea mays
  misc_feature: Ceres CLONE 1472727-F
  misc_feature: Encodes the peptide sequence at SEQ ID NO. 53190
  misc_feature (228)..(228): n is a, c, t, g, unknown, or other
  misc_feature (287)..(287): n is a, c, t, g, unknown, or other
  misc_feature (288)..(288): n is a, c, t, g, unknown, or other
  misc_feature (472)..(472): n is a, c, t, g, unknown, or other
  misc_feature (474)..(474): n is a, c, t, g, unknown, or other
tccccgcggtggcggccgctctagaactagtggatcccccgggctgcaggaattcgtctcacccctagaaaaacaccgcgcacggcatacccaccactcgatccaccacacgagggcacgagagaagaaccacttccatggccggcgcctcatcgtgagctcctcgcagcatcgctaccgcgcccttgcgttagctctgtcttcctgtcgcacgtacgcttgtgagancagcgagaaggcacgtacgtttagtttattcattttcttggagcgggatctgaggtccnnaccggcaaaagagagatgatggtagggaagagggagcgggactgcaagaacccgatgcggcggacgacgagcatgacggagttcgcgccgcccgacgcgctcgcggcggtgatggaggacgaggaggcccccagctgtccgacgacagcagccgtgacggcgggcagcaggactggctgtcccncnctccgcggccgcggcggcggcttccgggggcccccggcccaggaggactggctcccggcttaccaccccccgcgcggcgccggggcggggggggctccccccggaactcggccaactactccgccgtcaaaaaccgcccgtttcctgcccgcctggggggcttctgccggcg

SEQ ID NO: 53190 - protein, 114 aa, Zea mays
  misc_feature: Ceres CLONE 1472727-F
  misc_feature (57)..(57): Xaa is any aa, unknown, or other
MMVGKRERDCKNPMRRTTSMTEFAPPDALAAVMEDEEAPSCPTTAAVTAGSRTGCPXLRGRGGGFRGPPAQEDWLPAYHPPRGAGAGGAPPGTRPTTPPSKTARFLPAWGASAG

SEQ ID NO: 53191 - DNA, 659 bp, Zea mays
  misc_feature: Ceres CLONE 1472730-F
  misc_feature: Encodes the peptide sequence at SEQ ID NO. 53192
ctggagctccccgcggtggcggccgctctagaactagtggatcccccgggctgcaggaattcgtctcacccctagaaaaaaacagatacacacacactcgggtaaagctatctcgagctagctagctgctgtaagccgttgccatggccaaaatggtgttgctctgcgtgctcgtctccttcctcctgatgcccttggccctcctagccctgacgcaggacttctgcgtcgccgacctgacctgcagcgacacgccggcggggtacccgtgcaagtccagcgtcaccggcaacgacttctacttccacggcctggccggccagggcaaaataaacccactcatcaaggccgccgtcaccccgggcttcgtgggccagttcccgggcgtcaaacggcttggatctctgcggccaggctcgacatcgaggggcgggttcctgcccctcacacccacccgggggctcagagctcctctcgtgacccagggcaccttcgccgccggcttcatcagctccggctccaacaccggtctacccaaagacgctgtaccccggcaaaatcatgggtgtccccgcaggggcttgctccaataccaataacacccccggccccgggggctgccggggggcctccttccccttcagaaacccctaaccccg

SEQ ID NO: 53192 - protein, 151 aa, Zea mays
  misc_feature: Ceres CLONE 1472730-F
  misc_feature: SWISSPROT Homolog: EC 1.15.1.1 Superoxide dismutase
MAKMVLLCVLVSFLLMPLALLALTQDFCVADLTCSDTPAGYPCKSSVTGNDFYFHGLAGQGKINPLIKAAVTPGFVGQFPGVKRLGSLRPGSTSRGGFLPLTPTRGLRAPLVTQGTFAAGFISSGSNTGLPKDAVPRQNHGCPRRGLLQYQ

SEQ ID NO: 53193 - DNA, 653 bp, Zea mays
  misc_feature: Ceres CLONE 1472735-F
  misc_feature: Encodes the peptide sequence at SEQ ID NO. 53194
  misc_feature (422)..(422): n is a, c, t, g, unknown, or other
  misc_feature (429)..(429): n is a, c, t, g, unknown, or other
  misc_feature (445)..(445): n is a, c, t, g, unknown, or other
  misc_feature (447)..(447): n is a, c, t, g, unknown, or other
  misc_feature (448)..(448): n is a, c, t, g, unknown, or other
  misc_feature (512)..(512): n is a, c, t, g, unknown, or other
  misc_feature (537)..(537): n is a, c, t, g, unknown, or other
  misc_feature (573)..(573): n is a, c, t, g, unknown, or other
tccccgcggtggcggccgctctagaactagtggatcccccgggctgcaggaattcgtctcacccctagaaaaacgctcctccccacgacgacgagaatccccccattccccaccaggtcgccgatgccgcctaccatctgacatcgatcgcccaggcagatcgcgcgcaagccacccaaacaaatccaaaaccgaatcctgatccgatcccgtcgatcggcggcggcgatggaggcccggcccggcgcgtggcgcctgcagcagcggggccccggcgcgcccgtcgcgggcctgcccatcggcttccgcttccgccccaccgacgaggagctgctgctgcactacctccgccgcagggcgctggcctgcccgctcccgggcggcgtcatcccggaacgcgacctcgcgcgcctcgacccgtnggacctncctctccccgcgccgnanncactgggggggggagcgccgacgacgccagcggggagcacttcttcttccaccgcccggcaacncgttgctggcccaggggaggcggcncggccagggcgggccggccccggcgtctgggaggcntccgggaaggaaaccttcctcttgtcgccccgctgaaagcgccccgtcgggaccaaggggacgctcgtcttctgcccgcg

SEQ ID NO: 53194 - protein, 126 aa, Zea mays
  misc_feature: Ceres CLONE 1472735-F
  misc_feature (22)..(124): Pfam Name: NAM Pfam Description: No apical meristem (NAM) protein
  misc_feature (65)..(65): Xaa is any aa, unknown, or other
  misc_feature (73)..(73): Xaa is any aa, unknown, or other
  misc_feature (74)..(74): Xaa is any aa, unknown, or other
  misc_feature (95)..(95): Xaa is any aa, unknown, or other
MEARPGAWRLQQRGPGAPVAGLPIGFRFRPTDEELLLHYLRRRALACPLPGGVIPERDLARLDPXDLPLPAPXXLGGGAPTTPAGSTSSSTARQXVAGPGEAARPGRAGPGVWEASGKETFLLSPR

SEQ ID NO: 53195 - DNA, 652 bp, Zea mays
  misc_feature: Ceres CLONE 1472736-F
  misc_feature: Encodes the peptide sequence at SEQ ID NO. 53196
  misc_feature (268)..(268): n is a, c, t, g, unknown, or other
  misc_feature (364)..(364): n is a, c, t, g, unknown, or other
tggagctccccgcggtggcggccgctctagaactagtggatcccccgggctgcaggaattcgtctcacccctagaaaaaagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcgggcgaggcccgcgtgacgatgcgcaagacggcggcaaaggcaaagccggcngcgagctccggcagcccgtggtacggccccgaccgcgtgctctacctgggcccgctgtccggcgcgcccccgagctacctgacgggcgagttcccnggcgactacggctgggacacggcggggctgtcggcggaccccgagacgttcgccaagacccgggaggctggagtcatccactcccgctgggccatgctgggcgcgttgggctgcctgttcccggagctgctcgcccgcaacggcgtcaagttcggggaggccgtgtggttccaggccggggtcccaaatcttcagggagggtgggctggactacctcgggcaaccgagcctgatccacgcgcaaagcatcctccccatttggcctgcccaggcgtgctcaggggcccc

SEQ ID NO: 53196 - protein, 139 aa, Zea mays
  misc_feature: Ceres CLONE 1472736-F
  misc_feature (33)..(130): Pfam Name: Chloroa_b-bind Pfam Description: Chlorophyll A-B binding protein
MRKTAAKAKPAASSGSPWYGPDRVLYLGPLSGAPPSYLTGEFPGDYGWDTAGLSADPETFAKTREAGVIHSRWAMLGALGCLFPELLARNGVKFGEAVWFQAGVPNLQGGWAGLPRATEPDPRAKHPPHLACPGVLRGP

SEQ ID NO: 53197 - DNA, 655 bp, Zea mays
  misc_feature: Ceres CLONE 1472737-F
  misc_feature: Encodes the peptide sequence at SEQ ID NO. 53198
  misc_feature (76)..(76): n is a, c, t, g, unknown, or other
  misc_feature (94)..(94): n is a, c, t, g, unknown, or other
  misc_feature (111)..(111): n is a, c, t, g, unknown, or other
  misc_feature (161)..(161): n is a, c, t, g, unknown, or other
  misc_feature (414)..(414): n is a, c, t, g, unknown, or other
gctcttgaactagtggatcccccgggctgcaggaattcgtctcacccctagaaaaaaaaaccccaaaccgcaggtnaggaagcaaaccgcacgnccccgctccagaacggnatcctcatctctcacgttgtcaccacaggtctgaatccagaatccaactnagtagctccataaaagcggcaatgatccagctgctgttcgtcgtgctggtggcggaggcgtccctgacggcggcgctgctcttcaagacgccgctgcggaagctcgccgtgctagtgatcgaccggctcaagcgcgggcgccacgcgcccgtcgtcgtcaagacggtcgcgggcgtcatccttgccctgctcgcttcaacgctctacagcatgacacagatcgcggggagaacaagcaactccgactctgggngggggcccacccccaccgacagggtgctcttctcgcggtacctcctgggaggcgtgcctcatgggggaactccttatttcttgctctagggattaacccgttcccccaataacttaagagatttccccccggtttaaaaagggaattagagggcttgtccgaaaagaataataaaatggtggggggggagggcaaaaacttggggaaacttcggaggaagggaaaaaaaaatatccggggg

SEQ ID NO: 53198 - protein, 106 aa, Zea mays
  misc_feature: Ceres CLONE 1472737-F
  misc_feature (78)..(78): Xaa is any aa, unknown, or other
MIQLLFVVLVAEASLTAALLFKTPLRKLAVLVIDRLKRGRHAPVVVKTVAGVILALLASTLYSMTQIAGRTSNSDSGXGPTPTDRVLFSRYLLGGVPHGGTPYFLL

SEQ ID NO: 53199 - DNA, 658 bp, Zea mays
  misc_feature: Ceres CLONE 1472738-F
  misc_feature: Encodes the peptide sequence at SEQ ID NO. 53200
ctccccgcggtggcggccgctctagaactagtggatcccccgggctgcaggaattcgtctcacccctagaaaaaatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgcccgccgcgggcccatctgcgcgtccatgtccatgtcctcctccaacccggcctacgacctgacgtccttccgggtcagccccatcaaggagtccatcgtgtcccgcgagatgacccgtcgctacatgacggacatgatcacctaccccgacaccgacgtcctcatcgtgggcgcccgctccgcggggctgtcctgcccgtacaaactctccaaggaccccgccgtgagcattcccatcctggaacagtcggggtccccccggcggcgggccccttggttggggcggacaacttgttctcgcgccatgggggggggcgcaaaacccgggccaccttttcctttgaacaaagatggggcgtgggcctaacaaaaaagggccaaaaaaattactttg

SEQ ID NO: 53200 - protein, 160 aa, Zea mays
  misc_feature: Ceres CLONE 1472738-F
MATAAASSLLKSSFAGSRLPAATRTTPASLVVATGPRGARRGPICASMSMSSSNPAYDLTSFRVSPIKESIVSREMTRRYMTDMITYPDTDVLIVGARSAGLSCPYKLSKDPAVSIPILEQSGSPRRRAPWLGRTTCSRAMGGGAKPGPPFPLNKDGAWA

SEQ ID NO: 53201 - DNA, 1811 bp, Zea mays
  misc_feature: Ceres CLONE 1472739
  misc_feature: Encodes the peptide sequence at SEQ ID NO. 53202
aatgtgtgactgtgtgtatatatatccccggcagtgggctgtggcgagttctgttgagggaggagaagggggtggccagagaaaacaggggcagaggaagcagagtagtagagccaaggtgagcgtatcaatgatggggcctctgcctctccgccgccgccgcgtgggcgtcctgttcctggccctcgtgctcctgggcggcggcggcgcggacgccggcacgacgagctcgtaccggcggaagctggaggcgacggtggagatgccgctggacgccgacgtgttccgcgtcccgccgggctacaatgcgccgcagcaggtgcacatcacgctgggcgaccaggagggcacggccatgattgtgtcgtgggtgacggccaacgagccgggcagcagcaccgtcgcgtacggcgaggacctggccaggatggagcgccgcgccgacggcgcccacacgcgctacgactacttcaactacacctccggcttcatccaccactgcaccctcagaaacctcaagcacgccaccaagtactactacgccatggggtttggccacacggtcaggaccttctggttcaccacgccgcccaagccgggccctgatgtgcccttcaagttcggcctcatcggcgaccttgggcagacgttcgactccaacatcacgctgtcgcactacgagtccaacggcggcgacgccgtgctgtacgtgggcgacctctcgtacgccgacaaccacccgctccacgacaacaaccgctgggacacgtgggcgcggttcgtggagcgcagcgtggcgtaccagccgtgggtctggacggcgggcaaccacgagctggacttcgcgccggagctgggcgagaccacgccgttcaagcccttcgcgcaccggtacccgacgccgtaccgcgccgccgggagcacggagcccttctggtactcggtcaaggtcgcctccgcgcacgtggtcgtgctggcctcctactccgcctacggcaagtacacgccgcagtgggcgtggctgcaggcggagctggcgcgcgtggaccggaagaccacgccgtggctcgtcgtgctcacgcactcgccctggtacaacagcaacaactaccactacatggagggggagacgatgcgggtgcagttcgagcgctggctcgtcgacgccaaggtcgacctcgtgctcgccggccacgtccactcgtacgagcgcagccaccgcgtgtccaacgtcgcctacgacatcgtcaacggcaagtccacgcccgtccggaacgccgacgcgccggtctacgtcaccatcggcgacggcggcaacatcgagggcatcgccgacaacttcacgcgcccgcagccgggctactccgccttccgggaggccagcttcggccacgccacgctagacatcaagaaccggacgcacgcctactactcgtggcaccgcaaccatgacggcgcgaaggtcgtcgctgacggcgtctggttcaccaacaggtactggatgcccaccgacgacgacacaaactgacgatcaccgccgcagagggaacaaattactgatagatcagcgtagcacgttcctgagctagccccgccccctttatgttctccaattcagtaatgcaatgcgtttttataattactgatgaatgaataagaaaaatggctacgactacccgccggtcatcccaaccagactctcgaccgcagaaacaaccaggattatgtatggtccagtgcaaataattataacattgaccaaatgcattctaaggatatgtttggtttgatatcaaaaaaaaaaaaaaaaa

SEQ ID NO: 53202 - protein, 508 aa, Zea mays
  misc_feature: Ceres CLONE 1472739
  misc_feature (205)..(402): Pfam Name: Metallophos Pfam Description: Calcineurin-like phosphoesterase
  misc_feature: SWISSPROT Homolog: EC 3.1.3.2 Acid phosphatase
MCDCVYIYPRQWAVASSVEGGEGGGQRKQGQRKQSSRAKVSVSMMGPLPLRRRRVGVLFLALVLLGGGGADAGTTSSYRRKLEATVEMPLDADVFRVPPGYNAPQQVHITLGDQEGTAMIVSWVTANEPGSSTVAYGEDLARMERRADGAHTRYDYFNYTSGFIHHCTLRNLKHATKYYYAMGFGHTVRTFWFTTPPKPGPDVPFKFGLIGDLGQTFDSNITLSHYESNGGDAVLYVGDLSYADNHPLHDNNRWDTWARFVERSVAYQPWVWTAGNHELDFAPELGETTPFKPFAHRYPTPYRAAGSTEPFWYSVKVASAHVVVLASYSAYGKYTPQWAWLQAELARVDRKTTPWLVVLTHSPWYNSNNYHYMEGETMRVQFERWLVDAKVDLVLAGHVHSYERSHRVSNVAYDIVNGKSTPVRNADAPVYVTIGDGGNIEGIADNFTRPQPGYSAFREASFGHATLDIKNRTHAYYSWHRNHDGAKVVADGVWFTNRYWMPTDDDTN

SEQ ID NO: 53203 - DNA, 625 bp, Zea mays
  misc_feature: Ceres CLONE 1472742-F
  misc_feature: Encodes the peptide sequence at SEQ ID NO. 53204
tctttcctagtggatcccccgggctgcaggaattcgtctcacccctagaaaaaaccgccgaacgatggccgcctctcgccgcctcgcgcggaagctgccgtctctgatctcccggtatgagcgcctcatctccccggagactgacgcgcctgaactcaccgaagcccccaccacctccgcatccatcccgctcgacccctcactccctgtccttccgctcgccgtctcccacctctcgccgcctaacccgctcccggtgctcccctccgctcacgcttcctcccccgcctctctctttcgtctcctccgccgagcccgccaccacccgcgactcgcggcgctcgacctccacatcctgctggccgccgcagacgcgtcctccgctttccgaccagaccacggcgtcacgtccctcgtcgccgcccgcctcgcggcttcccgccgcctcccttcgctccagcgcctcctggagctcgtcctcacccgcccctgcccctgtgccgacgactccatctttgcatgccccgagctcctccccaccttccgcaaggcatcgtcgccttcgccgctccggcgacatcccttcgcatcacatgccctcgcctctctccggcgcgttgctgat

SEQ ID NO: 53204 - protein, 187 aa, Zea mays
  misc_feature: Ceres CLONE 1472742-F
MAASRRLARKLPSLISRYERLISPETDAPELTEAPTTSASIPLDPSLPVLPLAVSHLSPPNPLPVLPSAHASSPASLFRLLRRARHHPRLAALDLHILLAAADASSAFRPDHGVTSLVAARLAASRRLPSLQRLLELVLTRPCPCADDSIFACPELLPTFRKASSPSPLRRHPFASHALASLRRVAD

SEQ ID NO: 53205 - DNA, 701 bp, Zea mays
  misc_feature: Ceres CLONE 1472744-F
  misc_feature: Encodes the peptide sequence at SEQ ID NO. 53206
  misc_feature (445)..(445): n is a, c, t, g, unknown, or other
  misc_feature (446)..(446): n is a, c, t, g, unknown, or other
  misc_feature (451)..(451): n is a, c, t, g, unknown, or other
  misc_feature (452)..(452): n is a, c, t, g, unknown, or other
aaagctggagctccccgcggtggcggccgctctagaactagtggatcccccgggctgcaggaattcgtctcacccctagaaaaaacgagcaccaaatccgctcgaagcgagccggaaatatcaaaatttccggaatccgccgccgccgccgccaggctgaccaatggacctctccgtcgtgccatccctctccctctccccgcgccgtgcccttccactcccggccaggagggctgcgcggcgtccggccttcgtctgccgctgcagttgctccctggacgcgtccccggtggccacccggcggttgttcgcctccctcctcgccaccgcagcagcggtgggggttggcgtggcctggagctgaggggaagcccgcgctgtgtctacgagcaggagggcgctcagggcgtccaagattcctgagagcgaattcaccaccctgccnnatggnnctcagtactaccaacttcaggtaggagtggggctgaagctgtaaaagatccccggttgcggactttatgggcccaagggaagggcctccattccgtgaaaataggccgggccttgggtttggggggggaaccccaatgggtttaaactggcaattttaaaaaaggaaagttttaaaggatttgattttggggtttgaggaaaaaaattccgagccccaaggttaaaaaagccccccccaaacggggggg

SEQ ID NO: 53206 - protein, 66 aa, Zea mays
  misc_feature: Ceres CLONE 1472744-F
MDLSVVPSLSLSPRRALPLPARRAARRPAFVCRCSCSLDASPVATRRLFASLLATAAAVGVGVAWS

SEQ ID NO: 53207 - DNA, 708 bp, Zea mays
  misc_feature: Ceres CLONE 1472758-F
  misc_feature: Encodes the peptide sequence at SEQ ID NO. 53208
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (678)..(678): n is a, c, t, g, unknown, or other
aagctggagctccccgcggtggcggccgctctagaactagtggatcccccgggctgcaggaattcgtctcacccctagaaaaaatcgaaaccctatctcggatccgatggctcgttcgccgccgccttcttcgtcggccggcggcgcgcagtacgcgcagcagttcctcaacacggcgctctcccagcggggcccgtccgcgctgccgtacgccgaggacgtcaagtggctcatccgcaaccacctggtggcgctggccgaggccttcccctccctccatcccaaggccgccctcttcacccacaacgacggccgcgccgctcacctcctccaggccgacggcaccatccccatccaccacgccggtgcctcctacaacctccccgccgtcatctggctgcccgagccctacccgcgctccccgccgctcgtcttcctctccccgacccgagacatggtcatcaagccccaccaccgcctcgtcgacagctccggcctcgtcgccaacgcgccctacctccgctcctgggtcttcccctcctccaacctcgtcgacctcgtccgatccctctcgcacctattcggcctcgacccgcccctctttcacaggaaccctcnnntgcgcgctcaggctccgcccacgaaatcctcgccgacccagccctccacacgggtcgncgcctccctttccccctctacagcaggctt

SEQ ID NO: 53208 - protein, 200 aa, Zea mays
  misc_feature: Ceres CLONE 1472758-F
  misc_feature (43)..(165): Pfam Name: UEV Pfam Description: UEV domain
  misc_feature (171)..(171): Xaa is any aa, unknown, or other
  misc_feature (172)..(172): Xaa is any aa, unknown, or other
  misc_feature (191)..(191): Xaa is any aa, unknown, or other
MARSPPPSSSAGGAQYAQQFLNTALSQRGPSALPYAEDVKWLIRNHLVALAEAFPSLHPKAALFTHNDGRAAHLLQADGTIPIHHAGASYNLPAVIWLPEPYPRSPPLVFLSPTRDMVIKPHHRLVDSSGLVANAPYLRSWVFPSSNLVDLVRSLSHLFGLDPPLFHRNPXXRAQAPPTKSSPTQPSTRVXASLSPSTAG

SEQ ID NO: 53209 - DNA, 625 bp, Zea mays
  misc_feature: Ceres CLONE 1472760-F
  misc_feature: Encodes the peptide sequence at SEQ ID NO. 53210
  misc_feature (178)..(178): n is a, c, t, g, unknown, or other
  misc_feature (413)..(413): n is a, c, t, g, unknown, or other
ggagctccccgcggtggcggccgctctagaactagtggatcccccgggctgcaggaattcgtctcacccctagaaaaataatgttgaggaggtggtgctttatctcaagaaggaggtggtcaagacgcaagctggagacctcgagaagggtggcgagtacggtcagatgctggtgcangccatccatgcctgtgctgttgagtactcagaggtggctgggtctgtagtacacctcctaatggacttctttgaagacaccaatgttgctgcagctgttgatgttgttctgtttggacgtaagatcattgagacaatccaaagctgcttgtttccatgatccagaggctatttgatacattctaccaaattcgagcatcccgggtctgctcatgtcctctctggatcctgggggntactccctcttctttcagaggtgaaagtgcctttctcccttaaacaatgtcttggggatctccccttccaccctgtttttgatgagggggaggcactttttttttttaacccccccccgggggggggggaacctctttccctttttcttcccggggggcttttttttctttgccaatgggccctttttgcccccacaaaggccttttttttt

SEQ ID NO: 53210 - protein, 56 aa, Zea mays
  misc_feature: Ceres CLONE 1472760-F
  misc_feature (4)..(4): Xaa is any aa, unknown, or other
MLVXAIHACAVEYSEVAGSVVHLLMDFFEDTNVAAAVDVVLFGRKIIETIQSCLFP

SEQ ID NO: 53211 - DNA, 652 bp, Zea mays
  misc_feature: Ceres CLONE 1472761-F
  misc_feature: Encodes the peptide sequence at SEQ ID NO. 53212
  misc_feature (232)..(232): n is a, c, t, g, unknown, or other
  misc_feature (419)..(419): n is a, c, t, g, unknown, or other
aaagctggagctccccgcggtggcggccgctctagaactagtggatcccccgggctgcaggaattcgtctcacccctagaaaaaactatcattgcaaaagcaaagcacgcaatccaatttccctccatttctctagatctcgagttgctctgctacttcttttagattccttctttcgttcgggagagcgattctctagctggtggcaatggcgaagggcgagggtccggcnatcgggatcgatctcggcaccacctactcgtgcgtcggcgtgtggcagcacgaccgggtggagatcatcgccaacgaccagggcaaccgcaccacgccgtcctatgtcgctttcaccgacaccgagcggctcatcggtgacgccgccaagaaccaggtggccatgaacccccacaacaccgtcttcnatgcaagggggtgatcggcaggaggttctctcacccgtcagggcaaagtgacatgaagctatggccctttcaggtcctcccctggccctggggacagccccatgattgtagtcctccaacaggggtgaaggagaagcattttctttctataaaaaatccccccccgggggggttccccaaggaggaaaggaatttgcttaaaaccctcccctgggtttctacctaaaaaagaa

SEQ ID NO: 53212 - protein, 74 aa, Zea mays
  misc_feature: Ceres CLONE 1472761-F
  misc_feature (71)..(71): Xaa is any aa, unknown, or other
MAKGEGPAIGIDLGTTYSCVGVWQHDRVEIIANDQGNRTTPSYVAFTDTERLIGDAAKNQVAMNPHNTVFXARG

SEQ ID NO: 53213 - DNA, 696 bp, Zea mays
  misc_feature: Ceres CLONE 1472772-F
tccccgcggtggcggccgctctagaactagtggatcccccgggctgcaggaattcgtctcacccctagaaaaaccattgtaaaatgcatttagcacgagcaaattaccaatcgccatacccccgcctccgtccacggacacacacccgccttgccagccggcaccctcccggcctcccccacctgtgtcctccggcctcgccgccgcaaaacccgccgcgcaggccggttgctccgattgggagtgccaatcggagccaacagcgagggaagcacatgctgccgttcgtcctagagttcctcattgatgtcgcctgtgatcagtgagatcctcctctcggggtttatgatcaactccacactccggcgccgcacccacctggtccagtccttctccgtcgtcttcctctactggttctatgtcttctcatgaactactcgccccatcatagccacgccccttctctcccactcctcctcctcctctttcccttccatctagtagcatctaccgtcctcctcttctctccgtgtcagtctctgccttcgtcgtcgccgtttcagtcgttccctaaaccttctttagcttgcatgcacttccctactgctgctagcaaagacctttattactagtgtcaattaagttacgaaagaagaagaaagaaagaaaatttcgaggccgagaaaaagacggctt

SEQ ID NO: 53214 - DNA, 685 bp, Zea mays
  misc_feature: Ceres CLONE 1472775-F
  misc_feature: Encodes the peptide sequence at SEQ ID NO. 53215
aaagctggagctccccgcggtggcggccgctctagaactagtggatcccccgggctgcaggaattcgtctcacccctagaaaaaagccagggcgcagcaccctctatccgttcttcagccggcgcctcccacgtctccagtccgacactccgactcactccccctcccccgccccaacccgtcgcaatggccgccgtctccgcagccccgaggccctcgatgcctccccgactcgccctccgtgcccacctcttctcctccgcctctccgctcccaatgcgcgcgctccccttactccgcagccgcttccgctccttgaccacggcctacgctgtcaagcaggacacggccctctggacccctgcacccgtctccgccatcagtgctgccaccgacgacggctccgtctccctcatcgccgtcgacctatctgacgccacggacctcgtggactcgtacacgaacccgggccaatacctcctgatccgcgtacccggcgaggagctcaagccggcgtacatggtcatctcctcgccgcctaaagcggggccccggttcgaattcctcgtcaaaagcgtgccgggagctaccgcggggcggctctgcgccctccgagacggggatgttgtggagctcggcgccgtcacggggaaggggttccccctcgacaggataaatccgcccg

SEQ ID NO: 53215 - protein, 166 aa, Zea mays
  misc_feature: Ceres CLONE 1472775-F
  misc_feature (59)..(160): Pfam Name: FAD_binding_6 Pfam Description: Oxidoreductase FAD-binding domain
MAAVSAAPRPSMPPRLALRAHLFSSASPLPMRALPLLRSRFRSLTTAYAVKQDTALWTPAPVSAISAATDDGSVSLIAVDLSDATDLVDSYTNPGQYLLIRVPGEELKPAYMVISSPPKAGPRFEFLVKSVPGATAGRLCALRDGDVVELGAVTGKGFPLDRINPP

SEQ ID NO: 53216 - DNA, 668 bp, Zea mays
  misc_feature: Ceres CLONE 1472776-F
  misc_feature: Encodes the peptide sequence at SEQ ID NO. 53217
  misc_feature (525)..(525): n is a, c, t, g, unknown, or other
  misc_feature (547)..(547): n is a, c, t, g, unknown, or other
  misc_feature (592)..(592): n is a, c, t, g, unknown, or other
ggagctccccgcggtggcggccgctctagaactagtggatcccccgggctgcaggaattcgtctcacccctagaaaaaaactcgatcggcctccctcccccaagatcctccactcgatcccaaacaaaccaacaaatccatccatcgcacatggacgcgttcttctcggcctcctccgcgtaggcgccctacggctacggcgccggcggatggagctacgactcgctcaagaacttccgccagatcacccctgccgtccagacccacctcaagctcgtctacctcaccctgtgcgcggcgctggcctcgtcggcggtgggcgcttacctgcacgtggtctggaacatcggcgggacgctgacaatgctcggttgcgtcggcagcatcgcctggctcttctcggtgcccgtctacgaggagaggaagaggtatgggctgctgatggcggctgccctcctggaaggcgcttcggtcggacccctcgtcaagctcgccgtggaatttgacccaagcatcctggtgacngcgttcgtggggactgccatcngcgtcgcgtgctttctccggcgcggcatggtggcccagcgcaggnagtacctctaccctggcgggctgctctcgacggggctctccatcctgctctggctgcagctccgcgcctccatctt

SEQ ID NO: 53217 - protein, 101 aa, Zea mays
  misc_feature: Ceres CLONE 1472776-F
  misc_feature (62)..(62): Xaa is any aa, unknown, or other
  misc_feature (77)..(77): Xaa is any aa, unknown, or other
MLGCVGSIAWLFSVPVYEERKRYGLLMAAALLEGASVGPLVKLAVEFDPSILVTAFVGTAIXVACFLRRGMVAQRRXYLYPGGLLSTGLSILLWLQLRASI

SEQ ID NO: 53218 - DNA, 651 bp, Zea mays
  misc_feature: Ceres CLONE 1472782-F
  misc_feature: Encodes the peptide sequence at SEQ ID NO. 53219
  misc_feature (412)..(412): n is a, c, t, g, unknown, or other
ctccccgcggtggcggccgctctagaactagtggatcccccgggctgcaggaattcgtctcacccctagaaaactctacctccctccccctcttccgaggcttctcctttccgccatggcctcctgctagtgccagcccccgtcgcaacgcctcccagatcccggacgcagcgtgccgcaccccgcgacggccggctcgcgacatgggagggtgtcacgcgaagccgctcacccacgacgcggaccgctcgccgccgcacgcagcgccggcgaccccgcccccgggctccgccacgcccgccacccccggccccgggaagaagcactgggcggtgtccccgttcttcgcgttctccacgccgaagccgagccccgcgcaccacctcttcggcggttccgcggcgtcgccccncaagtcccccgctcggaagggctccgcgcccaccaccccgggcaggcggctcctgaggctgcccttcccgccccggtcgccgccagcacatcccggcggcgcttgccaggcgccacggcccggcccggccgtctatcccccaaggaaggcacccgccaaggggaaggcggccgccgcggaagcaagggccctcaaaagggggtttggtttcaacaaggggttttgcggcccaattttaa

SEQ ID NO: 53219 - protein, 149 aa, Zea mays
  misc_feature: Ceres CLONE 1472782-F
  misc_feature (70)..(70): Xaa is any aa, unknown, or other
MGGCHAKPLTHDADRSPPHAAPATPPPGSATPATPGPGKKHWAVSPFFAFSTPKPSPAHHLFGGSAASPXKSPARKGSAPTTPGRRLLRLPFPPRSPPAHPGGACQAPRPGPAVYPPRKAPAKGKAAAAEARALKRGFGFNKGFCGPIL

SEQ ID NO: 53220 - DNA, 889 bp, Zea mays
  misc_feature: Ceres CLONE 1472790-R
  misc_feature: Translation starting site: 96
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (675)..(675): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (699)..(699): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
cgaattgggtacctcgagcgtctcgtttttttttttttttttcccctccaatctcccccttaaggtaagagtacatcgcaccccccgctttggaaatggacttgccaattccagtaagtgtgccaattttgttgccaaccacaatgattgaaaacccgcccccaaaagctttttctaggggtgaaactaattcttccatcccgggggatcctctatttttaaagcggccgccaccccggggaaaccccatctttggtacccttatcggggggtctaattacttttccgggttttctgaagcaaaggaacttcagtgtcctcaagatcattccccaccttctttgtcacaatccactggttgaatccttctagctccagcagtccagtcatcgcagccctcatccgatgcaatgtcatcacactctcaaacaaaatccaaaaaggcactatgtccacattttttggatgtcttatagctgtgaccaccgtaagcaccatgggaaataattttttttctaggggtgaaaccatttcctgcaccccgggggatcccactatttcaaagcggcccgccaccggcggtggagctccaagcttttgttccctagggggggggggggaaaaaaaacnnnnnnnnnnnnnnnnnnnnnnnnttttgtggttttgggggtgggngttaggttnnngaatttttataanggggccnnnttttgggggggttttatcccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 53221 - DNA, 929 bp, Zea mays
  misc_feature: Ceres CLONE 1472790-R2
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (574)..(574): n is a, c, t, g, unknown, or other
  misc_feature (577)..(577): n is a, c, t, g, unknown, or other
  misc_feature (578)..(578): n is a, c, t, g, unknown, or other
  misc_feature (580)..(580): n is a, c, t, g, unknown, or other
  misc_feature (583)..(583): n is a, c, t, g, unknown, or other
  misc_feature (588)..(588): n is a, c, t, g, unknown, or other
  misc_feature (589)..(589): n is a, c, t, g, unknown, or other
  misc_feature (592)..(592): n is a, c, t, g, unknown, or other
  misc_feature (598)..(598): n is a, c, t, g, unknown, or other
  misc_feature (609)..(609): n is a, c, t, g, unknown, or other
  misc_feature (618)..(618): n is a, c, t, g, unknown, or other
  misc_feature (688)..(688): n is a, c, t, g, unknown, or other
  misc_feature (708)..(708): n is a, c, t, g, unknown, or other
tttgtatgagtcatcgcatcacccgctatggacatggacgtgccggttccagtttgtgtgctaattttgttgccccctacatgattgagagacaccgatgacgaaagctttttctaggggtgagactaattcctgcatcccgggggatgccactatttctagagcggccgccaccgcggtggagctccatcttttgtaccctttatcgtagggtctaattacttttccgggttttctgaagcaaaggaacttcagtgtcctcgagatcattccccaccttctttgtcacaatccactggttgaatccttctagctccagcagtccagtcatcgcagccctcatccgatgcaatgtcatcacactctcaaacaaaatccaaaatggcagtatgtgtagatcccttggatgtcttatagctgtgaccacggtaagcaccatgggaatatatttttttctaggggtgagacgaattcctgcagcccgggggatccactagttctagagcggccgccaccgcggtggagctccagcttttgttccctttaggagagggtggattacnnnnnnnnnncnccnncnccnccccnnccncccccnggcccgcggcngccccgggncccgccggccggccccccccccggggcgccgccccgaaagggcccccccccccggccagacccccccccngggccggcccgccaggcgcngaacgggcgccaacccggcgccggcaacggaagaaggccccagcgccccgggccccagggagggaccacccggaggggcccagcacgagagccgcgcagccgccacctcccccgaggagcgtgtctcatgatgcttcgccctggccagcggaagcgaggacgcctctaatggtaatgatcagcggctccgcgcggggacgtctcttcgactgtagggggcg

SEQ ID NO: 53222 - DNA, 688 bp, Zea mays
  misc_feature: Ceres CLONE 1472791-F
  misc_feature: Translation starting site: 210
  misc_feature (360)..(360): n is a, c, t, g, unknown, or other
  misc_feature (502)..(502): n is a, c, t, g, unknown, or other
  misc_feature (503)..(503): n is a, c, t, g, unknown, or other
aaagctggagctcaccgcggtggcggccgctctagaactagtggatcccccgggctgcaggaattcgtctcacccctagaaaaagccacgcccacgcctccacggccaagcgcctcgaaggcaaagcttccactagccacaggccaacgaaatcgcaacgcgaagctacggccaccgaccgacgttccaagaagcgaaacgaaacgaaaatgatgatgatgatgggagagagagcgcacgcgccgccgtggcagcactcgccggcggccagcggcgtcacggacgcggacgacgcgtctccgtacgccctcctagcggcgctgcagcattacctgccgtcgaacgaggtggcggctttcnacaaaaacaacgaggaggcggcccctggcggcggcgaccgccgccgtcgacgcgtacccctgcgacgagttccggatgtacaagttcaggggcgggggggctcgcgagggccggaaccacactgggacgggctgcccctacnnccaccccggggggagaaggcccgggcgggcccaacccagggggtaccactacctccgggggccgggtgcccggaacttccgaaagggggggggggaaggcgcggcaacccctggcaacctcccgcacgggggttgttccgaggtgctgctcccaccggttggggctaccggaacccagcccgggg

SEQ ID NO: 53223 - DNA, 665 bp, Zea mays
  misc_feature: Ceres CLONE 1472798-F
  misc_feature: Encodes the peptide sequence at SEQ ID NO. 53224
  misc_feature (511)..(511): n is a, c, t, g, unknown, or other
aagctggagctccccgcggtggcggccgctctagaactagtggatcccccgggctgcaggaattcgtctcacccttagaaaaaacctcgccttcacctcagctcacggcctcacccgtccacccacccacccgcctcgcctccatccacagcgaccacgcccatcttcgctctgtccgctcacccccacctctccgcccccgtctccgtccgcacccgtccgcctccgacttccccgtggcccagccggatccggagccgaactcgaccttgttcaggaaggagagcccgaaccgcggcgggcgggagggctctttttagcttgccccgcctgaggccagccgccccatgggccagtcgcctgagcgcgctacgtatcagctcatcgaccggcgggaagggcttgggtaaatcattattgaaagcatctcccttttacatgtaaccttgcatacaatatctgttaagatgaagtcactaaataaaagtgtttcaaatagtggagatgcatngtcagtcttagctagtaaagtcacatcattaaatcccaatgcagcggagtttgtaccgtcattttgtaaaccatcttttggaaatgtacagttctagataagtcagaatttcaggggtcttctgggaaaacaattctagataggcctgagccat

SEQ ID NO: 53224 - protein, 46 aa, Zea mays
  misc_feature: Ceres CLONE 1472798-F
  misc_feature (15)..(15): Xaa is any aa, unknown, or other
MKSLNKSVSNSGDAXSVLASKVTSLNPNAAEFVPSFCKPSFGNVQF

SEQ ID NO: 53225 - DNA, 608 bp, Zea mays
  misc_feature: Ceres CLONE 1472805-F
ctccccgcggtggcggccgctctagaactagtggatcccccgggctgcaggaattcgtctcacccctagaaaaagcgacctcaggtcagtcggtactacccgctgagttataagcatatctgtaatcgtacgacacactagacttaccatgattaccttatctctggcgagcgtatcgggagcacctcactttgaaaatcggacgacttcgccaccctaattgtagtctggagagacgtcctcagccactgaccgtccctcttttctctgtaaagcgacacatgtgagcgtgagagcctcgtcttgtcaggaccttgtctcaccaccaggcacaatgaccagtcaggttgacagtgatgctgcccagatcgcgtcgcaactgcgtcgcacgctaaatacaggcgagcagaccatagcttagatatacatgacgggaactgaaaaatgactctaatagggatcaaagagtgcttgaatttgccggcaggaacttacggtgcttggcacgccccccagccgtatgcgtatcggtacaagctggtcttccaatagaaagaagtcttgcatcgaattcctcgggacggatttctaatcggggggacaaaagg

SEQ ID NO: 53226 - DNA, 1133 bp, Zea mays
  misc_feature: Ceres CLONE 1472805-R
  misc_feature (62)..(62): n is a, c, t, g, unknown, or other
  misc_feature (569)..(569): n is a, c, t, g, unknown, or other
  misc_feature (1133)..(1133): n is a, c, t, g, unknown, or other
gtgggtggtttttggggtgggggggggggggtggaggggggggagggggggggggcacccanggggatggggtatgtgggaggaggcccttcttctgctacctttcgactcagatccggtgtaacagggaggacacattctccacggactacattacatatagcgctagagagctcacagcaactacacattattgatgaccataaccataagaattggtggcggggaaaaaaagaaaaccagaaagaacaaaccgctagaaacgatcgatgcctacagaagacgaggtgccatacaagatcatctatatctctgacctaagggtgggaggagcatatcagacaggtgcaggacaggacactcgaactcgagggaagagagaaggtcctcttcctcgcaggaactctggaatctccaccgtgctgctgccctctggtggagatgggcctcggccatgctcaccttgttgcccacccttatacacacggcctccagggtcatcctgacgcttgaggccagtagctatcaaggttatgctcacctggccactatgtggcgggggcataacngccgccaaatatgagcaataacctcttggatcggacagaggtcctagaataagttcccggccgccaccatgtcacctgcaatacaaagtggccggataggtctcccgacacgtgcattgtttcccccacagaggggcccggaagggggcccttttccaaatgtgcccaaacaatggaagccttaaaccgcgcccgaacccggtggatggggctgcctcttaaaaggaaggctagggggggtgccccccttttggcactccaatagagagccttttccacccgggtggagggtaaaatcgccgccatatttccccgccgtttcaaaagggatttggaaccgccctctcccattttcttggcccataagaatagggccacccggagacgcgtccaaggaagaaagagggtcagactttttaacggcccaaacccggggggaaaacaagaaagaatgttaatcgcccaggaagaaacccgcatgcccaaaaaagcccttggtacctaaataaaaaatttgggatccagccgcagaaattggaaacaggcgtttcccgtttacagggn

SEQ ID NO: 53227 - DNA, 710 bp, Zea mays
  misc_feature: Ceres CLONE 1472806-F
  misc_feature: Encodes the peptide sequence at SEQ ID NO. 53228
  misc_feature (406)..(406): n is a, c, t, g, unknown, or other
ggagctccccgcggtggcggccgctctagaactagtggatcccccgggctgcaggaattcgtctcacccctagaaaaaccgtggttcaactcctaccactaccacagcaccagcgacggaccgggcaggcagagaaaaagcagaccagacgagacctctcgcgttccgtcctcctccctgcccctgctgccgttccccttcttcctcagttctcctgcccgctgctgccctccgtccgcgtccagatcccgccaccaaccgatccggcgccctccagcatggcgggggcgggagcggggacgaaggcggcgggagccctggctctggcgctcgtgctcgcgctcgcgggggccaactccgagggcgacgcgctctcggcgctgcgccggagcctcagggacccccngcggcgtctgcagagctgggaccccacgctcgtcaacccctgcacctggttccacgtcactggcaaccgcaacaccggggtcacccgcctggaacttatataagaatacctttcagggacaatccccttctgaacttggcgaccttgaagaacttaaaaagcttccactttgtaaagaaccaaattttcgggggaaatacacccccgcccttggaaagttaaaaccccttggatttctggggccccaaggggaaacttttgtggggggcccctcccccggggaactcccggggaaattttgctc

SEQ ID NO: 53228 - protein, 76 aa, Zea mays
  misc_feature: Ceres CLONE 1472806-F
  misc_feature (25)..(65): Pfam Name: LRRNT_2 Pfam Description: Leucine rich repeat N-terminal domain
  misc_feature: SWISSPROT Homolog: EC 2.7.11.1 Non-specific serine/threonine protein kinase
  misc_feature (43)..(43): Xaa is any aa, unknown, or other
MAGAGAGTKAAGALALALVLALAGANSEGDALSALRRSLRDPXRRLQSWDPTLVNPCTWFHVTGNRNTGVTRLELI

SEQ ID NO: 53229 - DNA, 648 bp, Zea mays
  misc_feature: Ceres CLONE 1472816-F
  misc_feature: Encodes the peptide sequence at SEQ ID NO. 53230
ggagctccccgcggtggcggccgctctagaactagtggatcccccgggctgcaggaattcgtctcacccctagaaaaactcctcgatcttaccatcttgacatagcagacgggttcagccatttcgagctcccagccaagaacgtgctgggcacctcttacctcctagcagcgcacgctggtacaggtcatcacggcaagccggtcctcgcccgggcggctagcaccgtccatcgactacgtggaggaccccgacggctccgctgctgatatcatcgagaggcctggacctccccaccccttgtgccacgtgatgctccccgtcgccgaccttgaccgagccatactcttctatgataacgcctgccatgtgctactgctccggaacgagatatccctgactcaactcatgctgccactgatgggatacggacatgagaccagagcgctctgtactcatctaaactatggtgtcccgatatccaagcgactcttatactcgatcgactagtcatgacctctctccggatcgagcatgcggacagctgtctgagtctcatgctctgcagacctgaccttgcctgtatgacatcacatcattgcatactgtaccagatagctcgaaatcggcttcaacgactacaggacc

SEQ ID NO: 53230 - protein, 65 aa, Zea mays
  misc_feature: Ceres CLONE 1472816-F
  misc_feature: SWISSPROT Homolog: EC 4.4.1.5 Lactoylglutathione lyase
MLPVADLDRAILFYDNACHVLLLRNEISLTQLMLPLMGYGHETRALCTHLNYGVPISKRLLYSID

SEQ ID NO: 53231 - DNA, 691 bp, Zea mays
  misc_feature: Ceres CLONE 1472821-F
  misc_feature (515)..(515): n is a, c, t, g, unknown, or other
  misc_feature (599)..(599): n is a, c, t, g, unknown, or other
aaactggagctccccgcggtggcggccgctctagaactagtggatcccccgggctgcaggaattcgtctcacccctagaaaaacaataaaatcattcctcgatccaaaaactgcttccaagatccatgttcttgggaataagtatcaacataagttgctcgaaataattgacgagtgtgaactgccagaatttcttggtggcaaatgcaattgtattgaaggttgccaaagatctgacaaaggtccttggaaggatcccaacataataaagagagtcctcaatgacgaggcaaactacggcagacaaattgtgaccatatccagcattgatggaaaaataatacgttatgctaggccagatcacccaactagaaaagggagtgatgcatctgccgagtctggatctgaagtggaagatgtaacatctcctactgcatcaaggaacctgattacacatcctattttgacccctgttcacgaagagtcaaaattgtcgccacatggttccacatttngtgctcatgcttctattgaagaaacattccctgtgtaaacaaagttgtggatgaatgatggggtactcccagaaggtatctccnaggctcctccaggtccgtgccctccagaaccccgcacgcacattcaaagactgaaagttcaggctgtcccatggctgacttcttgaaccggc

SEQ ID NO: 53232 - DNA, 652 bp, Zea mays
  misc_feature: Ceres CLONE 1472833-F
  misc_feature: Translation starting site: 271
  misc_feature (450)..(450): n is a, c, t, g, unknown, or other
  misc_feature (467)..(467): n is a, c, t, g, unknown, or other
  misc_feature (482)..(482): n is a, c, t, g, unknown, or other
  misc_feature (491)..(491): n is a, c, t, g, unknown, or other
  misc_feature (508)..(508): n is a, c, t, g, unknown, or other
  misc_feature (512)..(512): n is a, c, t, g, unknown, or other
  misc_feature (514)..(514): n is a, c, t, g, unknown, or other
aaagctggagctccccgcggtggcggccgctctagaactagtggatcccccgggctgcaggaattcgtctcacccctagaaaaaagagcaggactagcactggcagtctagctagcacacccgcactgcgtctccgcagcacacactcgcacgcacgagaaggccggagaggcggcgcacccggagaggcaaaggtaagcgatccctctccccccctccctccctccctcgtatcgtatccaggacaacagcccgtgcaatccgatcccgatggcggcccggccggacgcgcgcagcggctactgcgccgcgacgcgcaccttccgtagcaagcgcgcggacgtcccgctccccgccgacgcggacctggacgtcgtcaggttcctcgcgtcccgccgccacgcgggcgttgtcgcgctcgtcgacgctgccacggggccacgggtcacngtccaggaactctggcncgcggtggaaagggnggccaccgngctcgccgcgcccgcgntgtngntcggaaggggcaggtcgcgctcatcctctccccgaactcggtccacttccccgtcgccgccctcgcagccatgtccttcggcggccgtcctcaccaccgccacccggtcaaaacgcccgctgagatcgccaagcagaa

SEQ ID NO: 53233 - DNA, 727 bp, Zea mays
  misc_feature: Ceres CLONE 1472843-F
  misc_feature: Translation starting site: 196
  misc_feature (413)..(413): n is a, c, t, g, unknown, or other
  misc_feature (416)..(416): n is a, c, t, g, unknown, or other
  misc_feature (727)..(727): n is a, c, t, g, unknown, or other
aaagctggagctccccgcggtggcggccgctctagaactagtggatcccccgggctgcaggaattcgtctcacccctagaaaaaactcccaagacacagagcgtcagagcccgatcccgatccagcgaggcggcgaccctccctcctccccttgcttcgctcgtccagccctgaccacccgcatccccgtcagtcatggcagcggcagcaggcggaggcgcggtgcgtgcgctgtcccagaaggagcaggacatacagatgatgctcgccgccgacgtccaccttggcaccaagaactgcgatttccagatggagcgctatgcctttaagcgccgcaccgacggcatctacatcatcaaccttggcaagacatgggagaaactgcagcttgcagcgagggttatcgttgccanccnacaaaccgcaggacatcatcgtccagtccgcccgcccttatggccagcgtgctgtcctcaagttcgctcagtacactggcgctcatgccatcgctgggaggaacacccctgggacccttcctaaacaagttcagacctccttcagcgagccctcggtgcttctcctttccgacccaaggactgaccctccgccaattaaggaggctgctttggggggaaatccccccaattggctttctgggaaaactgaccccccccgggcgggatggcaaaatcgggttccccaccaaaaaacaaggggggaggacaan

SEQ ID NO: 53234 - DNA, 674 bp, Zea mays
  misc_feature: Ceres CLONE 1472848-F
  misc_feature: Encodes the peptide sequence at SEQ ID NO. 53235
  misc_feature (365)..(365): n is a, c, t, g, unknown, or other
tggagctccccgcggtggcggccgctctagaactagtggatcccccgggctgcaggaattcgtctcacccctagaaaaaaccctcttctccgtttcgtttcccgaccaggcctcgccggctcaccgcccccgccgcgcccgccatggacttctcggaacaggacgtcaacgtcttcggcgaggactacgacgtccacgacggcggcgccgaggccgaggccgaggccgacggcggcggggactcgtcgggctcctcctcccatcatcgtcctcgtcgtcctctgcccgcgcgtcctcctcatcctcaagtggcggctcaagcctcagcagcagcggcggcgctgccggtgagggcgaggatggcnccaatgtgggggacggggagaaatacgattcgtccaacctcatagccacaaggagcgccggcgcccgcggctatctggacgatgaggagagggaatatgagaaacaggaaggtagaggaggagaagatatttgttcggctcaaaataacaaagagtccgtaagaactccgggcgcgcaaccactacctaagtcccagtggcttctcccatttcggaacattaaataatcattcctcgaggagggttttgaaggaccaggtgggtaaaggcccccccccttctttcaggggccaggaggccatcccgggg

SEQ ID NO: 53235 - protein, 196 aa, Zea mays
  misc_feature: Ceres CLONE 1472848-F
  misc_feature (122)..(122): Xaa is any aa, unknown, or other
GAPRGGGRSRTSGSPGLQEFVSPLEKTLFSVSFPDQASPAHRPRRARHGLLGTGRQRLRRGLRRPRRRRRGRGRGRRRRGLVGLLLPSSSSSSSARASSSSSSGGSSLSSSGGAAGEGEDGXNVGDGEKYDSSNLIATRSAGARGYLDDEEREYEKQEGRGGEDICSAQNNKESVRTPGAQPLPKSQWLLPFRNIK

SEQ ID NO: 53236 - DNA, 688 bp, Zea mays
  misc_feature: Ceres CLONE 1472855-F
  misc_feature: Encodes the peptide sequence at SEQ ID NO. 53237
aaagctggagctccccgcggtggcggccgctctagaactagtggatcccccgggctgcaggaattcgtctcacccctagaaaaaatcacggcggcggcggcggaagagtagcagcagcaggcggcgccgagtagcgtctccccacctcgagcttgccaccatggctagaggattgaagaagcatttgaagaggctcaatgcgcccaagcattggatgctggacaagcttggcggagcttttgctcccaaaccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaacgagaactacaggctgctgtatgacactaagggccgcttccgccttcacccaatcagggatgaggatgctaagttcaagctttgcaaggttaggtctgttcagtttgggcagaagggcatcccgtacctgaacacgtatgacggccgcaccatccgctaccctgacccgctcatcaaggccaacgacaccatcaagatcgatctggagaccaactagattgtggacttcatcaagtttgaa

SEQ ID NO: 53237 - protein, 167 aa, Zea mays
  misc_feature: Ceres CLONE 1472855-F
  misc_feature (94)..(168): Pfam Name: Ribosomal_S4e Pfam Description: Ribosomal family S4e
  misc_feature (3)..(40): Pfam Name: RS4NT Pfam Description: RS4NT (NUC023) domain
  misc_feature (42)..(90): Pfam Name: S4 Pfam Description: S4 domain
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGQKGIPYLNTYDGRTIRYPDPLIKANDTIKIDLETN

SEQ ID NO: 53238 - DNA, 767 bp, Zea mays
  misc_feature: Ceres CLONE 1472860-F
  misc_feature (767)..(767): n is a, c, t, g, unknown, or other
aaagctggagctccccgcggtggcggccgctctagaactagtggatcccccgggctgcaggaattcgtctcacccctagaaaaactcgggcagcttctcccgtgcccctcgcgtgcgctctacgactgggcggccgccggcaccctacaccagttgcccaggtctctgtcttcgggaccttccccggcgacgagcatccaccaggtcattgctgagaaggccgagaagagcgacaccctggaaatcacagcaaagctgatgacgagggacaacgatgcaagtggtgttgggaagctccccgggagcgcttctatcgcgcccaggcacacaggaaccggctcagcgattcgacttcccagtcccaataacgccttgaaaaggttaatcttttccagaattccccggggacccccccctgttacaagggccaccaaccggaagggaggtctccccccccacacaaaacacccttctccccaagggggggggcgaaatttggggggttttcttttaaagggtctccccccttctttcccaaaaaaccccactaattggggcgtgggccccccgggcccgggtttccctatttttttgacgggaaaatttttttttcttcttagagggggccaccacccccggaaaatataaaaaactaacccttttcctcccccccctcctttaagaaatatcttcctaattttcctttaagagggggccctccccccaccaagttgtttttcgttcttcccacaccccccctttaaaan

SEQ ID NO: 53239 - DNA, 802 bp, Zea mays
  misc_feature: Ceres CLONE 1472870-F
  misc_feature: Encodes the peptide sequence at SEQ ID NO. 53240
  misc_feature (802)..(802): n is a, c, t, g, unknown, or other
caaagctggagctccccgcggtggcggccgctctattcactagtggatcccccgggctgcagtgtaactcgtctcacccctagaaaaaaaaccagcacccgccgccgacagggaacatcgccggccgagatcggctgcacatctgtgctgcttcagggcgccggagttcgcgtcgtcgttcggtaacttgcggggtcaatgggaggagggaaagacaagcatgacgagagcgacaaggggctcttctcgaacatgatgcacggcgttgccggtggtcatgggtacccccaccatggataccctccgcaaggctacccaccgcaaccaggagcatacccgcctcccccagggggcgtatgcttcttccttcaggggcatatcacccctcacccggggggcataacccaccccaaaaatgcggcacccctccgtcgagggggtggtggccccccctcaagggggggataattcttccctggcggcgcctaaccgtgggctcaatcctttcccccgggcggtatgttgaagaccgaatcaccggggcgtagtggataagcggcgggatccaccttcgtgtactcggttttccataagtacactcgggaaatgtggctataaataaggtcccgcgtgctaccgtgcaagggagcccttacccgcaccttatcctaacggttcactggctccgggacacaagatattccacctttattcccctttcccgtaggcctatatagttcaccctggtggagaattcgtacccatccatcatacgatttttaccctgttaacatagtttatn

SEQ ID NO: 53240 - protein, 89 aa, Zea mays
  misc_feature: Ceres CLONE 1472870-F
MGGGKDKHDESDKGLFSNMMHGVAGGHGYPHHGYPPQGYPPQPGAYPPPPGGVCFFLQGHITPHPGGITHPKNAAPLRRGGGGPPSRGG

SEQ ID NO: 53241 - DNA, 671 bp, Zea mays
  misc_feature: Ceres CLONE 1472872-F
  misc_feature (298)..(298): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (306)..(306): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (377)..(377): n is a, c, t, g, unknown, or other
  misc_feature (378)..(378): n is a, c, t, g, unknown, or other
  misc_feature (384)..(384): n is a, c, t, g, unknown, or other
  misc_feature (386)..(386): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (406)..(406): n is a, c, t, g, unknown, or other
  misc_feature (411)..(411): n is a, c, t, g, unknown, or other
  misc_feature (418)..(418): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
ctggagctccccgcggtggcggccgctctagaactagtggatcccccgggctgcaggaattcgtctcacccctagaaaaagcatgaactgttaacgaaacaaataggtcatatctgtcattacacacacatatatattctgacccatggtatttccttttcagaaatagttatgtcccttgttttattgatttgccaatctggtgtatgttcgtcgtgaggcaacgtgagcgctgtgagggcgtcaatcctcccgcgcgcgttgcaagggtcctaaatataaacttaattaggtttantnnnnnanannnnnnnnnnnnnnnnnnnnnnnnnnnnnnnnnnnannnnnnnnnnnnnnnnnnnnnnnnnnnnnnnngnngggggngnggnnnnnnnnnnnnnnnngnggggnggtttgngnnnnaagggggnnnnngggggaagggcgggggggccacattccccctaaagggggggatataaacccggcccctcgggggcctttttttataaaccgggggaagggggaaaaaaccggtgggttccccacaatatttcgggggtgaaaaaaaacccccctttttcccagggtgggaaaaaaaaaaaaaaaagccccccccaaataccccctttcaaaaagttttccccccctctaaaagggaaagaaaaaaa

SEQ ID NO: 53242 - DNA, 643 bp, Zea mays
  misc_feature: Ceres CLONE 1472876-F
  misc_feature: Encodes the peptide sequence at SEQ ID NO. 53243
  misc_feature (364)..(364): n is a, c, t, g, unknown, or other
ctccccgcggtggcggccgctctagaactagtggatcccccgggctgcaggaattcgtctcacccctagaaaaaatccctccccttccagccttcctcttccacggtccacgccaccagtcgagtccaccgctccataactccattcctccggcctccgcacgccctacttctccattccgcaaagaggggccaggcgtcaagggcgcggctgctctctgctggacgcgcgtcatgggcgccgccgagaaccccccggcgcctccgcggcaggagtctgcaccagtcaggggagcggctccgacaccggcgacagaggcggtggagaaggtggtcgtcgtgaaccaggcgccgcccccgcagcngcgtcgaagctgcaggcgcagcggccgctggcgccgctgcaggtcaccacgcaggcgccgccgcccgccatgacggtggcctccggcgccgtcgagccgccgcccgcagtggcagcgtaccagcctgtcatgcagcctccgcagcaggggccgcttccgtcgctcaactcaagcaagtacacccacggcataacgctgtggctcttcctgctccaccttgccgcgcggcagccggcatggggttctttcgtgtcaagacgtccagagatcagccagcac

SEQ ID NO: 53243 - protein, 70 aa, Zea mays
  misc_feature: Ceres CLONE 1472876-F
MTVASGAVEPPPAVAAYQPVMQPPQQGPLPSLNSSKYTHGITLWLFLLHLAARQPAWGSFVSRRPEISQH

SEQ ID NO: 53244 - DNA, 656 bp, Zea mays
  misc_feature: Ceres CLONE 1472878-F
  misc_feature: Pfam Name: CDC48_N Pfam Description: Cell division protein 48 (CDC48), N-terminal domain
cggccgctctagaactagtggatcccccgggctgcaggaattcgtctcacccctagaaaaagctccgcatctcgcattctcgccggtgctgctgcaattaacgccgcctccggccaaccacccgaaacctacctccgccgccgtcgtcgccaccgtcaacatggcgagccaaggggagccctcggcctctgcttccgatccgaaggagaagaaggacttctcgacggcgatcctggagaggaaaagtcaccgaaccgccttgtcgtcgacgaggccaccaacgacgataactccgtcgtcgctctgcaccctgacaccatgaagaggctgcagctcttccgcggcgacaccgtgctcctcagggggtaagaagaagaaagacactatttgcattccccttgcgaacgaaacctgtgaggacgcaaaggttccggatgaacaaggttgtcccgccagaccctaagggtggatgcttggtgatggtggtttctgtcccaccagtgccaggatgtgaaaatatggggaggcgtgtccacctttctttcaatttgatgaatccggttgaaggctttttcaggggaaccttgtttggatgcctttcttgaaacccttttttccctaaaaacataccgggccggttgaaggaaaagaaaacc

SEQ ID NO: 53245 - DNA, 682 bp, Zea mays
  misc_feature: Ceres CLONE 1472889-F
  misc_feature: Encodes the peptide sequence at SEQ ID NO. 53246
ggagctccccgcggtggcggccgctctagaactagtggatcccccgggctgcaggaattcgtctcacccctagaaaaaatcgccattcacctccagccaggctccggaaccttatcgccaaatcctcgtcccctacccgaggcgagcatcatggcggccgcgctcttctccagctcgctctcgccccgcttcctcgccctatcctccccgaagccggccgcgcccgcggccacagccttcctccccttcaggctgccgccgcgcgctgtctcggcgccgggtaggcgggtcttcgagcccgtggccgtcgcggtgtcgtcggagtacaagacggagggcgcggagcaggagggggaggatggatccgaggagttctccgaggacctgaagctgttcgtcggcaacctaccgttcagcgtcgacagcgcgcagctcgcagggctcttcgagcaggccggctccgtcgagatggtcgaggttgtatatgacagaatgactggaccgaagcccaggatttggattccttgacaatgtcttcggcccgagaaagccaaagctgcttgccaagcattcaacgggtttgcctttcaaggaaaaacaactgaaggggaaatgggggggcccccccccccagaggatgaaatccccccccagaggccccaaggggtggggggtggggcgg

SEQ ID NO: 53246 - protein, 125 aa, Zea mays
  misc_feature: Ceres CLONE 1472889-F
MAAALFSSSLSPRFLALSSPKPAAPAATAFLPFRLPPRAVSAPGRRVFEPVAVAVSSEYKTEGAEQEGEDGSEEFSEDLKLFVGNLPFSVDSAQLAGLFEQAGSVEMVEVVYDRMTGPKPRIWIP

SEQ ID NO: 53247 - DNA, 645 bp, Zea mays
  misc_feature: Ceres CLONE 1472908-F
  misc_feature: Encodes the peptide sequence at SEQ ID NO. 53248
aaagctggagctccccgcggtggcggccgctctagaactagtggatcccccgggctgcaggaattcgtctcacccctagaaaaatcaggcccacgctttgttaacaaagaattccctcatagccgccgccgccgccgccgccgccgccgccgctcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttcacacatagcttcgtcgttttgaatttgatgtactaatggagtctaagggtggcaagaagtctagcagtagtcgttccatgatgtatgaagctccccttggctacagcattgaggacgttcgacctgccggaggcgcgaaagaagttcagtctgctgcttactcccactgcgcaaagaagccatcctgatatccctttttggctccctcgttctagtagtttaggatttctttttctgacacttcgattcttaccaatccccctgggctggtgctttcctgacaatcgacccagtccccagtcttgctccctgcagtcctccctcctccatcc

SEQ ID NO: 53248 - protein, 50 aa, Zea mays
  misc_feature: Ceres CLONE 1472908-F
  misc_feature (1)..(50): Pfam Name: AdoMetDC_leader Pfam Description: S-adenosyl-l-methionine decarboxylase leader peptide
MESKGGKKSSSSRSMMYEAPLGYSIEDVRPAGGAKEVQSAAYSHCAKKPS

SEQ ID NO: 53249 - DNA, 678 bp, Zea mays
  misc_feature: Ceres CLONE 1472916-F
  misc_feature: Encodes the peptide sequence at SEQ ID NO. 53250
aaagctggagctccccgcggtggcggccgctctagaactagtggatcccccgggctgcaggaattcgtctcacccctagaaaaaactagaaaaaaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttccccgagctgctcgcccgcaacggcgtcaagttcggcgaggccgtgtggttcaaggccggctcccagatcttcagcgagggcgggctggactacctcgggaacccgagcctcatccacgcgcagagcatccttgctatctgggcctgcccagtcgtgctcatgggcgccgtcgagggctac

SEQ ID NO: 53250 - protein, 175 aa, Zea mays
  misc_feature: Ceres CLONE 1472916-F
  misc_feature (65)..(175): Pfam Name: Chloroa_b-bind Pfam Description: Chlorophyll A-B binding protein
MASSTMALSSTAFAGKAVNVPSSSAFGEARVTMRKTAAKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACPVVLMGAVEGY

SEQ ID NO: 53251 - DNA, 659 bp, Zea mays
  misc_feature: Ceres CLONE 1472918-F
  misc_feature: Encodes the peptide sequence at SEQ ID NO. 53252
  misc_feature (434)..(434): n is a, c, t, g, unknown, or other
  misc_feature (439)..(439): n is a, c, t, g, unknown, or other
aaactggagctccccgcggtggcggccgctctagaactagtggacccccgggctgcaggaattcgtctcacccctagaaaaactcacctctcactaccaccaccactgccccggatccataccagctgcagcagcagcgcgcgcgagctagcttcggtcggtcgatagatcgatcgatcgctcggccatcatggcgcgggaggacaggcgctgctgtcgacggagatcgtgaaccgccgcgtggagccgtcgggcccggacgccggctcggcggccttctcggtgcgcgtgcgccgccgcctgccggacttcctgcagtcggtgaaccctcagtacgtgcgcctcgggtaccactacctcatcagccacggggtgtacctggccaccatccccgtcatcgtgctggtgtgcggccccaagctgggcagcctcanccgcnacaagctgtggcgcaaggtggtgggggaaggccacctacgacctcgcccacgtgctcgcctttcctcgccgtcctcgccttcaccatctcccgtctacatcatgtcccaggccaaggccccgtgtacctcatcgacttcgcatgctacaagccggccgaacgagctcagggtgtccaaggcggagttcatcgacctggcgcgcaagtccggcaagttcaa

SEQ ID NO: 53252 - protein, 39 aa, Zea mays
  misc_feature: Ceres CLONE 1472918-F
MSQAKAPCTSSTSHATSRPNELRVSKAEFIDLARKSGKF

SEQ ID NO: 53253 - DNA, 686 bp, Zea mays
  misc_feature: Ceres CLONE 1472922-F
  misc_feature (148)..(148): n is a, c, t, g, unknown, or other
  misc_feature (187)..(187): n is a, c, t, g, unknown, or other
  misc_feature (278)..(278): n is a, c, t, g, unknown, or other
  misc_feature (342)..(342): n is a, c, t, g, unknown, or other
  misc_feature (343)..(343): n is a, c, t, g, unknown, or other
  misc_feature (379)..(379): n is a, c, t, g, unknown, or other
ctccccgcggtggcggccgctctagaactagtggatcccccgggctgcaggattcgtctcacccctagaaaccacacccacaccacacctcacgtctcctcactacccgcgctctcaggcagcgcacctcgctcctcctccccacagngctttccattttcgtctatctcccgagaaacctcctgcngcctccaagctctcttgttcgttgctccccccgtgctggttatcatccccttcgattcgatcacatacatataatctctctcagctatcgncggcgcgcgcctgatcgacgtacgaccggtctggtacgtacgtgtgctcgccccgcatggctcnncgcaacggggagctggactgtccctgggggtccccnccacccgggggcccggcgggtgcccccccgggggggggggcgaacaagtgggccccaacaaccctcgggaggctcattcttcgccggaatggcccccgggcgggttcaaaaacgggtgggcccctaaaatctctccctcctacccccctaagggggaaaacttggggggttctaaaatgcccctccattttatttaaggggggcttatgcgggtcccttttgggggggtttaagggggcccaaccccgtggggttggggcctttaaacagaaaataagggtgccaaacaagaaggggggggaaaaaa

SEQ ID NO: 53254 - DNA, 668 bp, Zea mays
  misc_feature: Ceres CLONE 1472930-F
  misc_feature: Encodes the peptide sequence at SEQ ID NO. 53255
  misc_feature (447)..(447): n is a, c, t, g, unknown, or other
  misc_feature (450)..(450): n is a, c, t, g, unknown, or other
  misc_feature (451)..(451): n is a, c, t, g, unknown, or other
  misc_feature (455)..(455): n is a, c, t, g, unknown, or other
  misc_feature (490)..(490): n is a, c, t, g, unknown, or other
aaagctggagctccccgcggtggcggccgctctagaactagtggatcccccgggctgcaggaattcgtctcacccctagaaaaaaacgaactgaccacaactacctaagctaaaagctaaccaccgtacccccggccatggcgctcgcgcccacctccgctgccgtgctcaagaccccgttcctcggggccaggcgcgcgctcgccaagcccgcgcctcgccgcgcgctcgtcatcgccgccgcggccgccgccaagaagtcgtggatcccggccatcaagagcgacgccgagatcgtcaacccgccctggctcgacggctcgctccccggcgacttcgggttcgacccgctggggctgggcaaggacccggcgttcctcaagtggtaccgggaggcggagctgatccacgggcggtgggcgatggcggccgtgctgggcatcttcntgnngcangcgtgaagcggcatcccgtggttcgaggccggcgncgaaccgagcgccatcgcgccctttctctttcggtcgctgctgggcacgcagctgctgctgatggggtgggtggagtcaaagcggtgggtggacttcttcaacccgacttccagggccgtggagtggccacgccgtggtcgcccaccgcttaaaaactcgccaacttaccggggagca

SEQ ID NO: 53255 - protein, 107 aa, Zea mays
  misc_feature: Ceres CLONE 1472930-F
  misc_feature (54)..(108): Pfam Name: Chloroa_b-bind Pfam Description: Chlorophyll A-B binding protein
  misc_feature (104)..(104): Xaa is any aa, unknown, or other
  misc_feature (105)..(105): Xaa is any aa, unknown, or other
  misc_feature (106)..(106): Xaa is any aa, unknown, or other
MALAPTSAAVLKTPFLGARRALAKPAPRRALVIAAAAAAKKSWIPAIKSDAEIVNPPWLDGSLPGDFGFDPLGLGKDPAFLKWYREAELIHGRWAMAAVLGIFXXXA

SEQ ID NO: 53256 - DNA, 685 bp, Zea mays
  misc_feature: Ceres CLONE 1472933-F
  misc_feature: Encodes the peptide sequence at SEQ ID NO. 53257
  misc_feature (361)..(361): n is a, c, t, g, unknown, or other
aagctggagctccccgcggtggcggccgctctagaactagtggatcccccgggctgcaggaattcgtctcacccctagaaaaagcacggacgagcgaggcagccccgcaggtcgcagccacaacccaagcgcagcgatctgcctccgctccggctcagctcccgccctgcctccgccttccattccgccgcgcggcgctgccgagtgccgacgtcgtccccgccggagtttctggtttctgggttggatctctcggagtcggagcgagcgaagatgggcggcggcaacggtgaaaccacccagctgggggagccactgctggcgaagaaggcgaaggcgtaccgccctaggtgccccgggntgccgcccccgaccgcctcaacgcgggagcgggagggggtcttccctctcaaggacctcttcctcatctgggtcgtcaccatcacctgcaccctgccgatccagtctctggttccccttcttggatttcatggagaagggatctgcatattgctaaacaaacacaagacattgggattttttggctgggtttttgtgggcgcttcctatatggggggggaagggcaagcctccttcaacagaatggggaaaacggggcttaattaattttggaaaggaaacccggtttatcgtacctgaccctttattgcgaaaagtttatctt

SEQ ID NO: 53257 - protein, 117 aa, Zea mays
  misc_feature: Ceres CLONE 1472933-F
  misc_feature (30)..(30): Xaa is any aa, unknown, or other
MGGGNGETTQLGEPLLAKKAKAYRPRCPGXPPPTASTREREGVFPLKDLFLIWVVTITCTLPIQSLVPLLGFHGEGICILLNKHKTLGFFGWVFVGASYMGGEGQASFNRMGKTGLN

SEQ ID NO: 53258 - DNA, 674 bp, Zea mays
  misc_feature: Ceres CLONE 1472961-F
  misc_feature: Encodes the peptide sequence at SEQ ID NO. 53259
  misc_feature (472)..(472): n is a, c, t, g, unknown, or other
  misc_feature (622)..(622): n is a, c, t, g, unknown, or other
aagctggagctccccgcggtggcggccgctctagaactagtggatcccccgggctgcaggaattcgtctcacccctagaaaaatccgctggacaccccgctccgcctccactcctcgcgccgctgccgcatctcctctacaggtaagaaggagagaaagagggcgaaatggtgaagcacaacaacgtcatccccaacgggcacttcaagaagcactggcagaactatgtcaagacatggttcaaccagcccgcccgcaagcagaggcgccgcatcgcacgtcaaaagaaggctgtgaagatattcccacgaccaactgctggccctcttcgtcccattgttcaatgccagactctcaagtacaacatgaagtcaagggctgggagaggctttacccttgaggagttgaaggctgcgggcattccaaaaaggcttgctccaaccattggcatttctgtggatcaccgccgcangaacaaatcccttgaggggctgcaggccaatgtccagaggcttaagacatacaaggccaagctggttatcttccccaggcgtgctcgcaaggtcaaggctggtgactctactctggagaagctaccactgctaccaggtacagggtgacntacatgcaattactcgcggtgagagcgctctgtaaaggtggtaaggtcacaa

SEQ ID NO: 53259 - protein, 150 aa, Zea mays
  misc_feature: Ceres CLONE 1472961-F
  misc_feature (6)..(150): Pfam Name: Ribosomal_L13e Pfam Description: Ribosomal protein L13e
  misc_feature (102)..(102): Xaa is any aa, unknown, or other
MVKHNNVIPNGHFKKHWQNYVKTWFNQPARKQRRRIARQKKAVKIFPRPTAGPLRPIVQCQTLKYNMKSRAGRGFTLEELKAAGIPKRLAPTIGISVDHRRXNKSLEGLQANVQRLKTYKAKLVIFPRRARKVKAGDSTLEKLPLLPGTG

SEQ ID NO: 53260 - DNA, 692 bp, Zea mays
  misc_feature: Ceres CLONE 1472972-F
  misc_feature: Encodes the peptide sequence at SEQ ID NO. 53261
aaagctggagctccccgcggtggcggccgctctagaactagtggatcccccgggctgcaggaattcgtctcacccctagaaaaagaaaaaaatcgcactgttggaagctcttcgctgtcacccccacccacctccggcgctcttttttagcattttccttgggctctggactccaaaatcccagccttttgtttgcttctctgtctcctgctgattggtgtccccgggtccaggactcttgatttgctcctcgcgggggttcggtcccatggcggcagctgcgctggcaatggcagagcaggtggtggccgagctccgagtgaggtgtgagacgccgccgtcgatgctgcgcgaggtggccgtggagatggcccgcgagatgggcgcggggctggagaaggacggcgggagcagggtcaagatgctcctctcctacgtcgataagctccccacagggagagaggaaggattattctatggattggacctaggaggaacgaatttccgcgtcttgaaagtgcaactaggtgggaatgcgaagcatgtcgttgaccgtgactccagagaagtcggcattccgccacatctgatgtcagggagctcctcggagcttttttgtttcattgcttctgaattggccaagtttgttgacgatgatgagaagtgcgctaacatttcgaatggcagaaacg

SEQ ID NO: 53261 - protein, 141 aa, Zea mays
  misc_feature: Ceres CLONE 1472972-F
  misc_feature (3)..(137): Pfam Name: Hexokinase_1 Pfam Description: Hexokinase
  misc_feature: SWISSPROT Homolog: EC 2.7.1.1 Hexokinase
MAAAALAMAEQVVAELRVRCETPPSMLREVAVEMAREMGAGLEKDGGSRVKMLLSYVDKLPTGREEGLFYGLDLGGTNFRVLKVQLGGNAKHVVDRDSREVGIPPHLMSGSSSELFCFIASELAKFVDDDEKCANISNGRN

SEQ ID NO: 53262 - DNA, 626 bp, Zea mays
  misc_feature: Ceres CLONE 1472977-F
  misc_feature: Encodes the peptide sequence at SEQ ID NO. 53263
  misc_feature (423)..(423): n is a, c, t, g, unknown, or other
  misc_feature (424)..(424): n is a, c, t, g, unknown, or other
  misc_feature (510)..(510): n is a, c, t, g, unknown, or other
aagctggagctccccgcggtggcggccgctctagaactagtggatcccccgggctgcaggaattcgtctcacccctagaaaaaagcgcgccttcacttgtattcacagtttgcaagctagctagctaggacgagctgccagcggcgccagctagccatggcgatccgtggcgtggcctccacccgcgaggaggacatgacgctggaggagttcaaggagtggctgaagcagttcgacgccgacggcgacggcaggatcagccggaacgatctccggagggcgctccgccgccgccgccgcggccgccgctggttaaccgctagtaggagcgaccgcgcccttcgccacgcggacaaggacagcagtggcttcctggacgactccgagattgagaacctcatcagcttcgcccagaggatctcnngcatgagatatccacctggtagaagtagaagggccttctctttttttcccttaataaagctgggacgtgacatttctctgccgcgncttttaaaaaaaatacaaatgggtttgggactttggtggaatcctgtggggtgtgaccgggggacctatttccctggacacctactgttctcagcctggacccataaaaaagcttt

SEQ ID NO: 53263 - protein, 156 aa, Zea mays
  misc_feature: Ceres CLONE 1472977-F
  misc_feature (18)..(46): Pfam Name: efhand Pfam Description: EF hand
  misc_feature (90)..(90): Xaa is any aa, unknown, or other
MAIRGVASTREEDMTLEEFKEWLKQFDADGDGRISRNDLRRALRRRRRGRRWLTASRSDRALRHADKDSSGFLDDSEIENLISFAQRISXMRYPPGRSRRAFSFFPLIKLGRDISLPRLLKKIQMGLGLWWNPVGCDRGTYFPGHLLFSAWTHKKA

SEQ ID NO: 53264 - DNA, 675 bp, Zea mays
  misc_feature: Ceres CLONE 1472978-F
  misc_feature: Encodes the peptide sequence at SEQ ID NO. 53265
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
aaagctggagctccccgcggtggcggccgctctagaactagtggatcccccgggctgcaggaattcgtctcacccctagaaaaactagccgccgccagaccattcgtttctcgcgagccatcgcttctgtaattctcaggcatccggaagaaatggccaagtcgaagaaccacacggcgcacaaccagtcgttcaaggcgcacaagaacggcattaagaaacccaagcgccaccgccagacctccaccaaggggatggaccccaagttcctgaggaacctgaggtattctaggaagggcaacaaaaagagtggtgaggctgaagctgacgagtaggaaggaaagcatggctttgtttcctctgtttttagctcacttccacctttaggacctggggttttgctaaagatggaacttaagcggtgttactgtatgatggcaaggaccttttgctgccgagagttatgttttgaagttcatgctaccttttatagtacggattaccttgtgccgnnntctgtaggaatttgcatgctggatgaaaatgcacgcaggcgattccatgaaacttttaatgcgtgtcgctcggaggccccaattcgccctataatcgaggccgaatagccccgccttcctggccggcgatttacaacgtcgagactggggaaaaccccgg

SEQ ID NO: 53265 - protein, 60 aa, Zea mays
  misc_feature: Ceres CLONE 1472978-F
  misc_feature (3)..(42): Pfam Name: Ribosomal_L29e Pfam Description: Ribosomal L29e protein family
MAKSKNHTAHNQSFKAHKNGIKKPKRHRQTSTKGMDPKFLRNLRYSRKGNKKSGEAEADE

SEQ ID NO: 53266 - DNA, 613 bp, Zea mays
  misc_feature: Ceres CLONE 1473033-F
  misc_feature: SWISSPROT Homolog: EC 5.4.2.1 Phosphoglycerate mutase
  misc_feature (184)..(184): n is a, c, t, g, unknown, or other
  misc_feature (185)..(185): n is a, c, t, g, unknown, or other
  misc_feature (228)..(228): n is a, c, t, g, unknown, or other
  misc_feature (237)..(237): n is a, c, t, g, unknown, or other
ctggagctccccgcggtggcggccgctctagaactagtggatcccccgggctgcaggaattcgtctcacccctagaaaaagttccatcgccccccattgctcgccaagagttcttcttgtttaggcaaaggcaaaagcaggagcaaaaaggtttcgttggcgatggcgagctcgtggacgcttnnctgacacccgaagctccccaggggaaagccgtggctgttgtcntgctggacnggatgggcaaggccaaccccgaacagtaacactgcatccatgtccctcgaactcctgtcatggactctttaagaatggtgctcctgaaaaatgggaacttggaagggctccggaaaaatcttggggctcccctttaaaaaacactggcaaaaatgaaattggcccccaagcctttggggcggggcgaattttccccaagggtaaaattttgtaaaaaaccctctcccccggaaaatttttttgggggggggggttcccccccccaaaaaaatttttttaaaaagggcccccccccccctttgggggttaaaaaaaaaaggggggggcaccccccccccctttgtggaaaaatattttttttttttagggggggggg

SEQ ID NO: 53267 - DNA, 623 bp, Zea mays
  misc_feature: Ceres CLONE 1473036-F
  misc_feature: Encodes the peptide sequence at SEQ ID NO. 53268
  misc_feature (349)..(349): n is a, c, t, g, unknown, or other
tggagctccccgcggtggcggccgctctagaactagtggatcccccgggctgcaggaattcgtctcacccctagaaaaagtaccccaacgagaagagcggcggcgcgggcggacaaggagcaggcggaggaggagctgtgccaagccacaatgggtatctcgcgtgactcgatgcacaaacgccaggccaccggtggaaagcagaaagcctggaagaagaagcgaaagtatgagcttggtcgccagccagccaacaccaagttgtcaagcaataagacagtgaggagggtccgtgttcgtggaggtaatgtgaaatggagggctcttcgccttgatactggtaactacntcatggggaagtgaagctgttacccgcaagaccgtatcctcgacgtggtctacatgcatcatacatgagcttgtgagacacaaaccttgtgaagagtgcattgagcagttgatgctgccccattcagcagtggtacctcactcactatggagttgacattgttagaaagaaaaaacccccgctgcaaagaaggataatgctaaaggacaaaaggttaaggccacccccgaaaaaaacaaaaaaaagaacctttgtcccaaggaaatcttgaaaa

SEQ ID NO: 53268 - protein, 70 aa, Zea mays
  misc_feature: Ceres CLONE 1473036-F
  misc_feature (1)..(70): Pfam Name: Ribosomal_S8e Pfam Description: Ribosomal protein S8e
  misc_feature (67)..(67): Xaa is any aa, unknown, or other
MGISRDSMHKRQATGGKQKAWKKKRKYELGRQPANTKLSSNKTVRRVRVRGGNVKWRALRLDTGNYXMGK

SEQ ID NO: 53269 - DNA, 684 bp, Zea mays
  misc_feature: Ceres CLONE 1473038-F
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (674)..(674): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
aaagctggagctccccgcggtggcggccgctctagaactagtggatcccccgggctgcaggaattcgtctcacccctagaaaaaagtttggctccaagcagcacaaggcctttcttcctcctctgcagccaactcgtcccctcgggccaacgcgaggccaaaaccaatcacatctcctccccctgaccccctcccaccaccgaggacccttccccaagaactgccccgagtcctgtagcgggagagaggtcgagggaggagtccaataagagtttctcctcgcctctctctctttctgctcgaaaaattattgtcgcattggtttgcttcccttgccaaaggaggcggctttctgtcctcgctgatctaacatgatggcaagcaccgcgtcagtgaccgccgccgccgccgtgtttttcccccccccccccccgccgccgggaccggcgggggggctccccgcaagagggcctgccggcggtcagggggcgcctctcggaggccggggccctgccaccaccggccttgaagcccaaggcgcaaggagggggccaaaggccgccaggaattggcccggctcccataggttcaagattttcccgccacccggnnnctagagacgtagcaaccacgacgatgcagtcccgnnnnnnnnnnnnnncnnnnnnncgcgnannngccgtg

SEQ ID NO: 53270 - DNA, 834 bp, Zea mays
  misc_feature: Ceres CLONE 1473040-R
  misc_feature: SWISSPROT Homolog: EC 2.7.11.1 Non-specific serine/threonine protein kinase
  misc_feature (698)..(698): n is a, c, t, g, unknown, or other
  misc_feature (708)..(708): n is a, c, t, g, unknown, or other
ccgattgggtacctcgagcgtctcgtttttttttttttttttggcacggacagtactacagtagagcttgagcaagttgagcgtgcatggaaaaggaaaaagagatccatcctacagtgagtacagttgctatgctacactagcacgaattaatgcacatagtacttgcaggctgccgccgaccgaccgaaccaccaccaggcagcagcaagacagcctgacagggatgagatgccaacgcccaagggcccgtgccggacgacgttggttggtcggtcgccactgacggtcagtcaggatacatacagatcagaaggagccttccattctgctgcccacgggcgccttgatgacctgcaggatctggaccacctccgccatggacggccggttcgacgggatctgcgacgtgcacaccatgcccagcttcagcaccggcagcacctcctcctccgggacgcgcccgcccatgcccgggtccacgcactccagcgcgttgccgtgctccagcagggcgcgcacctggtccaccagcaccaccacgtcgtcgtccccgtactccaccgcccgacgccccgtcaccagctccaggatcagcacgcccagcccgtagatgtcgcacttctcgttcacgcgcaggctctggcacgccagctccggcgccacgtacccggccccgcccctgctgaaccgcccgncgcccatcgncacctgctgcctcccgccggcggtcgccagcagccgcgccagccccgactcgcccaccgccccggttgcactccgcgttcccaaagaagatgtttgctcggcttcaccgttgtagtggcacaacca

SEQ ID NO: 53271 - DNA, 698 bp, Zea mays
  misc_feature: Ceres CLONE 1473043-F
  misc_feature: Encodes the peptide sequence at SEQ ID NO. 53272
agagctggagctccccgcggtggcggccgctctagaactagtggatcccccgggctgcaggaattcgtctcacccctagaaaaacttccgtccgttcccccgaactctctctcctcctcgcggccacctcccatccccgttccttcccctccatctcatcaccgccgccagcgccaaaaccctacccacccaccgatggcctccccggcgccggcctcccccgcggccgcggcggcgcactgccccccgccgcgcatcgggctcgcgggcctcgccaccatgggccagaacctggccctgaacatcgccgagaaagggttcccgatctccgtctacaaccgcaccgccgccaaggtggactccacgctgtcccgcgcgcgggacgagggctcgctgccggtgctgggccaccgcgacccgcgcgggttcgtgctgtccctcgcgcgcccgcgcgccgtcgtgctgctcgtccaggccggccccgccgtcgacgcccccatccaggccctctccccctacctcgagcccggggacgccaatcctcgacggcggcaacgagtggttaaagaacacggagcgccgcatccagtaggcggcggcgccgcggcgtcctatacctcgggatggccgctctccgccgccaaggagggcgcgccgaaaacgggccctccctcatgcccggccggcagcccccaacc

SEQ ID NO: 53272 - protein, 167 aa, Zea mays
  misc_feature: Ceres CLONE 1473043-F
  misc_feature (18)..(165): Pfam Name: NAD_binding_2 Pfam Description: NAD binding domain of 6-phosphogluconate dehydrogenase
  misc_feature: SWISSPROT Homolog: EC 1.1.1.44 Phosphogluconate dehydrogenase (decarboxylating)
MASPAPASPAAAAAHCPPPRIGLAGLATMGQNLALNIAEKGFPISVYNRTAAKVDSTLSRARDEGSLPVLGHRDPRGFVLSLARPRAVVLLVQAGPAVDAPIQALSPYLEPGDANPRRRQRVVKEHGAPHPVGGGAAASYTSGWPLSAAKEGAPKTGPPSCPAGSPQ

SEQ ID NO: 53273 - DNA, 691 bp, Zea mays
  misc_feature: Ceres CLONE 1473056-F
  misc_feature: Encodes the peptide sequence at SEQ ID NO. 53274
aaagctggagctccccgcggtggcggccgctctagaactagtggatcccccgggctgcaggaattcgtctcacccctagaaaaagtccaccctcccctaccccgcgtcctcctcccctacgcctcccagcccagcggcaaaacctaaccctagatgggcgccgtcacctctacggtcgcggcgcgctttgcctttttcccgccgagcccgccgtcgtacgggttcgagcagccggcgccgcttccggcccctgccacacccgagcctccggccccggccacatccaagccgccgcctccggccccggccacacccaagccgccgcctccggccccggccacacccaagccgccgccagcgggggaggagaagggcggtggcgcggtggtggagctcacgggcgtcccgcggacacctaacgtggaggcgcggcggctgcggactaagcggggcacggaggtggtcgcgatgcacgtgcgccaggcgggggccaagctcacgctgctctactcccacggcaacgccgccgacctcggccagatgtacgagctcttcgtcgagctcagcgcccacctcaacgtcaacctcatggggtatgactattctggttatgggcaatctactgggaagcctagtggacaaaacacttattctgacatagaagctgtatacagatgcctcatagaaaccg

SEQ ID NO: 53274 - protein, 179 aa, Zea mays
  misc_feature: Ceres CLONE 1473056-F
MGAVTSTVAARFAFFPPSPPSYGFEQPAPLPAPATPEPPAPATSKPPPPAPATPKPPPPAPATPKPPPAGEEKGGGAVVELTGVPRTPNVEARRLRTKRGTEVVAMHVRQAGAKLTLLYSHGNAADLGQMYELFVELSAHLNVNLMGYDYSGYGQSTGKPSGQNTYSDIEAVYRCLIET

SEQ ID NO: 53275 - DNA, 711 bp, Zea mays
  misc_feature: Ceres CLONE 1473057-F
gctcttaactagtggatcccccgggctgcaggaattcgtctcacccctagaaaaaactcgcctccctcccggtcccggtcccggcctcccccctccccctccgctccccccaaccccagaacatccggcgctttcaccccccttcccctcccctcccctcccctcgtcctccgcgatggcggcgtccatggcgtcgccgcgggggcggtcgatccgggagacggtgctggagaccgtggcggcgtacaccagcagcagcgggcaaggggaagctgcgcaagagcctcaccttacccggaggcgagttctcgtccgcgggccggggcccgcggggaaggtttgggtgtacacctccggtctcctcggctttgggggccccaacaacaacgcacacgccttcccggtgaggaggaaggagggcaccctccaagtttcgtccagctcggggggcaacccggcttaagaaacgttcctcttccttatggggggaaccggggggagggcaccgggccttccgccgaggccaatcaaggaaccctctcccggaacaagttttggcaaaaaaaatccgggtcctccaaaagggtttgtggaaggggaaaaggcggggcgggcgcgctttaagaaatggggaggctttcttcaatgtttctgggctaacccacggtaggcttggaaaggggtgttccccccgccccccccgtgtgaggg

SEQ ID NO: 53276 - DNA, 706 bp, Zea mays
  misc_feature: Ceres CLONE 1473065-F
  misc_feature: Encodes the peptide sequence at SEQ ID NO. 53277
  misc_feature (622)..(622): n is a, c, t, g, unknown, or other
  misc_feature (651)..(651): n is a, c, t, g, unknown, or other
aaagctggagctccccgcggtggcggccgctctagaactagtggatcccccgggctgcaggaattcgtctcacccctagaaaaagaaacccacagcaaaaccggaacagaaagccttggaagcctaggcggaagcagaactgggaaggggagaagattctgatggggactaagaaacagggaggaggcggaggaaaccagaaggtcctcctctggaggctgccggtggtcacctctaaggagctcggcaagataggccccgccctcggaatcggcatcggctgcggcgccggcgcaggcatcggattcttcggtggtgcagggttaggctatggatttcctggactcacattaggctttggagttggagctggatgtggtgtgggaattggctttggttatggcttgggcaaaggaattgcatatgatgaaaagaaaaaatactccaacgttggcaagatgttccaggaagctccacattttcctatggacactgtcggtgctttatttgacgagctggttataaacaccaagaagcttgtgacatctagaaaaagtaaccgacacacttcccactcatctcgtcctcatccctcgttccccacccaccccaccccaagatntcgccgcggccaccgcttcctctatgggncgcgcagcccgccgcctttctctgctcgtcgtcaccgtagctggagccctggtgc

SEQ ID NO: 53277 - protein, 181 aa, Zea mays
  misc_feature: Ceres CLONE 1473065-F
  misc_feature (154)..(154): Xaa is any aa, unknown, or other
  misc_feature (164)..(164): Xaa is any aa, unknown, or other
MGTKKQGGGGGNQKVLLWRLPVVTSKELGKIGPALGIGIGCGAGAGIGFFGGAGLGYGFPGLTLGFGVGAGCGVGIGFGYGLGKGIAYDEKKKYSNVGKMFQEAPHFPMDTVGALFDELVINTKKLVTSRKSNRHTSHSSRPHPSFPTHPTPRXRRGHRFLYGXRSPPPFSARRHRSWSPG

SEQ ID NO: 53278 - DNA, 686 bp, Zea mays
  misc_feature: Ceres CLONE 1473072-F
  misc_feature: Encodes the peptide sequence at SEQ ID NO. 53279
  misc_feature (551)..(551): n is a, c, t, g, unknown, or other
cagagctggagctccccgcggtggcggccgctctagaactagtggatcccccgggctgcaggaattcgtctcacccctagaaaaagaaccctagccgagatcagatcggaggcgagcgccaccaccgaccggaggaagaggacgacacgatgctgcgggttgcggggagaaggctctcgtcttccctctcctggcgccccgccgcggcggtagccaggggccccctcgccggcgctggcgtccccgaccgggacgacgactcggctcgcggacggagccagccgcggttctccatcgactcccccttctttgtcgcttccaggggtttctcttctactgaaacagttgtcccaaggaaccaagatgctggcctagctgacctcccagcaactgtggctgctgtgaagaatcctaaccctaaggtggtttatgatgagtacaaccatgaaagatatcctcctggagatcccagcaagcgtgcctttgcatactttgtcctgagtggtgggaggttcatatatgcttccctgctgcgtcttctctactggaanttggcccttgacatgtcagcaagcaaggatgtgcttgcccttgcttcactttggggggacctcttccgtacccggcccaggcccccagtgacccttaaagtggcctgaaaaacccattttttactagggtttgag

SEQ ID NO: 53279 - protein, 169 aa, Zea mays
  misc_feature: Ceres CLONE 1473072-F
  misc_feature: SWISSPROT Homolog: EC 1.10.2.2 Ubiquinol--cytochrome-c reductase
  misc_feature (134)..(134): Xaa is any aa, unknown, or other
MLRVAGRRLSSSLSWRPAAAVARGPLAGAGVPDRDDDSARGRSQPRFSIDSPFFVASRGFSSTETVVPRNQDAGLADLPATVAAVKNPNPKVVYDEYNHERYPPGDPSKRAFAYFVLSGGRFIYASLLRLLYWXLALDMSASKDVLALASLWGDLFRTRPRPPVTLKVA

SEQ ID NO: 53280 - DNA, 664 bp, Zea mays
  misc_feature: Ceres CLONE 1473075-F
  misc_feature: Encodes the peptide sequence at SEQ ID NO. 53281
  misc_feature (664)..(664): n is a, c, t, g, unknown, or other
ggagctccccgcggtggcggccgctctagaactagtggatcccccgggctgcaggaattcgtctcacccctagaaaaaacattcggattcttcgaggcgcggagaccgcggtcggcgaactggtggccgtagtgtccagccgtggtgcgctctccgctgagagccttctcccagatccgcagcggcgctggcttgagatatatctttgattttcaagggaagatggcaaagtcttgctagtatcctatggatttggctggcgctgcgacaggataaggtggtggggtgcttgatcggtcagttgagaaaactactcctggtcgccaggctgaatttgatgccactgatgcccggaaaatgtcgcctccataccgtcgttcatcctgcacaatgcctcctacgacaggagcatctacgttctctagagtactgatgagagtgatccctggaatgaccgtcgacttacgctgtgaacatcacgcaagacgccgctcatgagtgggctgtcataggtgattgtctgttcccagacccaggctgcagatctctgctcgtatctcagggtcatcgggctccggagctcgatcgatcccgcgagtgctggctgctgaaggtcaagacttgcgggaataccttcttgttttagcagcgcttagtttgtaan

SEQ ID NO: 53281 - protein, 46 aa, Zea mays
  misc_feature: Ceres CLONE 1473075-F
MSPPYRRSSCTMPPTTGASTFSRVLMRVIPGMTVDLRCEHHARRRS

SEQ ID NO: 53282 - DNA, 686 bp, Zea mays
  misc_feature: Ceres CLONE 1473076-F
  misc_feature (293)..(293): n is a, c, t, g, unknown, or other
aaagctggagctccccgcggtggcggccgctctagaactagtggatcccccgggctgcaggaattcgtctcacccctagaaaaaatagagagagccactggccacaggtaggcaggcaggaggacgagtcggcaaggaagctgcctgctttcagaaagagtcatagagatagttattaagatggcgttgcttcggctgcttgccctctccctgctcttcgcagtggccactcctgtcagggacatcgcccacgatgcctgctcgtcagaagtgaaggatttccagcacctgancaacagctcggggctccacctgacgctgcaccaccgcagagcccctgctccccgggccgcttgccgcgacctccctttctcgcggtgctcgccacgacggggggggattggggcccccccccgggggcttggcaagaagcgtcctttcggccaccttgtttgcaaaagccgggggggttttttcttctccccaaaaaaaagcccttcgtcccgtcccttggccgggaaaatcctggggtgtggaaaaactcccccctggggccccggacccccgcaaaattatttttgggttggggaacggggtcccccccccggggccccgggtcccccccgggtggttgggcccccccaaaggggccgggttttacccccggggggccccccccccccccc

SEQ ID NO: 53283 - DNA, 661 bp, Zea mays
  misc_feature: Ceres CLONE 1473077-F
  misc_feature: Encodes the peptide sequence at SEQ ID NO. 53284
  misc_feature (395)..(395): n is a, c, t, g, unknown, or other
ctagaactagtggatcccccgggctgcaggaattcgtctcacccctagaaaaaattttttttgcttcccccccctcttgcccctcccctgtgctgtgctgtgaactgcggccgggggcatccttgttggggggtggtgtaggaggctgctgacactactgcagagcagggcagccatgaggcttcctctccctctgctggccctggtgtgctgcgccctgatggcgcgccagcattgcgtctgcggcgggcaaggcccggcacttgaggtgggagatacagcaacatgttctggtctcccgactgccaggagaaggtggtgatcggcatcaacgggcagttcccggacccaacaatccgcgcccgggctggcgacaccgtggacccccacctcangaacgcgctccacaccgagggcgtcgtcatccactggcacggcatccgacatatcgggacgccgtgggcggacggcacggcggcaatctcccagtgcgccatcgaccccgaggaaaccttcacctaccgcttcttcgtcgacaagccggggacatactgctaccacgggcactactggatgcacagggcggccggggctgtaccggtcccttatccaggaatttgacggacggcggatgaggaaccgttccagaacgaacgctgag

SEQ ID NO: 53284 - protein, 111 aa, Zea mays
  misc_feature: Ceres CLONE 1473077-F
  misc_feature (3)..(111): Pfam Name: Cu-oxidase_3 Pfam Description: Multicopper oxidase
  misc_feature: SWISSPROT Homolog: EC 1.10.3.3 L-ascorbate oxidase
  misc_feature (37)..(37): Xaa is any aa, unknown, or other
MFWSPDCQEKVVIGINGQFPDPTIRARAGDTVDPHLXNALHTEGVVIHWHGIRHIGTPWADGTAAISQCAIDPEETFTYRFFVDKPGTYCYHGHYWMHRAAGAVPVPYPGI

SEQ ID NO: 53285 - DNA, 881 bp, Zea mays
  misc_feature: Ceres CLONE 1473078-F
  misc_feature: Encodes the peptide sequence at SEQ ID NO. 53286
  misc_feature (19)..(19): n is a, c, t, g, unknown, or other
  misc_feature (20)..(20): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
ctcccgccccaccaccacnnccaccccccnnnnnnnggtaacnnnnnggaaaataaagatcccctcggtggcggccgctctagaatagtggatcccccgggctgcaggaattcgtctcacccctagaaaaagacgtcccaatcccaaccctactcctttgtctccccctaatgatatcgcctggcggcgtcttctccgccgtgctcgtcgccgaggacttcccttgggtggacatggacgacgagatggggatgggctccggactgtaccgccgggggttttatcttcataccgccggtgaatagagtcgtccgccaccggtttctttttgagacccatatggtggtggtgctggcgtttttctttgccggctctattcccgtcgtcccctgcatatcaggagtttttttaacccgcctgtgtggagggggggggggggggcgcgttcgattgtttttttgttcgggtaaacccccacctctcccccaaaaaaatataaattattaggaattatgtagccgtgttaggagtaggtagcagatccgccttctcccggacgaagactacgctggccctcttttcaccccgtttgcttacgtgcgctctctattacccgccccccatttgtctccgcggatacgctaatattactgtccgtgtgtcaagacttcctttacccgttgtccttctcctccattgctttattatccttctctatcacttccttactccgcccttatgcttctcgcggatccggtcttggcgtactgtatatatcaccgccgcgccgcgggatctatacctcactttgtatccccgttcgtcggcgtcgatgccttgtgaagattagcgcttctccacgctccgatcccgcgtcctcg

SEQ ID NO: 53286 - protein, 44 aa, Zea mays
  misc_feature: Ceres CLONE 1473078-F
MISPGGVFSAVLVAEDFPWVDMDDEMGMGSGLYRRGFYLHTAGE

SEQ ID NO: 53287 - DNA, 721 bp, Zea mays
  misc_feature: Ceres CLONE 1473084-F
aagctggagctccccgcggtggcggccgctctagaactagtggatcccccgggctgcaggaattcgtctcacccctagaaaaaaaaccaaacgagctgctagcccttctaaccttgctcgacccttgcccgccgcctgaactcgcctcccccgcggccggtcccctgcatctgttcgccgcgccgcaacccggaggagactacgactacgagcaccaccaggtagcagcaactgttttgctgcaatctgacaaagtggagggtttaagagtcgctgcttcttttatgtctgaacaatctttgctttatttgggattgctgggagagtattcttgcgcgacgaggaaaaggcacaagtttctgctccactgaatgcatcaaaaacccatccggtttccttgttctgaggtgtcattcccccccccctcagagccggcttggttttctcgaaagatcaccacccactcttgattcacgactttgtccccccggatagcatctagtttatacatttttttcccaggagggcactcaaaacatttggtgctttcaaaagggaatgatgccttctcccgggaccaagatgccccgaatgtttcccagaaaggaagggcggggaaagggttccaaaacaaaaattgggaacatgggttaaatataaaaaaagattttgtccggtcctgtttccctaaacaccccaaacctttgtgggtgggggcctg

SEQ ID NO: 53288 - DNA, 670 bp, Zea mays
  misc_feature: Ceres CLONE 1473095-F
  misc_feature: Translation starting site: 141
  misc_feature: SWISSPROT Homolog: EC 1.8.1.8 Protein-disulfide reductase
  misc_feature (478)..(478): n is a, c, t, g, unknown, or other
aagctggagctccccgcggtggcggccgctctagaactagtggatcccccgggctgcaggaattcgtctcacccctagaaaaaattcactcacccacctagctagtcatcactagtcacgttcgtccaccagagacaacaatggccatggagacgtgcttcagagcgtgggcgctgcacgcccccgctggcagcaaggacaggctcctcgtcggcaacctggtgctgccgtcgaagcgggcgctcgcgccgctgtccgtgggccgcgtcgccacgcgccggccgcggcacgtctgccagtccaagaacgcagtggacgaagttgtggtggcggacgagaagaactgggacgggttggtgatggcgtgcgagacgccggtgctggtggagttctgggcgccgtggtgcgggccgtgccggatgatcgcgcctgtgatcgacgagctggccaggactacgcccggcagatcacgtgctgncaggtgaacaacgacgacagccccaacgtggcgtctacctacggcatccgcagcatgcccaccgtgctcatcttcaagggcggcgagaagaaggagagcgtcatcggcgccgtcccagaagtcacgctcaccaccctcatcgacagtacatcggtagttcatgagcatgccatgccatgccatgcatacata

SEQ ID NO: 53289 - DNA, 786 bp, Zea mays
  misc_feature: Ceres CLONE 1473100-F
  misc_feature: Encodes the peptide sequence at SEQ ID NO. 53290
  misc_feature (13)..(13): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (45)..(45): n is a, c, t, g, unknown, or other
  misc_feature (46)..(46): n is a, c, t, g, unknown, or other
  misc_feature (316)..(316): n is a, c, t, g, unknown, or other
  misc_feature (317)..(317): n is a, c, t, g, unknown, or other
  misc_feature (508)..(508): n is a, c, t, g, unknown, or other
  misc_feature (715)..(715): n is a, c, t, g, unknown, or other
gggaggaccacanaataaaattaagtggtgggnnnnnctctctcnntacaaaactggagctccccgcggtggcggccgctctagactagtggatcccccgggctgcaggaattcgtctcacccctagaaaaatacatggtgttcgcttgctccgactcccgtgtgtgcccatcggcgaccctgggtctgcaccccagcgagggcttcaccgttcgcaacatatccgccatggtccctgggtacgagaagaaaaagtagaacggaatcgggtccgccatctagtacggtgtgtgcgctctcaaggtggaggtcctcnngggtcattgcccataactgatgaggtggcatcaaggcggtcttctcccttcgagtaggggggaagtggatttttttgtttttttttcgaagaatggcagttataaaccgcctcccccgccccggagggaggggagatgtaatgtggtatggagttagatatgccccccgcttgccccccccccccaatccnccaacaaagaagagcgcgtgaatctcaccccccctctaagtcccctctgtggaacgaacccctttgctgccggggtaggtgcctgggccaattgggaaccactaacgactgatattgttgcccaccatacttccttttgtttccaggtgaagatgcctcactatggatataaggggaaaaaaggtggggcaatcagccaatttttanacggcccgcgcgagccccagcaatatacaagaatctgagttcaaataaggaagctagcaacgaatcatacc

SEQ ID NO: 53290 - protein, 40 aa, Zea mays
  misc_feature: Ceres CLONE 1473100-F
  misc_feature: SWISSPROT Homolog: EC 4.2.1.1 Carbonate dehydratase
MVFACSDSRVCPSATLGLHPSEGFTVRNISAMVPGYEKKK

SEQ ID NO: 53291 - DNA, 682 bp, Zea mays
  misc_feature: Ceres CLONE 1473110-F
  misc_feature: Translation starting site: 474
  misc_feature: SWISSPROT Homolog: EC 3.2.1.21 Beta-glucosidase
  misc_feature: SWISSPROT Homolog: EC 3.2.1.147 Thioglucosidase
  misc_feature (629)..(629): n is a, c, t, g, unknown, or other
aaagctggagctccccgcggtggcggccgctctagaactagtggatcccccgggctgcaggaattcgtctcacccctagaaaaaactactcaagccgctcaaaactctagctagctagcagggggggaaatggctccacttctcgccgcagccatgaaccacgctgcccatccagtccttagaagccatctaggacccaacaatgagagtttctcacgacaccacctatcttcttcaccgcaaagcagtaagcgaaggtttaaccttagctttacgccacgatctgcaagagtaggcaatcaaaatggagtccaattgttgagcccttcggaaatccctcgaagggactggttcccctccgacttcatctttggtgccgccacttcagcgtaccaaattgaaggtgcttggaacgaagacccccacggcgaaagcaattgggatcacttctgccacaattttccggaaagataatggacgggagcaatgcagacattggagcgaattcgtaccatatgtacaaaacggatgtcagattgctgaaagaaatgggcatggacgcatataggttctctatctcttggcctagaatactgcctaagggaacggtcgaaggaggtataacccangatggcatcgattactacaaaaggctcatcaacttgttgctagagaatggcaa

SEQ ID NO: 53292 - DNA, 740 bp, Zea mays
  misc_feature: Ceres CLONE 1473117-F
acccgcggtggcggccgctctagaactagtggatcccccgggctgcaggaattcgtctcacccctagaaaaaacactcgtgcacggcaccatcgctctttgctctggctcgtcgtgtggtagagtacaggatggagtcccgacgccctctcttcgccgccgtcttcctcgccgcggatggttctgctcctcctttctccagcagaatagaccacggtgggcgtgaacgacggtcgcgtgtggaacaagatgcccaaaccagcgaaggttgagtagctgctcaagcggcaagaaatcgcgcatgaggagctgtgcgacttagacccacccgtgctgtaagccttttttaagcgcggcatgagggggaaatagctcattccaaaccataagggtgagggccggaaccccccccccatcctaaaaaactggttaaagtgggcccagaaaggaggggaaaaaacccacgggcacggggatttggggggcttgcaaggggaaaggaaagcgttttctcttggacccaaaaatccgcgcggttttaagggccccggctaagggcgacttggaggggcccttttttgccggaaaaaggcccccgaaagcgccctattaggggttttttcccacacaaccgcacaaaagggctttccccgttttaaaaacaccacccccgggagaggccttctttttgaggctccccccaggggggaggggaaggagttccccctggttctggtgtgg

SEQ ID NO: 53293 - DNA, 672 bp, Zea mays
  misc_feature: Ceres CLONE 1473119-F
  misc_feature: Encodes the peptide sequence at SEQ ID NO. 53294
  misc_feature (489)..(489): n is a, c, t, g, unknown, or other
  misc_feature (537)..(537): n is a, c, t, g, unknown, or other
aagctggagctccccgcggtggcggccgctctagaactagtggatcccccgggctgcaggaattcgtctcacccctagaaaaactccgtgctttctcagaggcgggttggcttctcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgcggaggcggcggtggcggatacggtggcgggcgccgtgatggaggcggctacngcggtggcggtggcggctaccgaggtggtcgtggaggctacggcggcngcggtgggggatacggtggtggaaacctgcgcggcggctacggcaacaacgacgggaactggagaaactgagcgtggggtccgctgaagcctagttatcttggtcgcttctgctaccgtgtcaccctagtctaga

SEQ ID NO: 53294 - protein, 146 aa, Zea mays
  misc_feature: Ceres CLONE 1473119-F
  misc_feature (10)..(81): Pfam Name: RRM_1 Pfam Description: RNA recognition motif. (a.k.a. RRM, RBD, or RNP domain)
  misc_feature (48)..(141): Pfam Name: GRP Pfam Description: Glycine rich protein family
  misc_feature: SWISSPROT Homolog: EC 5.2.1.8 Peptidylprolyl isomerase
  misc_feature (108)..(108): Xaa is any aa, unknown, or other
  misc_feature (124)..(124): Xaa is any aa, unknown, or other
MAASDVEYRCFVGGLAWATDDHSLNNAFSTYGEVLESKIILDRETQRSRGFGFVTFSTEDAMRSAIEGMNGKELDGRNITVNEAQSRGGRGGGGGGYGGGRRDGGGYXGGGGGYRGGRGGYGGXGGGYGGGNLRGGYGNNDGNWRN

SEQ ID NO: 53295 - DNA, 670 bp, Zea mays
  misc_feature: Ceres CLONE 1473124-F
  misc_feature: Encodes the peptide sequence at SEQ ID NO. 53296
aaactggagctccccgcggtggcggccgctctagaactagtggatcccccgggctgcaggaattcgtctcacccctagaaaaagttcactttccccggttgcccgtcaccactgacgcgcggctcccccgaggcccttcccatcgccgcgtataaaggttcgctgcccgccacgagaagatgaagctcaccgccacctccacgctcgaagctcctccagaaccggccgcatcgtcgccatggcagccgccgctactgcaagctccgtgaaggaagagctgccgtcgcccctgacctccgcctcgtagccgcctccccttttcgatggcaccaccaggatgtacgtggcctatctgtgcccgttcgcgcagcgcgcttcaattgctagaaactacaagggactgcaagacaagattaagacagttgccatctatctcgctgactagccagcctagaacaaagagaaggtgtatccgcaaaacaaggcgacttctctagagcacgacaaccccttagaaggatacagcttggaattcggttaagtacatcggacaacaactgtaaaatgtcccatctttgccccgcgagggatcatggcaaagcgggccccttcggatgagggacctggcccgggatacccctgaccctatttcaaacaaatccttatttcc

SEQ ID NO: 53296 - protein, 35 aa, Zea mays
  misc_feature: Ceres CLONE 1473124-F
MYVAYLCPFAQRASIARNYKGLQDKIKTVAIYLAD

SEQ ID NO: 53297 - DNA, 768 bp, Zea mays
  misc_feature: Ceres CLONE 1473126-F
  misc_feature: Translation starting site: 144
  misc_feature (365)..(365): n is a, c, t, g, unknown, or other
  misc_feature (366)..(366): n is a, c, t, g, unknown, or other
  misc_feature (404)..(404): n is a, c, t, g, unknown, or other
  misc_feature (417)..(417): n is a, c, t, g, unknown, or other
  misc_feature (418)..(418): n is a, c, t, g, unknown, or other
  misc_feature (423)..(423): n is a, c, t, g, unknown, or other
ccccgcggtggcggccgctctataactagtggatcccccgggctgcaggaattcgtctcacccctagaaaaaccggaaactggtaccatctgccgccttagccatccgcttgttctcttcggttcaattctcgagtttccaggatgaaggtaatatctgcctatctgcttgctgttctgggtggaacacttccccgactgctgatgatgttaagagcattctggaatcagttggtgttgaggttgatgaagaaaactagagttcctgctcacaaatcttaaagacaaggacataacacaagtcattgcacctggaacggaaaggttaccatctgttgcttcccggtggtggagctttttgttttnnaaaatacagaagggggcaattaggttttggggaaacanccctctccccaanntattnaataaaaaaaaaggttaaagaaaaaggaaaaactctaaaaaaaaaatggcggttcttaggtgttttttaaaaaagaacacccttacctgatttcgcggtttcccgcggaaagagggcccaaaaaaattgggtcgggctttccccatatataaaagtgggtcattcgctccgtccccctctttctttttttttcccccaggtaaaatccaacgtgctgcgtttctttgaaatttcttttccttctattattcgtccccccccccttatatattattttgacaaaatagccagcgtgtgtggcggccgaaacgcttttttgctcgctctggactccttttttcctgg

SEQ ID NO: 53298 - DNA, 700 bp, Zea mays
  misc_feature: Ceres CLONE 1473128-F
  misc_feature: Encodes the peptide sequence at SEQ ID NO. 53299
aagctggagctccccgcggtggcggccgctctagaactagtggatcccccgggctgcaggaattcgtctcacccctagaaaaaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaaagatgctgttgtcacggtccctggctacttcaacgactcacagaggcagggccacgaaagatgctgggg

SEQ ID NO: 53299 - protein, 166 aa, Zea mays
  misc_feature: Ceres CLONE 1473128-F
  misc_feature (9)..(166): Pfam Name: HSP70 Pfam Description: Hsp70 protein
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVIPGPGEKPMIVVQHKGEEKQFAAEEISSMVLIKMREIAEAYLGSTIKDAVVTVPGYFNDSQRQGHERCW

SEQ ID NO: 53300 - DNA, 835 bp, Zea mays
  misc_feature: Ceres CLONE 1473129-F
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (426)..(426): n is a, c, t, g, unknown, or other
  misc_feature (815)..(815): n is a, c, t, g, unknown, or other
ctttccccccgcccccgccatctactccctttnnnncaaccccnnncaaaagctggagctccccgcggtggcggccgctctagaactagtggatcccccgggctgcaggaattcgtctcacccctagaaaaacccccgtgccctccgcggctccgccgcactcatcttctattcttcttccctcccctccgtcaccactcaccacctcccctatggcaagggcgcttctcccggcctcttcctccccttcctgccagaccatcttcctaccgcaacggacctgacggtttccatccacctggcttctctgtcgcgcgagctgatcgacccacccaacggaagtgcaatgccgtgccgagtctagatcgagctgcttagcgtctgatcacggtgtaggtcacccagatccaccgcgattgggtgtanaaaaactttcaccccctttgccttttttttttttcgaacccccacacccccccacttataccttccataccctcttcctttccgagcggtcatctgggggcacacccgggcggagctcccccttagttctcaggtggcccgaaggccctcccgaccgggttccctttcctttcgtgcgaacccagtctaaccccttccgggcgccctggggacggccttaccccggtctggcatttctccttttcggacaggactagggatgctgttttcggattaaccatctttcccccccctttagaaattcccctccgaattcctatgtggaatggccctttgcctggctcaaacaagcgtggccacacatcggggtgaaaccttttctaccacgngaaccgtggaaaagtcggcg

SEQ ID NO: 53301 - DNA, 859 bp, Zea mays
  misc_feature: Ceres CLONE 1473131-F
  misc_feature: Pfam Name: PEPcase Pfam Description: Phosphoenolpyruvate carboxylase
  misc_feature: SWISSPROT Homolog: EC 4.1.1.31 Phosphoenolpyruvate carboxylase
  misc_feature (307)..(307): n is a, c, t, g, unknown, or other
  misc_feature (405)..(405): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (422)..(422): n is a, c, t, g, unknown, or other
  misc_feature (423)..(423): n is a, c, t, g, unknown, or other
  misc_feature (859)..(859): n is a, c, t, g, unknown, or other
aaagctggagctccccgcggtggcggccgctctagaactagtggatcccccgggctgcaggaattcgtctcacccctagaaaaaatcgcatcgcagcagcacgagcagcacgccgtgccgctccaaccgtctcgcttccctgcttagcttcccgccgcgccatggcgtcgaccaaggcacccggccctggcgagaaacaccctccatcgacgcgcagctccgtcagctggtcccaggtaaggtctccgaggactacaagttcatcgagtacgatgcgctgctcgtccacccgcttccgcagacgccntcaggaccttctatgggccccatccttcgggaaatctggctcgggaagggctaatgatttggcccccccgagggggggggggggggggggcccccccnccactcttnnntaaaannatgccgccccccactggagggggagcgggaccctctcgtcctccaccctatccccttgcggggcgaacccccccaattccactaacccatggcgagatgaaatatcgataacattccccttaccaagagacgcccagccctcatcatatatcacgcccccctccccccctcatacaacgccgttcgttacgacaatagtagagtacctccgctatccgccgactcccgccccctctgtccccgccaccccactactaatgcctaacgcgccccgcaaatttaagcgccccggcgactcctgctccaccatgattaccaacccggcataaacgcgtactcatttcgcagtatggtgtgtgaagagagagtagaatccaaacgtcggatgaccccctttatctcgccccttatctttccaacaccaccatcatcctcn

SEQ ID NO: 53302 - DNA, 690 bp, Zea mays
  misc_feature: Ceres CLONE 1473132-F
agagctggagctccccgcggtggcggccgctctagaactagtggatcccccgggctgcaggaattcgtctcacccctagaaaaaacttggacttggttattcatcaaggccaccccgcaaccgcaacgtctctctagcgtctagcctctgcctgcgctcccacactagaacagcacaccgctccgcgtgcgtcgcccgcactcctcacctctgccagtatgcctaccgtgccgtgccgtgccgtgctccccacccgatgcagccgccgacgcgggccgtgccgagccacaaccggagatgagctccagaaaccgttccgccgccgcctcatccgctgccccggctctccggacactgcgccgccttgaagcggcggccagttaacgagtcggcgccggagccgggcagcgtgccgccgatccggcccgcgacgacgctgctgaaatgggacgacgttggcgactgctcgtcgcgttgaggggaggaacgctggcatctactaaacggaggactacaagctgggcgcgggagaccaacgcgaacgccacgtacgtgtccgtgcaaagagctcgcgacggggtttgacggctgcgcctcccggacgtcgaggcctgcggcctgagcggcaaccccatgggctactagcatatcccaagcatctacaagttcagcttctgaaacacaacactt

SEQ ID NO: 53303 - DNA, 682 bp, Zea mays
  misc_feature: Ceres CLONE 1473576-F
  misc_feature: Translation starting site: 173
  misc_feature (235)..(235): n is a, c, t, g, unknown, or other
  misc_feature (638)..(638): n is a, c, t, g, unknown, or other
aagctggagctccccgcggtggcggccgctctagaactagtggatcccccgggctgcaggaattcgtctcacccctagaaaaagcaggccgtcatcccacgcattcgcatccttccccgctctcgctctctcagccgcagagccactcgtgtcggtgacggcggcgaagggcatgtcatccctccgccccgtcctcctgctcgtggtgtcgctgctcgcggcggctctgcttgcngcggcgccgtcctccgcgtctcgcgacctcggcccgctccaggcgagcttcgtcgtgcgcggccgcgtctgggtgcgacactgccgcgcgggcttcgagacccccgcatccacctacattggcggagctaaagtgagagtcgactgcaaatcggaggacgacgggggcaaatacatgcagcttcgaggggatactgacggcaccggcaccctacacatcctttgtcattgatgagcatgagcatgagctctgccagtccgtccttgtgagcagccgggacaaggggtgtgccaatgttgtgggctggtcctgaagagggcccccgtttttccttacaggaaccaaggggtgtgccatcccacgtttcgtttgggcaagtggtctgggggttccaaaaggaccnttcccctttcctagatgcggcggaaaattcctcaagattgtccc

SEQ ID NO: 53304 - DNA, 664 bp, Zea mays
  misc_feature: Ceres CLONE 1473579-F
  misc_feature: Encodes the peptide sequence at SEQ ID NO. 53305
gctctaaactagtggatcccccgggctgcaggaattcgtctcacccctagaaaaacccaactttttgttcctcgcgccgccgccgccgccgccgtgacggaaggaagaggaggagcaaggagcacgacgcgatgggccactccaacgtgtggaactcgcaccctaagaactacggccctggctcccgggtctgccgggtctgcccgaaccctcgcggtctgatcaggaagtacggggctcatgtggctgcaggcagtgctccccccagcaacgggaagggacttgggctttcctcaagtaccgttgaaaaaggcactggtgttgctgggggaaactttcttactcccacaaaatggggcccggggggggaggggctatttattcccatttaacgcgcccccccccaaacttgaagaccgtggtgccaaacccggcttggttcaaactcttgacaggctaatttggcgtctggttgggcccggcttctccccaggagtctggaggttcggggagcgaggggaggaccggcggcccaacccccgatcttgtagcctagaggtagtgcgccgggcggcgccgcgttaccggggagaaggatccccgcccgtgcagggaaactaccccgccggcccgcgcaaccggccgccttgtggggccccggggg

SEQ ID NO: 53305 - protein, 86 aa, Zea mays
  misc_feature: Ceres CLONE 1473579-F
  misc_feature (3)..(55): Pfam Name: Ribosomal_S14 Pfam Description: Ribosomal protein S14p/S29e
MGHSNVWNSHPKNYGPGSRVCRVCPNPRGLIRKYGAHVAAGSAPPSNGKGLGLSSSTVEKGTGVAGGNFLTPTKWGPGGEGLFIPI

SEQ ID NO: 53306 - DNA, 639 bp, Zea mays
  misc_feature: Ceres CLONE 1473582-F
  misc_feature: Encodes the peptide sequence at SEQ ID NO. 53307
  misc_feature (347)..(347): n is a, c, t, g, unknown, or other
  misc_feature (373)..(373): n is a, c, t, g, unknown, or other
aagctggagctccccgcggtggcggccgctctagaactagtggatcccccgggctgcaggaattcgtctcacccctagaaaaaagcaaataagacgacttgtttcattgattcttgaagagatcgagcttcttttgcaccacaaggtcgaggatgtcttgcaactgcggatcaagctgcggctgcggctcaggctgcaagtgcggcaagaagtaccctgacctggaggagacgagcaccgccgcgcaggccaccgtcgtcctcggcgtggccccggagaagaaggccgcgcccgagttcgtcgaggccgcggcggagtcccgcgaggccgccacggctgcagctgcngtgcaactgcaagtgcgacccctgcnactgctgatacatcgatcgacgacctggatatgattatatctatctagctgggggtggtggttaacataatagcgaggcgagctggctgcatacataggtatggggggggtgtgtaaaaaaaaaaaacagagttctccgttggctatctctcctgcatgtttggcgccgtcttttgtgctctgaccgaccgggtgccacctgctggtggttgatccaattgatctgctgaaaccataattaattggcccccgataatttatttaat

SEQ ID NO: 53307 - protein, 84 aa, Zea mays
  misc_feature: Ceres CLONE 1473582-F
  misc_feature (1)..(64): Pfam Name: Metallothio_2 Pfam Description: Metallothionein
  misc_feature (74)..(74): Xaa is any aa, unknown, or other
MSCNCGSSCGCGSGCKCGKKYPDLEETSTAAQATVVLGVAPEKKAAPEFVEAAAESREAATAAAAVQLQVRPLXLLIHRSTTWI

SEQ ID NO: 53308 - DNA, 671 bp, Zea mays
  misc_feature: Ceres CLONE 1473589-F
  misc_feature: Translation starting site: 237
  misc_feature (278)..(278): n is a, c, t, g, unknown, or other
  misc_feature (279)..(279): n is a, c, t, g, unknown, or other
  misc_feature (294)..(294): n is a, c, t, g, unknown, or other
  misc_feature (297)..(297): n is a, c, t, g, unknown, or other
  misc_feature (303)..(303): n is a, c, t, g, unknown, or other
  misc_feature (304)..(304): n is a, c, t, g, unknown, or other
  misc_feature (312)..(312): n is a, c, t, g, unknown, or other
  misc_feature (325)..(325): n is a, c, t, g, unknown, or other
  misc_feature (326)..(326): n is a, c, t, g, unknown, or other
  misc_feature (456)..(456): n is a, c, t, g, unknown, or other
  misc_feature (518)..(518): n is a, c, t, g, unknown, or other
aagctggagctccccgcggtggcggccgctctagactagtggatcccccgggctgcaggaattcgtctcacccctagaaaaaacctactgacgagctcgccatggcctccctctcctctgccgccgtcaccgccccttccttcgccgcaccagcgccagcccgcgccgtggtcagaaagaggtcccttcacgtgcgcgcctctctccgcaagggcaccggcaccgccgccgtggcaatggctgccagcgccctgcttgccggcgggtgcatggcccanngagtgctgctgggcncangcaacnngcggctcntcttcaagcccanngcagtcaccgtcaagggcggcgacaccatcacattcaagaacacgccggctttccgcacacgtcgtcttcaacgaagaaaggtgccgagcggcgtcaaccccacaagatctcgcagggagagtacctcancgcgccaggggagacctactccgtcaccctcaccgtgccggggacttacggcttctactgcnagccgcatcaaggagccggaatggtcggcaagaatcaccgtcaactaatgaagctagctatccatcaaaatccatccatgtattagctgttgcttcctggctttggactcccgcgaatcctgccattctcaacgtgttttccgtctccaccca

SEQ ID NO: 53309 - DNA, 642 bp, Zea mays
  misc_feature: Ceres CLONE 1473611-F
  misc_feature: Translation starting site: 355
  misc_feature (301)..(301): n is a, c, t, g, unknown, or other
  misc_feature (302)..(302): n is a, c, t, g, unknown, or other
  misc_feature (344)..(344): n is a, c, t, g, unknown, or other
  misc_feature (345)..(345): n is a, c, t, g, unknown, or other
  misc_feature (376)..(376): n is a, c, t, g, unknown, or other
  misc_feature (377)..(377): n is a, c, t, g, unknown, or other
  misc_feature (449)..(449): n is a, c, t, g, unknown, or other
  misc_feature (459)..(459): n is a, c, t, g, unknown, or other
  misc_feature (487)..(487): n is a, c, t, g, unknown, or other
  misc_feature (547)..(547): n is a, c, t, g, unknown, or other
  misc_feature (574)..(574): n is a, c, t, g, unknown, or other
tggagctccccgcggtggcggccgctctagaactagtggatcccccgggctgcaggaattcgtctcacccctagaaaaattccaaaagctctcgagacttcctcagcaatcaatcagctttccagcgatcggcaggtcctcgatcgtttcgaagctccaatccgcccggccgcctgttgccactagctaggtgatcgatcgaatggactgcggtggcgcgctgcagctcccgcctgggttccgcttccaccccaccgacgacgagctggtgatgtactacctcctcccgcagtgcggcggnnctgcgctcgccgcgccggtcatcgccgaagtggatctctacnnagtcgacccatggcagctcccaaagaaggcnngtcgtggggagaaagagtgtacttcttctcgccgcgcgaccgcaagtacccgaatggctccaggcctaaccngggcggcggnacagggtactggaaggccaccggcgccnaacagcccgtagggtcgcccgcgcccgtggccatcaagaaggcgctcgtcttctacgccngggagcccgccaagggcgtcaagaccnactggatcatgcacgagtacggcctcgcggacgtcgaccgctcgggccgccgaacgcaagaagaccaa

SEQ ID NO: 53310 - DNA, 655 bp, Zea mays
  misc_feature: Ceres CLONE 1473617-F
  misc_feature: Translation starting site: 173
  misc_feature: SWISSPROT Homolog: EC 2.5.1.18 Glutathione transferase
  misc_feature (472)..(472): n is a, c, t, g, unknown, or other
  misc_feature (473)..(473): n is a, c, t, g, unknown, or other
aagctggagctccccgcggtggcggccgctctagaactagtggatcccccgggctgcaggaattcgtctcacccctagaaaaaaagaccggagacttgggggcttcacctgctgtatctcattaccatctgcatctggttgcccgttgattgagaaggaggagctgagggccatggcgaccgagaagcccatcctgtacaacgcctggatcagctcctgctcccaccgtgttcgcatcgcactcaacctcaaaggtgtggattacgagtacaagtcggtaaaccctaggacagatccagattatgaaaaaatcaatcccatcaaatatattccagcattagtagatggggacatagtcgtttctgattctcttgcatctcattgtatttggaagatagtatcctgagcatccactcctgcctaaagatctcaagaagaaagctcttaatcttcagattgcaaacattgtttnngtcagcattcaacctctttcaggctatgctgttattggtctgcacgagggtaggatgaacccagatgagggcctttcatatttgtcaaagttattttgacaagggattcagagcgatcaaaaagctgttggaaagatgttaaaataaatatgctcctggagataatgtccaattggcagatg

SEQ ID NO: 53311 - DNA, 663 bp, Zea mays
  misc_feature: Ceres CLONE 1473618-F
  misc_feature: Encodes the peptide sequence at SEQ ID NO. 53312
  misc_feature (233)..(233): n is a, c, t, g, unknown, or other
  misc_feature (439)..(439): n is a, c, t, g, unknown, or other
  misc_feature (440)..(440): n is a, c, t, g, unknown, or other
  misc_feature (458)..(458): n is a, c, t, g, unknown, or other
  misc_feature (459)..(459): n is a, c, t, g, unknown, or other
  misc_feature (541)..(541): n is a, c, t, g, unknown, or other
aaagctggagctccccgcggtggcggccgctctagaactagtggatcccccgggctgcaggaattcgtctcacccctagaaaaattcgttgcagtagtcgcagctgacggacgactgaaccaccgacagacaacatggccgcctccgcctccaccgtctccggcctcgccggcgcctccctggccagccgcccggcgttctccaccagcttcacgcggggcagccgggtgtcngcgaagaaccccctgatgagcaggaacctggagaggaatggcaggatcacctgcatgacgtttccccgggactggctgcggagggacctgagcgtcatcggcttcgggctcatcggctggatggggccgtccagcgtcccggccatcaacggcaacagcctcacggggctcttcttctccagcatcggccaggagctggcccattnncccacgcccccgcccgtnnactcccagttctggctgtggctagtgacgtggcacctgggcctgttcatcgtgctcaccttcggccagatcggattcaaggncaggaccgaggactacttcgagaaggtgaggcggtaagatcctatccatcatccctggtgctgccctgcatttcgttgcgtgcgtgctccccgcaatccaacctttgctggatagggtccca

SEQ ID NO: 53312 - protein, 147 aa, Zea mays
  misc_feature: Ceres CLONE 1473618-F
  misc_feature (102)..(102): Xaa is any aa, unknown, or other
  misc_feature (109)..(109): Xaa is any aa, unknown, or other
  misc_feature (136)..(136): Xaa is any aa, unknown, or other
MAASASTVSGLAGASLASRPAFSTSFTRGSRVSAKNPLMSRNLERNGRITCMTFPRDWLRRDLSVIGFGLIGWMGPSSVPAINGNSLTGLFFSSIGQELAHXPTPPPVXSQFWLWLVTWHLGLFIVLTFGQIGFKXRTEDYFEKVRR

SEQ ID NO: 53313 - DNA, 683 bp, Zea mays
  misc_feature: Ceres CLONE 1473625-F
  misc_feature: Encodes the peptide sequence at SEQ ID NO. 53314
  misc_feature (215)..(215): n is a, c, t, g, unknown, or other
  misc_feature (323)..(323): n is a, c, t, g, unknown, or other
  misc_feature (333)..(333): n is a, c, t, g, unknown, or other
  misc_feature (334)..(334): n is a, c, t, g, unknown, or other
  misc_feature (367)..(367): n is a, c, t, g, unknown, or other
aagctggagctccccgcggtggcggccgctctagaactagtggatcccccgggctgcaggaattcgtctcacccctagaaaaacaacactcatcgatctacacacatacatagtttcttctactacacgacgacaaacatggggaagcctgcgaagatcggagagtggggtggatacgccggcgatcgtcgggatctgagggctactccggaccngctgatcgaggtgaaggtcacggcggacaacagcagctgcatccgctccatctccttcatctacatcggagccgatggcaaaccgtacgaggaggggccatggggttncgggcatgcnntgcacgagtacaggattgatctgtgcaggttcnacaagagcttggacgagatctccgggacacgggcccagcctacaacattgacaatctggtcagtctctcaaattgtccaccacaccccgcctaccgaccgttcgggagggacaaggcccccccttcccgtttcaagggatgaaaaacggccccgtccctggggttctttgccccttcggaatttgccggaacccattgggtctttccttaaccccaattaaaaataaaaaaggggggccggacctccgggggggggggattttggaattggggttgcgtttccccccccggaacaaaattaaaaggccaaaaaacc

SEQ ID NO: 53314 - protein, 149 aa, Zea mays
  misc_feature: Ceres CLONE 1473625-F
  misc_feature (26)..(26): Xaa is any aa, unknown, or other
  misc_feature (62)..(62): Xaa is any aa, unknown, or other
  misc_feature (66)..(66): Xaa is any aa, unknown, or other
  misc_feature (77)..(77): Xaa is any aa, unknown, or other
MGKPAKIGEWGGYAGDRRDLRATPDXLIEVKVTADNSSCIRSISFIYIGADGKPYEEGPWGXGHAXHEYRIDLCRFXKSLDEISGTRAQPTTLTIWSVSQIVHHTPPTDRSGGTRPPLPVSRDEKRPRPWGSLPLRNLPEPIGSFLNPN

SEQ ID NO: 53315 - DNA, 651 bp, Zea mays
  misc_feature: Ceres CLONE 1473646-F
  misc_feature: Encodes the peptide sequence at SEQ ID NO. 53316
  misc_feature (651)..(651): n is a, c, t, g, unknown, or other
aaagctggagctccccgcggtggcggccgctctagaactagtggatcccccgggctgcaggaattcgtctcacccctagaaaaatccactcgccctcccacacagaaaaccctagccgccgccaccgaagcggcctcccaggtaagcaggagcgtccaccccgccgccgtcatgaagcgcaatccccgcgtcacgagctcccgccggaagtgccgcaaggcgcactttacggccccgtcctccgtccgccgcgttctcatgtccgccgggctgtcgacggagctccgccacaagtacaacgtgcgctccatcccgatccgcaaggacgacgaggtgcaggtcgtgcgcggcacctacaagggccgcgaggggaaggtggtgcaggtctaccgccgccgctgggtcatccacgtcgagcggatcacccgcgagaaggtgaacggctccaccgtgaacgtgggcatccacccctccaaggtgatcgtcactaagctgaagctcgacaaggaccgcaaggcgctcctggaccgcaaggcccggggccgcgccgccgacaaggctaagggcaagtttactgccgacgacgtcgctgccgccgccgctggtggcgccgccaccggcgcctctctccaggagatcgactaggctctn

SEQ ID NO: 53316 - protein, 157 aa, Zea mays; identical to SEQ ID NO: 15760
  misc_feature: Ceres CLONE 1473646-F
  misc_feature (51)..(82): Pfam Name: KOW Pfam Description: KOW motif

SEQ ID NO: 53317 - DNA, 658 bp, Zea mays
  misc_feature: Ceres CLONE 1473647-F
  misc_feature: Encodes the peptide sequence at SEQ ID NO. 53318
aaagctggagctccccgcggtggcggccgctctagaactagtggatcccccgggctgcaggaattcgtctcacccctagaaaaaatctcatgcacgccgatcacacattggacttgcactggtgcttgctcataattactagttcatcagcaaacaacaaacaatggcaccgaggctagcgtgcctcctagctctggccatggcagccatcgtcgtggcgccgtgcacggcccagaactcgccgcaggactacgtggacccgcacaacgcggcgcgcgccgacgtgggcgtcgggccggtgtcctgggacgacaccgtggccgcgtacgcgcagagctacgcggcgcagcgccagggcgactgcaagctgatccactccggcgggccctacggcgagaacctcttctggggctccgccggcgccgactggtcggcgtccgacgccgtgggctcctgggtgtccgagaagcagtactacgaccacgacaccaacagctgcgcggaggggcaggtgtgcggccactacacgcaggtggtgtggcgcgactccaccgccatcggctgtgcccgcgttgtctgcgacaacaacgccggcgtcttcatcatctgcagctacaacccgccgggcaacgtcgtcggcgagagcccctactagact

SEQ ID NO: 53318 - protein, 151 aa, Zea mays
  misc_feature: Ceres CLONE 1473647-F
  misc_feature (19)..(139): Pfam Name: SCP Pfam Description: SCP-like extracellular protein
MAAIVVAPCTAQNSPQDYVDPHNAARADVGVGPVSWDDTVAAYAQSYAAQRQGDCKLIHSGGPYGENLFWGSAGADWSASDAVGSWVSEKQYYDHDTNSCAEGQVCGHYTQVVWRDSTAIGCARVVCDNNAGVFIICSYNPPGNVVGESPY

SEQ ID NO: 53319 - DNA, 674 bp, Zea mays
  misc_feature: Ceres CLONE 1473861-F
  misc_feature: Encodes the peptide sequence at SEQ ID NO. 53320
gctggagctccccgcggtggcggccgctctagaactagtggatcccccgggctgcaggaattcgtctcacccctagaaaaactcagaggagagagtcgctctgcactgcacgactcctcccccatctaccactacctgtctacctacccagcccatcgactgcccctcgcaacgcaatggcgctcgccaccaactccgccgctgccgcagcagctgccgtatccggcggcgcggcatcccagccgcaccgcgcggccacgttcctcccgctgaagaggcgcaccatctccgccatccacgccgccgacccgtctaagaacaacgggcccgccgtccccgcggccgccgccgctaagtcatctgcctctgcggtggccacgccggagaagaatccggcggcgccggtaaagtgggcggtcaacagctggaagtcgaagagggcgctgcagctcccagagtacccaaaccaggaggagctggacacggtgctcaagaccatcgagacgttccccgccggtggtgttcgccggagaggcgcgtcacctcgagagagcgcatggccgaaggccgccatgggccgcggccttcatcctccagggcgggcaactgcgcccgaaagcttcaggggagttccccgccaacaaaaatccggtgaaaaccttccgtaatcctgc

SEQ ID NO: 53320 - protein, 163 aa, Zea mays
  misc_feature: Ceres CLONE 1473861-F
  misc_feature: SWISSPROT Homolog: EC 2.5.1.54 3-deoxy-7-phosphoheptulonate synthase
MALATNSAAAAAAAVSGGAASQPHRAATFLPLKRRTISAIHAADPSKNNGPAVPAAAAAKSSASAVATPEKNPAAPVKWAVNSWKSKRALQLPEYPNQEELDTVLKTIETFPAGGVRRRGASPRESAWPKAAMGRGLHPPGRATAPESFRGVPRQQKSGENLP

SEQ ID NO: 53321 - DNA, 754 bp, Zea mays
  misc_feature: Ceres CLONE 1473862-F
  misc_feature (754)..(754): n is a, c, t, g, unknown, or other
aacagtggagctccccgcggtggcggccgctctagaactagtggatcccccgggctgcaggaattcgtctcacccctagaaaaatccctttggcaacccaattcgagttccatcgcaccgcatcatcaccccacgcaggtagggttttccttcctttcggcctcgccgcgtcgatctccgtcaatccacccgcccgccccctacccaaaccctagggcttccaaggtccaagcttgccgttgatggggcgcaagaagaacgtcgccatcgacgacgacgagtacttctttccgcaggacgacgcggccgacccagccccggccccgcccgcccccgccgccggccgaaaaagagaagtccaaaaagggcggcaagaagggaaaggaggggggggacggctccccccccccgaacaacgacgaacaacgaagcccccgacccccggcggcccggcgggtgcggcggaggaaggacggatgcgacggcgaagccctttgggccgccgggctagccagccggttgcgggcgagcggggaggggaaggggggggctcacaacgcgcaggggtccccgttttggggggctggttagggcgccgctcaggaggaagcaaggtgcttcggcagccgggaatagacgtgccgggagccgctgggcccccgtgaaggcgtgcaggaggtgagatgggagcgtccggcgaggaaaaagtcgccgcgggaggggacaagaccgcagggggcttggccgcccagan

SEQ ID NO: 53322 - DNA, 674 bp, Zea mays
  misc_feature: Ceres CLONE 1473863-F
  misc_feature: Translation starting site: 169
aagctggagctccccgcggtggcggccgctctagaactagtggatcccccgggctgcaggaattcgtctcacccctagaaaaaaagatcgagcagcgagagacgggcaggggagagggaaaaaaaaatctaaccctagcatccgcagcgctagggttcgggggttgcgatggcggcggcggcgagacagcgggggacggtgaagtggttcaacgacaccaagggcttcgggttcatctcccccgaggacggcagcgaagatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaggccccacgaggaggcggcggcggctacggctcccgcggcggtggcggatctggcggcggcggtcgcagctacggtggtagctggggcggcggccggagatccggcggcgggggcggtcccggcgcgtgctacaagtgcggcgagcccggccacatggcaagggactgccctagcgccgacgcggaggcggctacggcggaggctgctacggcggcggctgctacgaagaagaaaggcggccgcccccctcttttttttc

SEQ ID NO: 53323 - DNA, 666 bp, Zea mays
  misc_feature: Ceres CLONE 1473871-F
  misc_feature: Encodes the peptide sequence at SEQ ID NO. 53324
ggagctccccgcggtggcggtcgctctagaactagtggatcccccgggctgcaggaattcgtctcacccctagaaaaacctctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgtcaagcgtctcattggcaggaggtttagtgatgcctctgtcccgagtgatattaagctgtggcccttcaaggtcattcctgggcccggtgagaagccaatgatagttgttcaccacaagggggaggagaaacagtttgcagccgaagagatctcctccatggttctcatcaagatgcgtgagatcgctgaagcttaccttggaagcacgatccagactgctgtttgtcacggtccctgcctactttcacgactcacg

SEQ ID NO: 53324 - protein, 158 aa, Zea mays
  misc_feature: Ceres CLONE 1473871-F
MAGKGDGPAIGIDLGTTYSCVGVWQHDRVEIIANDQGNRTTPSYVAFTDSERLIGDAAKNQVAMNPINTVFDVKRLIGRRFSDASVPSDIKLWPFKVIPGPGEKPMIVVHHKGEEKQFAAEEISSMVLIKMREIAEAYLGSTIQTAVCHGPCLLSRLT

SEQ ID NO: 53325 - DNA, 761 bp, Zea mays
  misc_feature: Ceres CLONE 1473874-F
  misc_feature: Encodes the peptide sequence at SEQ ID NO. 53326
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
  misc_feature (46)..(46): n is a, c, t, g, unknown, or other
cgcaggcaaacaccacacaaaaaagcccaaccaacncnnacccggntttaacaaagctggcactccaccgcggtggcggccgctctattatagtggatcccccgggctgcaggaattcgtctcacccctagaaaaaaccgaaccaaacaacacacgtcaaagcggaaaacctcagaaaaccacaataaatcatcctcgtccaccactgcccccgctctgctgcaactccactcggcccggccgccctttccacccaccttgatcctctgatccgttggtgcttgaccgatccatggacacccatatcggatccgtgaacggggcggcgtcgaaccagacggttggctgcccggtgtcggcgccggggtgcccgatggcgtccacgccggcgcagcccgcggcgaccctgtcggcgggggaggcgtcgctggggcgccacctcgcgcgtcgcctcgtgcaggtcggtgtttaccatgtattcccggtccccggggattgcgacctcccgctggctccaccacctgatcgccgagcccgggctgcgccacgacggctgctgcaccgaagttcaacgcccggatacccccccccacgggtaacacgacgcgcggggcggacgtacgggggccctgcggtcgatcacggttcaaaagacagggggggggatcccagcggggatcgcaacggcccatttgcgggcggtgtccctactacgcggagggaaagccctgggcctcggctcaatcctggcccttctcggg

SEQ ID NO: 53326 - protein, 156 aa, Zea mays
  misc_feature: Ceres CLONE 1473874-F
  misc_feature: SWISSPROT Homolog: EC 4.1.1.1 Pyruvate decarboxylase
MDTHIGSVNGAASNQTVGCPVSAPGCPMASTPAQPAATLSAGEASLGRHLARRLVQVGVYHVFPVPGDCDLPLAPPPDRRARAAPRRLLHRSSTPGYPPPRVTRRAGRTYGGPAVDHGSKDRGGDPSGDRNGPFAGGVPTTRRESPGPRLNPGPSR

SEQ ID NO: 53327 - DNA, 770 bp, Zea mays
  misc_feature: Ceres CLONE 1473875-F
  misc_feature: Encodes the peptide sequence at SEQ ID NO. 53328
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
cttcccaccccccccccttcccccctcaaccctannnccctcccccccccaaagagggactcaccgcggtggcggccgctctatactagtggatcccccgggctgcaggaattcgtctcacccctagaaaaattctattcctccacaccgatcaagcgctgctcccctctctcgccggagctccgggccggatggcggcggcagcagcagctcctcccgcctccgtgatcgcgtgatggacgcacacaccgccgcgctccgccgatggacgacgccggaaggccaccaccacacgctcccgtggaggtgaccgcctccgcctccgcctccgccaccgccgcgcccgcccctccccaaccctcagccactgctgccgtcgacaggtcctcccccgaccccgacgcgctctatgaaggttagggattacgcttctctctccgctcgcgcttcagctcgtgtagagacccctttcaattgcgggctcggtgcctcatttcttgtctacgttaaagttcccccagacgctctgtttttatcgttatctctcattccccccagggacataacgggctgcccccggggatgactctaatacgtccaaccatgtgatcggtaaatcccgcataccccctctgatgttacccagagcccccggagtacgcgggataactctaccccccccactcaaaaattcccccaaccattcgccccttttattcgatcgggccgcaaaataaccggagaattaccacctccaccatcggatttgg

SEQ ID NO: 53328 - protein, 51 aa, Zea mays
  misc_feature: Ceres CLONE 1473875-F
MDDAGRPPPHAPVEVTASASASATAAPAPPQPSATAAVDRSSPDPDALYEG

SEQ ID NO: 53329 - DNA, 716 bp, Zea mays
  misc_feature: Ceres CLONE 1473877-F
  misc_feature: Encodes the peptide sequence at SEQ ID NO. 53330
  misc_feature (394)..(394): n is a, c, t, g, unknown, or other
tcaccgcggtggcggccgctctagaactagtggatcccccgggctgcaggaattcgtctcacccctagaaaaaagcccagcaccgcagaggcgcagagacaggcgtcttcgtactcgcctatctccgcgactcaaagcttcttccatttcctaccgccgccgctgcagctccaccccattccgtcgacaccatgagggagtgcatctcgatccacatcggccaagccggtatccaggtcggaaacgcgtgctgggagctctactgcctcgagcatggcattcaggctgatggtcagatgcccggtgacaagaccattgggggtggtgatgatgctttcaacaccttcttcaatgacactggtgctgggaagcacgtcccctcgtgaatgttttntgtagaacttggaccccaccgccatcccatgagggggaggacttggcaccctaccgcccaggctctttccacccctgaaccacctttatcaggtggcaaaggaaggatggcaaccaaaaaactttccccccggggggcccctacccccatttggccaaggaaaaattgtttaaccttggggcccttgaattcgccccccggaaagttttggcaaaaaaattggcaactgggtctcccaaagggcttccccacggactttcaaaccgcttgtttggctcgaagacaaaaagggttctcgggccccttgggtttcccccccccc

SEQ ID NO: 53330 - protein, 64 aa, Zea mays
  misc_feature: Ceres CLONE 1473877-F
MRECISIHIGQAGIQVGNACWELYCLEHGIQADGQMPGDKTIGGGDDAFNTFFNDTGAGKHVPS

SEQ ID NO: 53331 - DNA, 653 bp, Zea mays
  misc_feature: Ceres CLONE 1473878-F
  misc_feature: Encodes the peptide sequence at SEQ ID NO. 53332
ggagctccccgcggtggcggccgctctattactagtggatcccccgggctgcaggaattcgtctcacccctagaaaaagagggcgcagagcgcagagggcgcagggcgcatcgcgcaggggctgggcggccaagagggcgagcggcggcgccctcaactgctcttcgatctgggcggcgatctcagccgtatctctcgcaagttcggttctcctctcctctgctcggtcccttacaaatgggaggtaaatcccctcctttctgggcacaagagacacacgctctctgctcctttctccattgtgctactgctcctatgtggcgacggcgaggtgctgctgctcctgtacggcgaggtgctgctgctgctactgtgtggcgaggtgcagctgtgctccattgcctcacttgtgcgcctgcgtggtgctttgtttgtctggttgctgtccaccgtggcctggtgtttgggctccctgctgcgcggtgttcctcttctcgggctggtgccgtggacgtctcctacggcatcagcagcggctctagtatctccgtcaacctcccgctgtgcatgctcggacgtgggcggcggattgggttttctgggacagaacttggggttcgtggactgggtctcccacgtaaacaatctacttg

SEQ ID NO: 53332 - protein, 112 aa, Zea mays
  misc_feature: Ceres CLONE 1473878-F
MWRRRGAAAPVRRGAAAATVWRGAAVLHCLTCAPAWCFVCLVAVHRGLVFGLPAARCSSSRAGAVDVSYGISSGSSISVNLPLCMLGRGRRIGFSGTELGVRGLGLPRKQST

SEQ ID NO: 53333 - DNA, 623 bp, Zea mays
  misc_feature: Ceres CLONE 1473879-F
  misc_feature: Encodes the peptide sequence at SEQ ID NO. 53334
  misc_feature (437)..(437): n is a, c, t, g, unknown, or other
agtggatcccccgggctgcaggaattcgtctcacccctagaaaaaaaagtgggtggttcatccccctcacactcacacgcgattctcgactcccctccacccatacgtaacacgttctcctcccacgcccccactaaaacagatgccttcggccttcgtgcgccacaacggaaaacccactactcgcgagcaagtgcaagcaccgttgcccatccatcgttcatgatcccagcctgcctccgcggcctctgcacctgctttgacgtggacgacgacaaggctaacaaccacgagcaagagccgacgatggccgacgccgccgccgctacagtcggcagcgccgacgacgaccagacggcaagcaccatcatcacccaccgcaccgtggagctgaccaccggcgtgcgcctgcacgtggtggacccccccccgccccngcaacagcagcaggaagcgcgcccgcggtgctgctgctgcacggcttcccggagctgtgggacacctggcccccccagatgcgggcgcttgccgcgggcgggtaccgccccgtggcgccggaacctgcccggttacgggggttccaaccgccgccggggggggggggggacaaataaaacaaaccg

SEQ ID NO: 53334 - protein, 32 aa, Zea mays
  misc_feature: Ceres CLONE 1473879-F
MRALAAGGYRPVAPEPARLRGFQPPPGGGGDK

SEQ ID NO: 53335 - DNA, 651 bp, Zea mays
  misc_feature: Ceres CLONE 1473882-F
  misc_feature: Encodes the peptide sequence at SEQ ID NO. 53336
tggagctccccgcggtggcggccgctctagaactagtggatcccccgggctgcaggaattcgtctcacccctagaaaaaaccccaccccaccccacccgcgccgagacggattggaggaggaaccctaccatatcaatctcgcttctcgcctcgtttcgtctcagctgcattccaattccacctgtaagcggagagccttcgtggtccctgctcggttcatcagaatacaggaggctccggagctttaagattgtgcagacacataatttggatgctcctgcctatgcaagatgtcaaccaccagagatattgtttagtgctgggaaagttatgcagttttggatcataaattctaaatagacaagataattatggaccgtgcagacacatcagggtttgtcagtggtggttgctttggtactacactcctgctgatattctttcatttcgtctattctacagtccgtgtctgaaaaatcgtcagtaacgctgcagctgcctgggcagaaaatcatcagccccccccccccccccccccctgttctttgagatctctggtttttatctcattttcttttccaccatcgttatattgtcttaactgtgatggataacggcttcatggacatcccccatccgcccctgatgaa

SEQ ID NO: 53336 - protein, 119 aa, Zea mays
  misc_feature: Ceres CLONE 1473882-F
GAPRGGGRSRTSGSPGLQEFVSPLEKTPPHPTRAETDWRRNPTISISLLASFRLSCIPIPPVSGEPSWSLLGSSEYRRLRSFKIVQTHNLDAPAYARCQPPEILFSAGKVMQFWIINSK

SEQ ID NO: 53337 - DNA, 767 bp, Zea mays
  misc_feature: Ceres CLONE 1473883-F
  misc_feature: Encodes the peptide sequence at SEQ ID NO. 53338
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
aataccaccattcccttttcccccccttccccttctacattgaannnccccttttcataaaaactggcactccccgcggtggcggccgctctataatagtggatcccccgggctgcaggaattcgtctcacccctagaaaaactcccaacaccgggaatccatggagccggcctatgtcgtcaccctctccttcctcttcctcttcttgctccaccatctcctcggccgccaccgccgcaggaccaacggcaagaacaagagaacgcagctgccaccgagccctcccgccatcccggatcttggggtcaccttccactctcttaccggaagcccttaatcccacggcgggaggcttggacttcgcccttcgtaggaaagccgcttaaccggggcccggggtggtcttccttttcccatccggcggtatccccgtttccgcgtccccacaattaccaatgggcctaggacggccactaaccccttcacccgggactatcggatattttcccacctatcccaccgagggctctccttccccttccctaacctaatccgcgtaaaacttctcctttcgcgctttcaccctcccgtaaaaaaacacaccccccccaccccccaccatggccttttccccacccccccccccaatttcccccgcttgtgcgagggaggaggatattctccttttaccttaggagctgccaccgcggattgaccgacattaaccctaatcttacccccaaaaacagacaggggagcaccctcg

SEQ ID NO: 53338 - protein, 58 aa, Zea mays
  misc_feature: Ceres CLONE 1473883-F
MEPAYVVTLSFLFLFLLHHLLGRHRRRTNGKNKRTQLPPSPPAIPDLGVTFHSLTGSP

SEQ ID NO: 53339 - DNA, 742 bp, Zea mays
  misc_feature: Ceres CLONE 1473885-F
  misc_feature (37)..(37): n is a, c, t, g, unknown, or other
  misc_feature (38)..(38): n is a, c, t, g, unknown, or other
  misc_feature (41)..(41): n is a, c, t, g, unknown, or other
  misc_feature (52)..(52): n is a, c, t, g, unknown, or other
  misc_feature (486)..(486): n is a, c, t, g, unknown, or other
ccccttgctttccccctctccccttcacacccacatnnaanaaaaaaaaaanaaaccaaaactggaactcaccgcggtggcggccgctctatactagtggatcccccgggctgcaggaattcgtctcacccctagaaaaacggactcgcccctccctcctctcgtctcccaggtcatggcaaagctggagcacccgtgaaaatagcaagtgggagataaacaggaagagctagggtgaatactaactacaagtagcagtagaaggaagagagtcagtctgcccgtgactgcgagtgaatttgttgggtgtggtgtttgttgagatcacgatgatgggaggcgggctgttggtggatcagagcgtggtgttccctggcgtccacaacttcgtggatctcctgcagcagaccggcgaccagaaacctgggcttcgggtctctgatgccgcaaaagtcctctggcgaacaatgggagaaggtgtaactnccccccccagggacccgccctcggaaaagcttccccgaattccggggaagaagaaacggggacgaagaacccccaagaacattccagaaacttggaaaccccccaagggggcatgcacccccataaagctgaaaaccggttctagggaaaatgggcaacaaaacccccccgggtaagggaacctcttttggttaacgaggggccggggaactgggctgatggctcgtcccagccaaggcagttgcaggagcagccc

SEQ ID NO: 53340 - DNA, 510 bp, Zea mays
  misc_feature: Ceres CLONE 1473890-F
  misc_feature: SWISSPROT Homolog: EC 1.1.1.22 UDP-glucose 6-dehydrogenase
  misc_feature (227)..(227): n is a, c, t, g, unknown, or other
  misc_feature (287)..(287): n is a, c, t, g, unknown, or other
  misc_feature (302)..(302): n is a, c, t, g, unknown, or other
tccccgcggtggcggccgctctagaactagtggatcccccgggctgcaggaattcgtctcacccctagaaaaaacacacacacaagacacaacacaactcgtaggcagcgagcgtctctcctcttcctctcccacgcaccgcgccaaggaaggcagagagagatcgccgctcctcttctctccgtcggtggtgcggttgaccgccctcctcgagcgagatctcgctngcagtccctcgagatctggtccagatctatccgacaagatggtgaagatctgctgcatcngtgctggctatgtcngtgcccaaccatggctgtcatgccctaaagtgccagacatttgaggtgtccgtggtgacatctccaagccccgcttgaagcatggaacagcgacaccctcccgatctacgagcccgggctcgatgatgtttgtgaccattgcaggggcagaacttcttccttcccatgaagtttaaaaacccgctccttaggctgaattcctcttcct

SEQ ID NO: 53341 - DNA, 659 bp, Zea mays
  misc_feature: Ceres CLONE 1473891-F
  misc_feature: Encodes the peptide sequence at SEQ ID NO. 53342
  misc_feature (371)..(371): n is a, c, t, g, unknown, or other
acgctggagctccccgcggtggcggccgctctagaactagtggatcccccgggctgcaggaattcgtctcacccctagaaaaactccgctcccctccagcccgcccgctcacgtcccgccatgggaaactccctcgcctgcttctgctgcgggggcggcgccgccggccgccgccgccacgtggcgcccgcggcgctcccctcggaccccgcctacgacgagggcctcggccactccttctgctacgtccggccggataaggtgctggtgcccttctccgcggacgacgacgacctggtcgccgacgccaaggcggccgccgcggccgaggagcccaccacgttccgggccatatccggggccgcgctcancgccaacgtcggcgcgcagctctccacctccgtcctcctcctgctcccccactaatcctcctccgccgccgccgcctcctcctcctcctccgggttcgagagctccgaatcgttcgccgccgtgccgctgcagcccgtcccgaggttcccgtcgggccccatctgcgcgcacgggggcgggttcctctccgggcccctagagagggggttcctctcggggccccctcgaagcgggcgctcatgtcccggcccttctcccttgcggccgccccattccgccccgcatgg

SEQ ID NO: 53342 - protein, 101 aa, Zea mays
  misc_feature: Ceres CLONE 1473891-F
  misc_feature: SWISSPROT Homolog: EC 3.1.3.16 Phosphoprotein phosphatase
  misc_feature (84)..(84): Xaa is any aa, unknown, or other
MGNSLACFCCGGGAAGRRRHVAPAALPSDPAYDEGLGHSFCYVRPDKVLVPFSADDDDLVADAKAAAAAEEPTTFRAISGAALXANVGAQLSTSVLLLLPH

SEQ ID NO: 53343 - DNA, 644 bp, Zea mays
  misc_feature: Ceres CLONE 1473893-F
  misc_feature: Encodes the peptide sequence at SEQ ID NO. 53344
cgcggtggcggccgctctagaactagtggatcccccgggctgcaggaattcgtctcacccctagaaaaagtcgagagagtcgtccccccgcgtgctctccgcctgcggcctctgtatcccgcaaccaaaaactacccccaaaaaaagaagaaaaccccaaatcctcgagatctatcagtatcgagcgacttaccaatccgattgctagggtttagtttcgaaaaaatctgaaaaaaaattctggtcgaggggaggaggcgatgtcggcgcaagtggcggtggtgcctaatgggggcccgggcgctgtccccgcggtggtgtcgccgggagctgtcggcgtggctcagcctctcccgaccacgtcgctctacgtgggcgacctggagggggccgtctcggactcgcagctgtacgaactcttcagccaggcggggcaggtggtgtcggtgcgcgtctgcagggatgtcacctcgcgccgctcgctcggatacgcctacgtcaactacagcaatcccttggatgctgcgagagcattggaagtgctgaactttgctgctcttaaaaacaagcctatccgggtgatgtattcaaaccgtgatccaaccagccgcaggaatggatctgcctaactttttcataaaaaa

SEQ ID NO: 53344 - protein, 122 aa, Zea mays
  misc_feature: Ceres CLONE 1473893-F
  misc_feature (36)..(107): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSAQVAVVPNGGPGAVPAVVSPGAVGVAQPLPTTSLYVGDLEGAVSDSQLYELFSQAGQVVSVRVCRDVTSRRSLGYAYVNYSNPLDAARALEVLNFAALKNKPIRVMYSNRDPTSRRNGSA

SEQ ID NO: 53345 - DNA, 649 bp, Zea mays
  misc_feature: Ceres CLONE 1473894-F
  misc_feature: Encodes the peptide sequence at SEQ ID NO. 53346
  misc_feature (644)..(644): n is a, c, t, g, unknown, or other
  misc_feature (649)..(649): n is a, c, t, g, unknown, or other
tggagctccccgcggtggcggccgctctagaactagtggatcccccgggctgcaggaattcgtctcacccctagaaaaacgctaccagcccgacccaccaccaccatcgccaccattaccctctcgcccctgcctctccggccgccagcccatcccgtccccgtcccatgccgcagcgcgcagcggccgcactgacacaccagtgagcgagcagagcgagagcgaggcctgatgcggcagcggcagcaaggcgaggagcaccgggagatattcgtccagtggagaccctgcgacaagaagaggtcttaggccctccgccgccacgcgcaccggcagacaaatccgcgcaggccttcttccgatccgcaaaggcgccgcctttttcgccgattccacaggccggagcccggggagaaaggcagacagacagaccggaagatgagcgcgtccgtgggccggacccgtgtggggcggtacgagctcggccggaccctcggcgaaggcaccttcgccaaggtcaagttcgcccggaacgtcgagaccggagagaatgtcgccatcaagatcctcgacaaggagaaggtcctcaagcacaagatgatcgcccagatcaagcgggagatctcgaccatgaagctcatcangcacn

SEQ ID NO: 53346 - protein, 70 aa, Zea mays
  misc_feature: Ceres CLONE 1473894-F
  misc_feature: SWISSPROT Homolog: EC 2.7.11.1 Non-specific serine/threonine protein kinase
  misc_feature (69)..(69): Xaa is any aa, unknown, or other
MSASVGRTRVGRYELGRTLGEGTFAKVKFARNVETGENVAIKILDKEKVLKHKMIAQIKREISTMKLIXH

SEQ ID NO: 53347 - DNA, 811 bp, Zea mays
  misc_feature: Ceres CLONE 1473895-F
  misc_feature: Encodes the peptide sequence at SEQ ID NO. 53348
  misc_feature (11)..(11): n is a, c, t, g, unknown, or other
  misc_feature (20)..(20): n is a, c, t, g, unknown, or other
  misc_feature (32)..(32): n is a, c, t, g, unknown, or other
  misc_feature (43)..(43): n is a, c, t, g, unknown, or other
  misc_feature (45)..(45): n is a, c, t, g, unknown, or other
  misc_feature (46)..(46): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
ttgtggggggnggggggggntttccacacccnacctctacctntnnggcctcaannnaaacaccgtggagctccccgcggtggcggacgctctagactagtggatcccccgggctgcacgaattcgtctcacccctagaaaaatcccacgctgccctcggcgctgcgcctggacccggcactaacctccccctccccacctcgccgccggcgggtggagtcgggctggagcagccgctctcctctgttacccccctaaccccctataaagaaaaagacaaaaaaacccagagaagagcgagcgaccggcggctcggcaaccaggggcaccggtgtcacctgggcccgccccgggaaagcaccaccacaccctttcatgaccggcacaagaccggggaacctcgaagcccccgggaaacctattccctgccactccccaaccttacctgggggggggggggcggcggtacaaatcttattacccacactgttttttgccttggagggataaaaagcccccccacaccccccaaaataagaaccgccccatcccgggggggatgcagtccccgccagctggagtcatcggtgcacccttgtggggtggggtggtacgcgggcgcgcgcccgccccttgttgccataggcccccgcgaggatcgcggacgcaccgggatgcaccaccccctggtatccttccccgaaaagccgtggagagggggggtccccaccccgatcggcccaccgtacccccccgcccgttaattgagaccaagcggtactgacccacatcacaccccgtccgcccccga

SEQ ID NO: 53348 - protein, 74 aa, Zea mays
  misc_feature: Ceres CLONE 1473895-F
MQSPPAGVIGAPLWGGVVRGRAPAPCCHRPPRGSRTHRDAPPPGILPRKAVERGGPHPDRPTVPPRPLIETKRY

SEQ ID NO: 53349 - DNA, 645 bp, Zea mays
  misc_feature: Ceres CLONE 1473901-F
  misc_feature: Encodes the peptide sequence at SEQ ID NO. 53350
tggagctccccgcggtggcggccgctctatccctcctggatcccccgggctgcaggaattccgtctcacccctagaaaaacccgccccacgctgattgtgtgtctcactgtgccgcgcccgcactcggcacgggagtcgtctcgtcgccatctccccaccacctcgtcaccgcagaccatgcccccacggggcccccgcgcggccgtggcctaccggtgaacgcaacccagacacacgggaccgcgcaatcggagagcacgcgcatcgcacatcacgggcgcggccaagaggcgggagccgtgcgctgcgaattgcggaagcacctgttaattgctctccctccagtgacgcgcagtgcgcacagggttttaggaagggggcgacaccggtatcgccgttcgccagccatggaatccgcaacggcggccgtccgcatcgcgtcgctagaccgggcccggcccgcgacggtcgtccacgatagcgcgcgcggctcgtgtctcgtcctgtgcgctggcctcagcgcgtgagcttcgaggagggagctcgtcgacgtaaccatccacctagagcaccccgatgcgctcccgacgagcggaatgagggcggctacgtggctgtggttaccacgctgacgagggggaagc

SEQ ID NO: 53350 - protein, 39 aa, Zea mays
  misc_feature: Ceres CLONE 1473901-F
MESATAAVRIASLDRARPATVVHDSARGSCLVLCAGLSA

SEQ ID NO: 53351 - DNA, 667 bp, Zea mays
  misc_feature: Ceres CLONE 1473908-F
  misc_feature: Translation starting site: 289
ggagctccccgcggtggcggccgctctagaactagtggatcccccgggctgcaggaattcgtctcacccctagaaaaaattcccagacaccggcgcgagcgctctaacatttattgcctttcaagtcgagaggctgctgcggcgcgaacgtcgaggagcttagcctccaggggagactcctgttgatcggccgagcacacgtacagacagagagggtcgcggcgcggttgaaggttcgtcgtcgacccatggccgtgaccgcaaccacggatcgcggcggcgatcacgatgctggcggacgtggcggcggttttcctcaccgtgctgctctgcttctacatcgtcctgtgcgccagagcaataacggggcggggagccccacgcggagggcgagggcgaggagcgggcgtggctgctgcgcgtcttgttccgaagcggatgagccgacggctgcggccgccgctccacctattggtgccacgagggcgtgctctacgacaaggccatggcgaggctgccccggcgggaggtgggcgcgggccaagcgctgagactgctccgagtgcatctcgtatgtggcggcccgggacgcggcgcggttgctgacgcggtgcggtcacgccttccacgtccactgcgtcgacggctggctgctctcctactccca

SEQ ID NO: 53352 - DNA, 633 bp, Zea mays
  misc_feature: Ceres CLONE 1473924-F
  misc_feature: Encodes the peptide sequence at SEQ ID NO. 53353
  misc_feature (497)..(497): n is a, c, t, g, unknown, or other
tggcggccgctctagaactagtggatcccccgggctgcaggaattcgtctagcccctagaaaaaaagcatgagcactccatccactagctttactcaaagtctagagctagctttttgctttgctcaccagaaaagccgcagcacatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcgccatgggcaacgacctgtggtacggcccggaccgcgtcaagtacctgggccccttctccgcccagacgccctcgtacctgaccggcgagttccccggtgactacagctgggacaccgccgggctgtccgcggacccggaggggttcgcgcggaacacggcgctggaggtgatccacgggctgtgggcgatgctgggtgcgctgggctgcntccccccggaagtgctggacaagtggggtgcgcgtggacttccaggagcccgtgtgggtcaatgccggcgcccatatcctcacggagggggggctggcatacctgggcaaaccccaactgggtgcaaacgcaaaaa

SEQ ID NO: 53353 - protein, 162 aa, Zea mays
  misc_feature: Ceres CLONE 1473924-F
  misc_feature (69)..(161): Pfam Name: Chloroa_b-bind Pfam Description: Chlorophyll A-B binding protein
  misc_feature (118)..(118): Xaa is any aa, unknown, or other
MASTIMAATSRIVAAKTPFLGQGRAAAAAANASPLRDVAAAAAGGRIAMGNDLWYGPDRVKYLGPFSAQTPSYLTGEFPGDYSWDTAGLSADPEGFARNTALEVIHGLWAMLGALGCXPPEVLDKWGARGLPGARVGQCRRPYPHGGGAGIPGQTPTGCKRK

SEQ ID NO: 53354 - DNA, 654 bp, Zea mays
  misc_feature: Ceres CLONE 1473927-F
gcggtggcggccgctctagaactagtggatcccccgggctgcaggaattcgtctcacccctagaaaaaactactcatcgtcctctgtgttcttgggggttcgcggacacgggcccgcatgctaatcgtgctccttgcgagcctcgccgatcccccgctcccctcgcctcgcttctggatgcagatctttgtgaagaccctccccggccatactatcaccctcggaggtggagtcttctgacaccattgacgatgtcaaggctgagatcctcgacgaggagggcatccctcctgaccagcagcggcttatctctctccggggagcctctttgacgaccgacgcgcacttgctgactactgcatcctgaaggagtccaccctccgcattggtgctgcgccttacgggaggaatgcggatctttgtctagaccttgactggcctgacggtctcccttgaggtggactcctcttacacctgtgactgtgtcaaggcctagatcctggacaaggagggcatcccacctgaccagcgacgtctcatctttgccggcaagctgctggaggatgggaggacccttggtgacgactgcctcctgaaggagagcaccctccacttggtgctgcgtcttatgggtggtatgcagatctttgtgaa

SEQ ID NO: 53355 - DNA, 666 bp, Zea mays
  misc_feature: Ceres CLONE 1473928-F
  misc_feature: Encodes the peptide sequence at SEQ ID NO. 53356
  misc_feature (591)..(591): n is a, c, t, g, unknown, or other
tccccgcggtggcggccgctctagaactagtggatcccccgggctgcaggaattcgtctcacccctagaaaaaagcgcccgtcgcctccctttccccttcgctccctccctctccccgcgggccgccagaggcaatttcgccctcgattcgaccccgattcgtccgcccgcgaccgggattccctccgcctagcgcggatctgaaagctgcgctccatgtcgccgctcgaatccgccatgaagggggccaaatccaagggcgccgccaaggccgatgccaagctggcggtgaagagcaagggggcggagaatcccgccaagggcaggaaagggaaggccggctaggaccccaacaagcctaatagggctcccagcgctttcttcgtgttcatggaggaatttcgcaaggagttcagggagaagaagcctaagaacaagtctgtcgctgcggtggagaaagctgctggcgacaggtggaaatccctgagcgagtcggacaaggctccctatgtagcctaggctaacaagctcaagctcgagtacaacaaggccatcgctgcctacaacaagggcgagagcactgcagctaanaaagctcctgcctaggaggaagaggaggaagatgaagaggagtctgacaagtccgagtcggaggtcaatgacgag

SEQ ID NO: 53356 - protein, 35 aa, Zea mays
  misc_feature: Ceres CLONE 1473928-F
MKGAKSKGAAKADAKLAVKSKGAENPAKGRKGKAG

SEQ ID NO: 53357 - DNA, 698 bp, Zea mays
  misc_feature: Ceres CLONE 1473940-F
  misc_feature: Encodes the peptide sequence at SEQ ID NO. 53358
ggagctccccgcggtggcggccgctctagaactagtggatcccccgggctgcaggaattcgtctcacccctagaaaaaaatcgcgtctctgcaacagctgtcctccggtctcatcctatccgcgcacgtagcgtgtagcggggatcgcaccgcccgccgctcaatcaccatgccgcctctcgccaccacgtacaccaagtacgagacccgccgccgagatccggacccccgcgcggccgtgctcctcgtgatcgacgtgcagggccacttcgcctcgctggccgccccgatcatgccggccatcgcgtccaccgtcgctctgtgccccgccgcgggcgtgccggtcttgtacccccgccacctggaacgggcgccgcgcctgcccccgctcggaaagtgtgggcccggccaaccgcattgaatccggcacccccgcggacgaactgttcccggggggccgtccccccccagggggaaccccgggggggaaaagggcccgtaaacgccccttctgtggcccggggggtggccggcacccccccgcgcgatatgggccccgggaaaagtatattcctggccggggggagaacccacacttggatgtggagaaccccccccggggggtcccccttttaaaaggggggtccccctggggtttttttttccccccaaaaaagcccgggcccaagacgcaacag

SEQ ID NO: 53358 - protein, 83 aa, Zea mays
  misc_feature: Ceres CLONE 1473940-F
MPPLATTYTKYETRRRDPDPRAAVLLVIDVQGHFASLAAPIMPAIASTVALCPAAGVPVLYPRHLERAPRLPPLGKCGPGQPH

SEQ ID NO: 53359 - DNA, 667 bp, Zea mays
  misc_feature: Ceres CLONE 1473945-F
  misc_feature: Encodes the peptide sequence at SEQ ID NO. 53360
  misc_feature (485)..(485): n is a, c, t, g, unknown, or other
  misc_feature (494)..(494): n is a, c, t, g, unknown, or other
  misc_feature (579)..(579): n is a, c, t, g, unknown, or other
aagctggagctccccgcggtggcggccgctctagaactagtggatcccccgggctgcaggaattcgtctcacccctagaaaaatcctactgtcacacacacacagagagagacaagtggtttccaaagccaagtgtgtactaccagtctagcaaccagctagttcgggcggaaccaggaaccattatggtcgaagaaaaacaccaccacttcttccaccaccacaagaaggaccaggaacagccccccggcgagtaccggtactccgagaccgaggtggtcaccgccaccggcgagggcgagtaccagaggtacaagaaggaggagaaggagcacaagcacaagcagcacctcggcgaggccggcgccatccccgccggggccttcgcactctacgagaagcacgaggcgaaaaaggaccccgagcacgcgcacaggcacaagatcacggagggaggtctcttgccgcgggggccgtcggcgccngcggctacnttattccccgagcaccccgaaaagaagaagggaccccaggacgcccaaggaggctagcggcaaaaaaaacaccacccacctcttncggttaacgttataacgggccggggcgcgacccaaaagctagctatctccggggaacacaacaacacccgtgtttaaatctgtactgg

SEQ ID NO: 53360 - protein, 121 aa, Zea mays
  misc_feature: Ceres CLONE 1473945-F
  misc_feature (41)..(121): Pfam Name: ABA_WDS Pfam Description: ABA/WDS induced protein
MVEEKHHHFFHHHKKDQEQPPGEYRYSETEVVTATGEGEYQRYKKEEKEHKHKQHLGEAGAIPAGAFALYEKHEAKKDPEHAHRHKITEGGLLPRGPSAPAATLFPEHPEKKKGPQDAQGG

SEQ ID NO: 53361 - DNA, 664 bp, Zea mays
  misc_feature: Ceres CLONE 1473957-F
ggagctccccgcggtggcggccgctctagaactagtggatcccccgggctgcaggaattcgtctcacccctagaaaaaaaggccaccgtcgcctctgacggagccttctcaagaggtacctgaagtacttgcacccgaaggacttgatcatccaccgcgtgcggtattggctacccgcgtgtgctggaaaatcggacggaagcgtctatgagtgtcttctacttcaacattggttaaagcgagggcgatgaagaacattagattgccctacgcttatattttaggatggaagtcgttgcattttaatacctgtacccgatatttcgcaaatgtcacatgtaacggcgtggcacggataatttcaaataccgtatgtcctgaatcactacgcatcctatgttgtgtacccagctgtgacgtgccgtattcctctggcgccggaaggtcgtctctggctccgtcgaccagtccgaccagagcttcctcaacgacaacaaggtcgccgacggttggttgctcacatgcactgaataacccacctcggacgtcggggtcccaatctcccggaagaggagctcctataattcgggctagcgggcccccgtttagagccgtcggaattgggcaaaccctggcggttcccccctttaacgaattgagactt

SEQ ID NO: 53362 - DNA, 709 bp, Zea mays
  misc_feature: Ceres CLONE 1473968-F
  misc_feature (103)..(103): n is a, c, t, g, unknown, or other
  misc_feature (400)..(400): n is a, c, t, g, unknown, or other
  misc_feature (643)..(643): n is a, c, t, g, unknown, or other
tccccgcggtggcggccgctctagaactagtggatcccccgggctgcaggaattcgtctcacccctagaaaggtgcccgcggtgctagtgacggttgctctanatccgttcatcctggtggttttgtgaggtcgaaagcggcgagcgaattaaaagatgctggacaagctgtgggacgacgtggtggccgggcctcccccggagacgggcctctagaaactccgcaaggccacccccgcccgcccgctcttcatcaacaaaaacgcggacgggggttgctacaagggggggggagtccacccccttcgaccccgacgacgccggtggacgccgtcgttttttggaaaaaattttttttccccccccacccggggggacccgccccgggggcccccccccnaaacaaacccccccccccccggggtttgggacaacaaacttctctccaaccgggccgtcaggggtaatcttccccactccttttttctaacggggtttttctcagcgaccatcgacctcgggccacaacttccgtttgtggcggtggaggtcagtgggcggtggaccctctatctttgcctcctctgtccgtgttgtcccccgctgtgccccccccccaccgcgccctcgccgcccacccagnccgccttccgccgcgcgaggcgtccgggctccggggggtgcgcccggcatgccccggggcccgccc

SEQ ID NO: 53363 - DNA, 656 bp, Zea mays
  misc_feature: Ceres CLONE 1473977-F
  misc_feature (175)..(175): n is a, c, t, g, unknown, or other
  misc_feature (210)..(210): n is a, c, t, g, unknown, or other
  misc_feature (211)..(211): n is a, c, t, g, unknown, or other
  misc_feature (346)..(346): n is a, c, t, g, unknown, or other
  misc_feature (359)..(359): n is a, c, t, g, unknown, or other
  misc_feature (415)..(415): n is a, c, t, g, unknown, or other
  misc_feature (416)..(416): n is a, c, t, g, unknown, or other
  misc_feature (427)..(427): n is a, c, t, g, unknown, or other
  misc_feature (428)..(428): n is a, c, t, g, unknown, or other
  misc_feature (445)..(445): n is a, c, t, g, unknown, or other
  misc_feature (456)..(456): n is a, c, t, g, unknown, or other
  misc_feature (497)..(497): n is a, c, t, g, unknown, or other
  misc_feature (502)..(502): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (576)..(576): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (596)..(596): n is a, c, t, g, unknown, or other
  misc_feature (597)..(597): n is a, c, t, g, unknown, or other
  misc_feature (630)..(630): n is a, c, t, g, unknown, or other
  misc_feature (631)..(631): n is a, c, t, g, unknown, or other
  misc_feature (634)..(634): n is a, c, t, g, unknown, or other
  misc_feature (635)..(635): n is a, c, t, g, unknown, or other
  misc_feature (639)..(639): n is a, c, t, g, unknown, or other
  misc_feature (641)..(641): n is a, c, t, g, unknown, or other
  misc_feature (642)..(642): n is a, c, t, g, unknown, or other
acccgcggtggcggccgctctagaacagtggatcccccgggctgcaggaattcgtctcacccctagaaaactgcaacgggaaggttgcttttgatgacatcttaagcatcttgcgagatctgacaggttcatttatgacagagcaccagagacagattattgggcattctgagcntcagatggaggttgaagttcctatttgacctaaannaaaacccaaaataagtatccatctagttgtatccggtgattgtgtttgcccgaaaaaaccccccaggaaccctggtaaatggtcccattttttgggggttggaaaatttaaaggtccttatggggtggtattttntttttcaaaaaanacaccccccccttttgggtataaaaaaatttttcccaaaaaaaatccatggaattnntcccaatattnnagaaaaagtgtggtaantttttttaagngggaaaaaaccccaaaggtgttggggcccccccctgggttnttaanaaaaaaannnnaacaaaaaagaaaaaannnnntaaaagnnnnaaaaaaaaaaaaccggcaagcacgcctttctntttcnnnngggggggggggnnccccaacggaatttccccccctaaaaagggggnnaannatantnnccccacgagaaaag

SEQ ID NO: 53364 - DNA, 633 bp, Zea mays
  misc_feature: Ceres CLONE 1473978-F
  misc_feature: Translation starting site: 163
  misc_feature: SWISSPROT Homolog: EC 3.2.1.23 Beta-galactosidase
ggcggccgctctagaactagtggatcccccgggctgcaggaattcgtctcacccctagaaaattgtaaatgagcaaggctaactctgttccggtgactgaaggctggcaattattggtctgcgctgcgctctcgacgccgtgcagtagctgcggctttgctcatggaagacacgcccttctctgcatatgctttggttcctggcagccgtcagatgtggagtgattggacggttagttgggctcctcacgtgccgcgtctctgctccttgtctctctggctggctctgcttccgcctgggcctgggcatattgcggagccttgattaaagctggcccagctcggatacggccgcagctatcattgtacgtactactgcaaccgagttccagccagccagccaccccacccctctcctttctttttccctttagcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttccc

SEQ ID NO: 53365 - DNA, 652 bp, Zea mays
  misc_feature: Ceres CLONE 1473980-F
  misc_feature: Translation starting site: 136
  misc_feature: SWISSPROT Homolog: EC 1.8.1.8 Protein-disulfide reductase
  misc_feature (217)..(217): n is a, c, t, g, unknown, or other
  misc_feature (265)..(265): n is a, c, t, g, unknown, or other
  misc_feature (342)..(342): n is a, c, t, g, unknown, or other
  misc_feature (359)..(359): n is a, c, t, g, unknown, or other
  misc_feature (390)..(390): n is a, c, t, g, unknown, or other
ggagctccccgcggtggcggccgctctagaactagtggatcccccgggctgcaggaattcgtctcacccctagaaaaaattcactcacccacctagctagtcatcactagtcacgttcgtccaccagagacaacaatggccatggagacgtgcttcagagcgtgggcgctgcacgcccccgctggcagcaaggacaggctcctcgtcgggcacctgntgctgccgtcgaagcgggcgctcgcgccgctgtccgtggggcgcgtcnccacgcgccggccgcggcacgtctgccagtccaagaacgcagtggacgaagttgtggtggcggaccaaaaaaactgnacggtttggtgatggcntgcaaaaccccggtgctggtggagttctggncgccgtggtgcgggccctgcccgagatcgcgccgggtatccacaagctgcccaagactacccccgaagatcacgtgctgcaaggtgaaacggacgacagccccaacgtggcgtctacctacgggatccgcagcatccccacggggctcttcttcaaggggcggaaagaaaagggaaaagcgtcatcggcccccttccccaaattcccaccctccccacccttcattgaaacaagtaccttcggtaattccatgaaccttgcc

SEQ ID NO: 53366 - DNA, 642 bp, Zea mays
  misc_feature: Ceres CLONE 1473992-F
  misc_feature: Pfam Name: Jacalin Pfam Description: Jacalin-like lectin domain
  misc_feature (334)..(334): n is a, c, t, g, unknown, or other
  misc_feature (357)..(357): n is a, c, t, g, unknown, or other
  misc_feature (362)..(362): n is a, c, t, g, unknown, or other
  misc_feature (557)..(557): n is a, c, t, g, unknown, or other
  misc_feature (560)..(560): n is a, c, t, g, unknown, or other
ggagctccccgcggtggcggccgctctagaactagtggatcccccgggctgcaggaattcgtctcacccctagaaaaacaacactcgtcgatctacacacatacatagtttcttctactacacgacgacaaacttggggaagcctgcgaagatcggagagtggggtggatacgcccggcgatcgtcggatctgaaggctactccggaccggctgaccgaggtgaaggtcacggcggaacacagcagctgcatccgctccatctccttcatctacatcggagccgatgggcagccgtacgaggaggggccatggggtttcggccatgctggcacngagtacaagattgatctgtgcangttcnacaagagcttgacggagatctccggggaccacgggcccagccctacacattgacaatctggtcaagtctctcaaatttgtcaccaacaaacgtacttacggaccgtacggcagggacgaggccaccccgttccgtgtcaggggatgaacaacgggcacgtcggctggcttctttgccgctctggagattgcctgnacncaatcgggctctacgtcaccccccactaataactaaaacgatggatccgatcatctgcatgcatgcatatgcagtatgctcc

SEQ ID NO: 53367 - DNA, 662 bp, Zea mays
  misc_feature: Ceres CLONE 1473997-F
  misc_feature: Encodes the peptide sequence at SEQ ID NO. 53368
  misc_feature (288)..(288): n is a, c, t, g, unknown, or other
  misc_feature (291)..(291): n is a, c, t, g, unknown, or other
  misc_feature (430)..(430): n is a, c, t, g, unknown, or other
  misc_feature (469)..(469): n is a, c, t, g, unknown, or other
  misc_feature (505)..(505): n is a, c, t, g, unknown, or other
  misc_feature (506)..(506): n is a, c, t, g, unknown, or other
ggagctccccgcggtggcggccgctctagaactagtggatcccccgggctgcaggaattcgtctcacccctagaaaaaaagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgaattcntcnaagccgcagcggagtccggcgaggcctcccacgcctgcggctgcggtagcagctgcaagtgcgacccctgcaactgctgatcacatcgatcgacgaccatggatatgattattatctatctagcttgcgggtgtcggtngaacataataagcgaggcggagctggctgccatacatangtattgtgtggtgtgtgaaaaaaacaaaaaacaaanntcttcagtttgctatctctctctctgcatgtttggcgtcagtctttgtgctcatgtacgtgtgtctacatgcatggtgggtggatccgattgcctctgctgtaaccatatattaaatgggcccccgatgatatgatttgaaactatatatatatat

SEQ ID NO: 53368 - protein, 76 aa, Zea mays
  misc_feature: Ceres CLONE 1473997-F
  misc_feature (1)..(76): Pfam Name: Metallothio_2 Pfam Description: Metallothionein
  misc_feature (50)..(50): Xaa is any aa, unknown, or other
  misc_feature (51)..(51): Xaa is any aa, unknown, or other
MSCNCGSSCGCGSSCKCGKKYPDLEETSTAAQATVVLGVAPEKKAAPEFXXAAAESGEASHACGCGSSCKCDPCNC

SEQ ID NO: 53369 - DNA, 648 bp, Zea mays
  misc_feature: Ceres CLONE 1474000-F
  misc_feature: Encodes the peptide sequence at SEQ ID NO. 53370
  misc_feature (433)..(433): n is a, c, t, g, unknown, or other
  misc_feature (505)..(505): n is a, c, t, g, unknown, or other
ggagctccccgcggtggcggccgctctagaactagtggatcccccgggctgcaggaattcgtctcacccctagaaaaagtgttctcgactcgaccgccgccgtcccagttcgcttcgcgtcacccagagctcgtcggcctccgtccccgcgagaagcgagagcatggacacccaggtgaagcttgctgttgtggtgaaggtgatgggcaggaccggctccaggggtcaggtgacccaggtcagagtgaagttcttggatgaccacaaccgtctcatcatgaggaacgtcaagggccctgttcgtgagggtgacatcctcaccctgctcgagtctgagagggaggccaggacgctgcgctgaagccctggtggccttggatgtaattctgtaaattttgttctatgtctgtcgaacttgccgtgtgaccttcancacatctgctttgagatttactcagcctgaattgcagttttattttatgttcctgctggaaagtgacttgangagacataggtatcagtggttatctataatagctcaaaataaaaaaaaaaaacgagacgctcgaggtaccccattcgccctatagtgagtcgtattacgcgcgctcactggccgtcgttttacaacgtcgtgactggggaaac

SEQ ID NO: 53370 - protein, 65 aa, Zea mays
  misc_feature: Ceres CLONE 1474000-F
  misc_feature (1)..(65): Pfam Name: Ribosomal_S28e Pfam Description: Ribosomal protein S28e
MDTQVKLAVVVKVMGRTGSRGQVTQVRVKFLDDHNRLIMRNVKGPVREGDILTLLESEREARTLR

SEQ ID NO: 53371 - DNA, 570 bp, Zea mays
  misc_feature: Ceres CLONE 1474001-F
  misc_feature: Encodes the peptide sequence at SEQ ID NO. 53372
  misc_feature (46)..(46): n is a, c, t, g, unknown, or other
  misc_feature (180)..(180): n is a, c, t, g, unknown, or other
  misc_feature (318)..(318): n is a, c, t, g, unknown, or other
  misc_feature (550)..(550): n is a, c, t, g, unknown, or other
ggagctccccgcggtggcggccgctctagaactagtggatcccccngggctgcaggaattcgtctcacccctagaaaaaaagaggagtctgacaagtccaagtcggaggtcaatgaccaggatgatgaaaagggtagtgaggaggatgaagatgatgacgagtgatggagctcctcgagnacatggaccgtgcttcatcccacaatggagcggctacacagggccccgtggcgatcacaaaaaaaggagcctatatccatgtactagaattattcagtttcactccacatcgggatgtttttattttacttttgggcnggctataacggatagccctcctcgttgggccccactggcggggggggtctgcctcttggcctgggggtttgggtttgggccaactttgccacccaccaaaggcccctggttggacccaaaaatacgggtcccctttggcgccatttcgggaaaaaattgtataaatggcctttttggggtttgtttaatttccctttcaaaaaaaaaacccccccggtaaaaaaattaaaancccgggggccgccgttgggg

SEQ ID NO: 53372 - protein, 138 aa, Zea mays
  misc_feature: Ceres CLONE 1474001-F
  misc_feature (20)..(20): Xaa is any aa, unknown, or other
  misc_feature (66)..(66): Xaa is any aa, unknown, or other
MMKRVVRRMKMMTSDGAPRXHGPCFIPQWSGYTGPRGDHKKRSLYPCTRIIQFHSTSGCFYFTFGXAITDSPPRWAPLAGGVCLLAWGFGFGPTLPPTKGPWLDPKIRVPFGAISGKNCINGLFGVCLISLSKKKPPR

SEQ ID NO: 53373 - DNA, 590 bp, Zea mays
  misc_feature: Ceres CLONE 1474002-F2
  misc_feature: SWISSPROT Homolog: EC 3.2.1.23 Beta-galactosidase
  misc_feature (310)..(310): n is a, c, t, g, unknown, or other
  misc_feature (561)..(561): n is a, c, t, g, unknown, or other
  misc_feature (563)..(563): n is a, c, t, g, unknown, or other
tccccgcggtggcggccgctctagaactagtggatcccccgggctgcaggaattcgtctcacccctagaaaaaacgggattggtaacgaaggcctgcccgaaaatgataatgtccatagaagcactctcagcagccgatcctcagaaagggaacctagttcaagcaaactgcagacagatcatgaccatgaccatgaatttccaaaggaagaccagagctttgatgaggagaccttcgtgaggacgaaacgctgcccgtgtggtttttctatccaagtagaggagttgtaactttgataccagaatgcancagtgcacatggttaactgtgttacatatggccccttttcgtcatttgaagtcggaatcaaaacgtagttttgaaaaaaaaaaaaaacgagacgctcgagtaccccattcgcctatagtgagtcgtattacgcgcgctcactggccgtcgttttacaacgtcgtgactgggaaaaccttggcgttacccaacttaatcggcctgcagccaatcccccttttcccaaggtggggtaataagcgaaaggcccngnaccgatcccccttcccaaaagttgggc

SEQ ID NO: 53374 - DNA, 590 bp, Zea mays; identical to SEQ ID NO: 53373
  misc_feature: Ceres CLONE 1474002-F
  misc_feature: Encodes the peptide sequence at SEQ ID NO. 53375
  misc_feature (310)..(310): n is a, c, t, g, unknown, or other
  misc_feature (561)..(561): n is a, c, t, g, unknown, or other
  misc_feature (563)..(563): n is a, c, t, g, unknown, or other

SEQ ID NO: 53375 - protein, 79 aa, Zea mays
  misc_feature: Ceres CLONE 1474002-F
PRGGGRSRTSGSPGLQEFVSPLEKTGLVTKACPKMIMSIEALSAADPQKGNLVQANCRQIMTMTMNFQRKTRALMRRPS

SEQ ID NO: 53376 - DNA, 646 bp, Zea mays
  misc_feature: Ceres CLONE 1474014-F
  misc_feature (646)..(646): n is a, c, t, g, unknown, or other
aagctggagctccccgcggtggcggccgctctagaactagtggatcccccgggctgcaggaattcgtctcacccctagaaaaacctggcttctatgagccatagagccgcttcggccttccactatccgtgttgccgagctgcggcgggcgtttcccctccgtcgcctcaccagtctcctcgcctctttctcgtttgcggcgaaatccacagtatctgcggctcctcgcaccacgtttcggctgcgaccccttctcccgaaataccaatgatgagagctggatgaacataatcaaagaaaattatgcgctgcacaagtcctttgcattgcatttttccactgcaaggttgtagatgcaggcacaaagatatacttgtagacagaaaccataatgcctgaccctgcttattccatctcaattatggtcaactagagtaattgtcgtggttcaatgcactgtacttgttatacgttcatatggtgcaattgttataagacgttactcatcacccagaaaaagaaaaacaactagacgctcgatgtacccacttcgccctatagtgagtcgtattactcgcgctcaatggccgtctgtttacaagtcgtgactggtaaaaccactgacgtacccaacttagtcgccttn

SEQ ID NO: 53377 - DNA, 655 bp, Zea mays
  misc_feature: Ceres CLONE 1474016-F
aagctggagctccccgcggtggcggccgctctagaactagtggatcccccgggctgcaggaattcgtctcacccctagaaaagtcaagctgaagaggattggaccgaagtggtaccgcggtgtccgaaggcatggcctcatcatgggctgctccgtcacaggcgtcaagagagagcgcggtgactctcccttggagcttggtcccaggcggaggatgtcagcaagccagtgaatccgatcaccttcctcttccgcttcctcgtaggaacgatatgtgctgcctactatgttctggtgcctatttacatgtggataaaggaccagatcgtgccatagagcatgccaatctgagtgaagggaatgagctgcatgtaagagaggatagccaacgtctgaattttactcttctctatatcagacgcttcctgcctgttttgatataaaacctctggttttccctctgcatattacttcctgcactgctgttcatgattggtgcaattagtatgctaaggaaacaaactataaaaaaaaaaaaacgagacgctcgaggtacccaattcgccctatagtgagtcgtattacgcgcgctcactggccgtcgttttacacgtcatgactgggaaaaccctggcggtaaccaactgatcggctg

SEQ ID NO: 53378 - DNA, 675 bp, Zea mays
  misc_feature: Ceres CLONE 1474017-F
  misc_feature: Encodes the peptide sequence at SEQ ID NO. 53379
  misc_feature (675)..(675): n is a, c, t, g, unknown, or other
ggagctccccgcggtggcggccgctctagaactagtggatcccccgggctgcaggaattcgtctcacccctagaaaaactcttttccggctgcgccatcccctcgcagccgccagccctcaacgttcctaccagctgccaccgcctgttaccagtgatgtctcccgcccttgccgctggcgtggagcccatggccgtcgacgattccgcctccaagaaggccaagcgcaagcagctcaaggccgccgccgccgccgcggaggcagaggcggaggccgcttcggtaaaaaaaaaaaaaaaacgagacgctcgaggtacccaattcgccctatagtgagtcgtattacgcgcgctcactggcccgtcgttttacaacgtcgtggactgggaaacccctgcgttacccaacttaatccccttgcagcacatccccccttttcgcagctgggcgtaatagcgaagaagcccgcacccaatcgcccctcccaaacagttgcgcaacctggaatggcgaaatgaaaattgtaagcgttaaatattttgttaaaatttccgcgttaaattttttggttaaatcaacctcattttttttaaccaatagaggccaaaattcggcaaaatccctttaataatccaaaaaaataaacccagaatagggttgaagggtttttccccn

SEQ ID NO: 53379 - protein, 58 aa, Zea mays
  misc_feature: Ceres CLONE 1474017-F
MSPALAAGVEPMAVDDSASKKAKRKQLKAAAAAAEAEAEAASVKKKKKRDARGTQFAL

SEQ ID NO: 53380 - DNA, 583 bp, Zea mays
  misc_feature: Ceres CLONE 1474019-F
  misc_feature (319)..(319): n is a, c, t, g, unknown, or other
  misc_feature (320)..(320): n is a, c, t, g, unknown, or other
  misc_feature (335)..(335): n is a, c, t, g, unknown, or other
  misc_feature (345)..(345): n is a, c, t, g, unknown, or other
aagctggagctccccgcggtggcggccgctctagaactagtggatcccccgggctgcaggaattcgtctcacccctagaaaagaaaagcacggctcaggaaaaacaacggcggacagcccgcctccaccgccgtggcgccgttcaccccgccccgcgttctctctccctcggtgacggctcgacgaccgccgcgccggcctacgctccagccttcatgtgctttcgcggggcccttcgccgtcgactacacaccacaccagcatagggttctcttcccttcctgctctacgaagcctagcacccaaccctaactgtttnngtttatcggatttgntcccactacnaatgtggtgtatgtagtattgtgtcaactaactttcctctttttccctttttttttctttttgcaaaaaaaaaaaaaaaaacgagacgctcggaggtaccccattccgccttaaagggaagtccgaattacgcggcgctcctgggccctcctttttccaacgtcttgcatggggaaacccctggggttacccaaattttaatcgctttgggaaaaattcccccttttcgccggtgggc

SEQ ID NO: 53381 - DNA, 648 bp, Zea mays
  misc_feature: Ceres CLONE 1474027-F
  misc_feature: Translation starting site: 86
  misc_feature: SWISSPROT Homolog: EC 3.2.1.23 Beta-galactosidase
  misc_feature (157)..(157): n is a, c, t, g, unknown, or other
  misc_feature (228)..(228): n is a, c, t, g, unknown, or other
aagctggagctccccgcggtggcggccgctctagactagtggatcccccgggctgcaggattcgtctcacccctagaaaaacgccatgcgctgggcgcagcagacctccatggtctactactactgccaggattacaccaaggatcgctccttgtanccagagtgctcgctcgctagctagcctagctaccactaccagagcaagagcatgcatggaggaggcgtgcnagtgaaaaaacccccccctacgtacgtaccgttctaaaattgtatgtacaattaagtctccatccacatccatatatacatatgtaatgtataattaagtccattattaatttaatcatcaaaaaatggaacatgcctatatatttcctactaaaaaaaaaaaaaaaaaacgagacgctcgaggtacccatttcgccctatagtgagtcgtattacgcgcgctcactggccgtcgttttacaacgtcgtgactgggaaaaacctggcgttacccaacttaatcgcttgcagcacatccccctttcgccagctggcgtataacggagagccccgcacgatcgcccttcccaaagttgcgcaccctgatggccaatgaaaattaacctttatatttttgtaaaattcccgtaaatttttgta

SEQ ID NO: 53382 - DNA, 657 bp, Zea mays
  misc_feature: Ceres CLONE 1474040-F
  misc_feature: Encodes the peptide sequence at SEQ ID NO. 53383
  misc_feature (458)..(458): n is a, c, t, g, unknown, or other
agctggagctccccgcggtggcggccgctctagaactagtggatcccccgggctgcaggaattcgtctcacccctagaaaaagaccggagacttgggggcttcacctgctgtatctcattaccatctgcatctggttgcccgttgattgagaaggaggagctgagggccatggcgaccgagaagcccatcctgtacaacgcctggatcagctcctgctcccaccgtgttcgcatcgcactcaacctcaggggtgtggattacgagtacaagtcggtaaaccctaggacagatccagattatgaaaaaatcaatccaatcaaatatattccagcattagtagatggggacatagtcgtttctgattctcttgccctctcatggtatttggaagataagtatcctgagcatccactcctgcctaaagatctcaagaggaaagctcttaatcttcagattngcaacattgtttgttcaagcattcaacctcttcaagggtatgctgttatgggtctgcacgagggtaggatgagcccagatgaaggccttcatattgttcaaaagtatattgacaagggattcagagcgatccaaaaagctgttggagggatgttaaaataattatgctactggaaatgatgtccaattggcaaatgttt

SEQ ID NO: 53383 - protein, 149 aa, Zea mays
  misc_feature: Ceres CLONE 1474040-F
  misc_feature (4)..(75): Pfam Name: GST_N Pfam Description: Glutathione S-transferase, N-terminal domain
  misc_feature: SWISSPROT Homolog: EC 2.5.1.18 Glutathione transferase
  misc_feature (97)..(97): Xaa is any aa, unknown, or other
MATEKPILYNAWISSCSHRVRIALNLRGVDYEYKSVNPRTDPDYEKINPIKYIPALVDGDIVVSDSLALSWYLEDKYPEHPLLPKDLKRKALNLQIXNIVCSSIQPLQGYAVMGLHEGRMSPDEGLHIVQKYIDKGFRAIQKAVGGMLK

SEQ ID NO: 53384 - DNA, 656 bp, Zea mays
  misc_feature: Ceres CLONE 1474042-F
  misc_feature: Encodes the peptide sequence at SEQ ID NO. 53385
  misc_feature (180)..(180): n is a, c, t, g, unknown, or other
  misc_feature (319)..(319): n is a, c, t, g, unknown, or other
  misc_feature (555)..(555): n is a, c, t, g, unknown, or other
  misc_feature (629)..(629): n is a, c, t, g, unknown, or other
  misc_feature (633)..(633): n is a, c, t, g, unknown, or other
ggagctccccgcggtggcggccgctctagaactagtgggatcccccgggctgcaggaattcgtctcacccctagaaaaaccacgccgtcactcctctcaacccgaccacgccgcgcctccgcttcgaaccctagccgagcggggtaaggagggaaatggggaagggtacgggcagcttcngcaagcgccggaacaaaacgcacacgctgtgcatccgctgcggccgccgcagcttccacctccagaagagtacctgctcctcctgcggctaccccgcggcccgcatccgcaagtataattggagtgtgaaggccatcangcgcaagaccactggtacggggagggatgagtacatgcgacacgtgcctcgccgtttcaagagcaacttcagagaagggactgaggctgccccaaagaagagtgctgctgctgccaactaagtgtggatgttgccatcaagaccctcagaagctagacgttggatctttttgatttgaatggacttctgacctatttgcccgtaatactattacaggactgggtttaccgtgtccnagatggaaccagacccccttcttctttgggagcgtaatttatttttcaccccagttttatgccccgtgaaaaanaaanaaaaagaaaaaaccccccccccc

SEQ ID NO: 53385 - protein, 94 aa, Zea mays
  misc_feature: Ceres CLONE 1474042-F
  misc_feature (2)..(55): Pfam Name: Ribosomal_L37e Pfam Description: Ribosomal protein L37e
  misc_feature (9)..(9): Xaa is any aa, unknown, or other
  misc_feature (55)..(55): Xaa is any aa, unknown, or other
MGKGTGSFXKRRNKTHTLCIRCGRRSFHLQKSTCSSCGYPAARIRKYNWSVKAIXRKTTGTGRDEYMRHVPRRFKSNFREGTEAAPKKSAAAAN

SEQ ID NO: 53386 - DNA, 694 bp, Zea mays
  misc_feature: Ceres CLONE 1474044-F
  misc_feature: Translation starting site: 144
  misc_feature (239)..(239): n is a, c, t, g, unknown, or other
  misc_feature (272)..(272): n is a, c, t, g, unknown, or other
  misc_feature (405)..(405): n is a, c, t, g, unknown, or other
gctccccgcggtggcggccgctctagaactagtggatcccccgggctgcaggaattcgtctcacccctagaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaagcccgcgtgacnatgcgcaggacggcggcgaaagccaagccagcngcggcgtccggaagccggtggtacggccccgacggcgtgctgtacctggggcccactggtccggcgagccaccgagctacctgacgggcgaagttcccgggcgactacgggttgggacaccgcggggctggtnggcggacccggaaacgttcgccaggaaccgggagctgggaggtgatcccctccccgctgggccatgctggggcccgctcggtttgcctccttccccgagctgctccccccccaacgggcttcaaatttcgggcaaggccctttttgggttcaagccccgccctcccaaatctttcaggcgagggcggggtttgaattaccctcgggaaacccgaaccctctcttccaccgcgaaaaagcatccctttcttatcttgggccctgcccagggtcctttcttcatggggccc

SEQ ID NO: 53387 - DNA, 828 bp, Zea mays
  misc_feature: Ceres CLONE 1474045-F
  misc_feature: Translation starting site: 215
  misc_feature (41)..(41): n is a, c, t, g, unknown, or other
  misc_feature (489)..(489): n is a, c, t, g, unknown, or other
  misc_feature (606)..(606): n is a, c, t, g, unknown, or other
gagaggggcggggggggggggcgcgcgggccgtttctcccncggcaacaccacaaccatggactccaccgcgtggcggccgctctagaactagtggatcccccgggctgcaggaattcgtctcacccctagaaaaaaccagcaagaccaacaaacccacttctgactgaccactgtgccgcgccgtggtcaccggacggacacacagaacgacgatggccgcgtcggggctgcaccagaccaccagcttcctcgggcaggccctggtctcccgcgccgccggcgtcgatgccggtgggcgcatcaccatgcgccgcaccgtcaagagcgttccccagagcatatggtacggccctgatcgccccaagtatcttggccccgttctccgaggcagacgccgtcgtacctgaaccggggagttcccccgggggagtaaaactcggaacaaccccgggtctttcttggtggaacccaaaaaacccccccgggnccccaaccgggggagcctgggaaggtgaatcccactcccccgggtggggcgaaatgcctggggccgcggcctggggcctgggggtgattccccggtgaaaatcccttggggccaaanacacacggcctgtaaaaggtttccggccaaaggcccggggtgggggttctcaagggcccggggcgccgacagaattttttctctcgagaaggggcgggggttcggaacttacccttggggggaacacccccgaccctgtgggggggacccgcaaaagaagcctatccctggggccacttcttggggcggcgggcccaggggggtggcggcgtccataggggg

SEQ ID NO: 53388 - DNA, 649 bp, Zea mays
  misc_feature: Ceres CLONE 1474047-F
  misc_feature: Encodes the peptide sequence at SEQ ID NO. 53389
  misc_feature (582)..(582): n is a, c, t, g, unknown, or other
tccccgcggtggcggccgctctagaactagtggatcccccgggctgcaggaattcgtctcacccctagaaaaagcagggcctcttgatcatcagtcgccagaggagctgttgatcgaggtgagtgaggttgaaaagcaggcggcgaacaaaggcaccatcgtcatggacggcggatactacggcggccgcgatcagcgctacagcggcgggtactacggcggcggtggcatcgcgacgccggggtacgctccggcggtcccgtacgggatgtcgcaggtgaacatcgaggggcacgggtgcgggcgggcgctgccgccgcagccgaccgtgaatgtgtactgccgcgccaaccccaactacgccatgagcgtccgcgacggggaggtggtgctggcgccggcaaacccccaggacgagtaccagcactggatcaaggacatgcggtggagcacgagcatcaaggacgaagaagggtacccggcgttcgcgctggtgaacaggcgaccgggggagcccatcagcactcgctggggcagtcccacccggtgcgcctggtgccctacaaccggacttcctggacnaagtcggtgctgtggacggagaacccccacttcggcaacggctttcggctgcgtccgcatgttcaaa

SEQ ID NO: 53389 - protein, 162 aa, Zea mays
  misc_feature: Ceres CLONE 1474047-F
  misc_feature (140)..(140): Xaa is any aa, unknown, or other
MDGGYYGGRDQRYSGGYYGGGGIATPGYAPAVPYGMSQVNIEGHGCGRALPPQPTVNVYCRANPNYAMSVRDGEVVLAPANPQDEYQHWIKDMRWSTSIKDEEGYPAFALVNRRPGEPISTRWGSPTRCAWCPTTGLPGXSRCCGRRTPTSATAFGCVRMFK

SEQ ID NO: 53390 - DNA, 649 bp, Zea mays
  misc_feature: Ceres CLONE 1474055-F
  misc_feature: Encodes the peptide sequence at SEQ ID NO. 53391
  misc_feature (621)..(621): n is a, c, t, g, unknown, or other
acccgcggtggcggccgctctagaactagtggatcccccgggctgcaggaattcgtctcacccctagaaaaagcaagaacagagcgaacagaggactgaagcagagcgagcgagctgtccggccaaaccctcacggccgcctccacaatgccgcgccatctcgcgctgctcctgcccctgctcctgctggcctcgccggcggccacgcgcctggcgtccgccgcctgcgcgggcgagaagttcccggcggggcgtgcgtacgcgtcgtgcgaggacctgccgaagctgggcgcgtcgctgcactggacgtacgacgcgtccaagagctccctgtcggtggcgttcgtggcggcgcccgcggcggcgggcgggtgggtggcgtggggcctgaacccgacgggcgagggcatggccggcgcgcaggcgctggtggcgctggcgggggccggggccgcggcgcccgccgtgcggacgtacaacatcacggggtacgtcccgctgggcaaggcctccacgccgctggacttcccggcgaccgacctcgcccgcgacgccgcgggcggcaagatccgggtgtacggcaagctgcagctgcgcaaggggatgaaaggcgtgaaccangtgtggcaggtccgcgcgtcctccacgg

SEQ ID NO: 53391 - protein, 167 aa, Zea mays
  misc_feature: Ceres CLONE 1474055-F
  misc_feature (88)..(166): Pfam Name: DUF568 Pfam Description: Protein of unknown function (DUF568)
  misc_feature (158)..(158): Xaa is any aa, unknown, or other
MPRHLALLLPLLLLASPAATRLASAACAGEKFPAGRAYASCEDLPKLGASLHWTYDASKSSLSVAFVAAPAAAGGWVAWGLNPTGEGMAGAQALVALAGAGAAAPAVRTYNITGYVPLGKASTPLDFPATDLARDAAGGKIRVYGKLQLRKGMKGVNXVWQVRASST

SEQ ID NO: 53392 - DNA, 675 bp, Zea mays
  misc_feature: Ceres CLONE 1474057-F
  misc_feature: Encodes the peptide sequence at SEQ ID NO. 53393
  misc_feature (418)..(418): n is a, c, t, g, unknown, or other
  misc_feature (419)..(419): n is a, c, t, g, unknown, or other
ctccccgcggtggcggccgctctagaactagtggatcccccgggctgcaggaattcgtctcacccctagaaaaaggccgccgccgttaccacctccttgcgccatggcggagaagtcgccggcagccgacgtggaagccggtctccttgcccacctcaactcagcgggagaggtccccgactcacgctctttcgcttcctccctcggcgtctcccacctcgaacttgagggcgtcatcaagagcctctcagctttccgcatcgtcgacagcacagacatcatcaaggagacatgggtgctcaccgaggaggccaagggctacgccgccaagggctcccccgaggcacagctcgtcgccgcaatttcaccggagggtgcctctaaggacgcacttcaggcaatatgggagatgctttcnnatgtggcatgaaagcagccgccagaaccaagtggataggggtcgaggagggggataagggacttagtccttaggaggttgaaagcctaaaggatggacttgcagaccaccttaaaaactaaaagaagggggaaggttgtttccgaaaaagggatcaaggatttaaaggaaaggaaacttttttccaaaggaaaaaccctttggggcccccctaaaaaaagggggccttaattttggttaaaaaaaaaaaaactttg

SEQ ID NO: 53393 - protein, 108 aa, Zea mays
  misc_feature: Ceres CLONE 1474057-F
  misc_feature: SWISSPROT Homolog: EC 6.1.1.20 Phenylalanine--tRNA ligase
  misc_feature (106)..(106): Xaa is any aa, unknown, or other
MAEKSPAADVEAGLLAHLNSAGEVPDSRSFASSLGVSHLELEGVIKSLSAFRIVDSTDIIKETWVLTEEAKGYAAKGSPEAQLVAAISPEGASKDALQAIWEMLSXVA

SEQ ID NO: 53394 - DNA, 635 bp, Zea mays
  misc_feature: Ceres CLONE 1474060-F
  misc_feature (386)..(386): n is a, c, t, g, unknown, or other
tccccgcggtggcggccgctctagaactagtggatcccccgggctgcaggaattcgtctcacccctagaaaaacaagcaccagaccaattaactagcttcttctagctctagctaggctcgtctgctgcaagaaggaacagtaacagcaggcatggaggggaaggaggaggacgtccgcctgggcgccacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccnagtccaccctccagtgcgccaccgtcggcatccagggcatcgccctggtccttcggcggcatgatcttcgcccctcgtctactgcaccgccggcatctcccgcgggcacatcaacccggcggtgactttcgggctgttcctgggcgaggagttgtcccttcccaagggcggggttttacctcatcatgcagtgcctgggcgcccttctgcggggcgggcgtcctcaaggggttcccagcaggggctgta

SEQ ID NO: 53395 - DNA, 1253 bp, Zea mays
  misc_feature: Ceres CLONE 1474061
  misc_feature: Encodes the peptide sequence at SEQ ID NO. 53396
agcttcgacgtatttctctatctatctatacggttcaagggactgaagaaggtagagagagaaacttgaaggggagaggaatgagatacaggttcatgttcatttaggtgtcagttcatctgatttctcagaagcaaaatgttgtttggagctcagtgacaccatcttgtaatgcatgtgccttttacgggaaatggaggatcattctgtccatccaaagtctaagtctaaccatggttccttgtcaggaaatggttatgagatgaaaaatccaggccatgaagtttgtgatagggattcatcatcagagtctgatcgatctcacccagaagcatcagcagtgagtgaaagcagtctagatgaacacacatcaactcaatcagacaatgatgaagatcatgggaaggataatcaggacacattgaagccagtattgtccttggggaaggaagggtctgcctttttggccccaaaaatagattacaacccgtcttttccttatattccttatactgctgacgcttactatggtggcgttggggtcttgacaggatatgctccgcatgccattgtccatccccagcaaaatgatacaacaaatagtccggttatgttgcctgcggaacctgcagaagaagaaccaatatatgtcaatgcaaaacaataccatgcgatccttaggaggaggcagacacgtgctaaactggaggcgcagaacaagatggtgaaaggtcggaagccataccttcatgagtctcgacaccgtcatgccatgaagcgggcccgtggctcaggagggcggttcctcaacacaaagcagcagctccaggagcagaaccagcagtaccaggcgtcgagtggttcaatgtgctcaaagaccattggcgacagcgtaatctcccaaagtggccccatttgcacgccctcttctgacgctgcaggtgcttcagcagccagccaggaccgcggctgcttgccctcggttggcttccgccccacagccaacttcagtgagcaaggtggaggcggctcgaagctggtcgtgaacggcatgcagcagcgtgtttccaccataaggtgaagagaagtgggcacgacaccattcccaggcgcgcactgcctgtggcaactcatccttggcttttgaaactatgaatatgcaatggacatgtagctttgagttcctcagaataaccaaacgcgaagaatatgcaaagtccttttgagatttgctgtaaaaaaaaaaaaaaaaa

SEQ ID NO: 53396 - protein, 301 aa, Zea mays
  misc_feature: Ceres CLONE 1474061
  misc_feature (154)..(210): Pfam Name: CBFB_NFYA Pfam Description: CCAAT-binding transcription factor (CBF-B/NF-YA) subunit B
  misc_feature: The sequence is a functional homolog of SEQ ID NO 1338 in the 11/479,226 US patent application
  misc_feature: The sequence is a functional homolog of SEQ ID NO 622 in the 10/412,699 US patent application
MCLLREMEDHSVHPKSKSNHGSLSGNGYEMKNPGHEVCDRDSSSESDRSHPEASAVSESSLDEHTSTQSDNDEDHGKDNQDTLKPVLSLGKEGSAFLAPKIDYNPSFPYIPYTADAYYGGVGVLTGYAPHAIVHPQQNDTTNSPVMLPAEPAEEEPIYVNAKQYHAILRRRQTRAKLEAQNKMVKGRKPYLHESRHRHAMKRARGSGGRFLNTKQQLQEQNQQYQASSGSMCSKTIGDSVISQSGPICTPSSDAAGASAASQDRGCLPSVGFRPTANFSEQGGGGSKLVVNGMQQRVSTIR

SEQ ID NO: 53397 - DNA, 689 bp, Zea mays
  misc_feature: Ceres CLONE 1474062-F
  misc_feature (300)..(300): n is a, c, t, g, unknown, or other
  misc_feature (689)..(689): n is a, c, t, g, unknown, or other
ctggagctccccgcggtggcggccgctctagaactagtggatcccccgggctgcaggaattcgtctcacccctagaaaaaacctcgtcctcctcctgctcctgcattctcgcccgtcccccaaattcacctcggccaccctccaccacctcgtcggcgcgggcagcagttcgcctcatcgtcctcccacctgacgacgtcgcggttcgcgctctcgcggcgtgccgcgcacccattcctcgcccacgtctcccgcgagttccacgccttctgtgccacgcgccacccggagccactgttncgcgcgccctccgcatctctgacctctacatctccatccgcggaagcagaccacctcgaatccttctccttcacgcagtcattgcttgcctccttagcccaactggttgggtaccacaggttcatgtttcatcataagggatgaacagtagtcgacaaatggaactccactacataaacactggatttccatacaccatcaccgagagcttcatggaattcctttgagggtctcaccttatgctcatggctgacttttgctctcacgggagggctttccagggatcaggggtatcccatactggggcaaatgatgcataccaaacctcgtaaaaaatatggggatacttctgggccccggggaaactaattaccaggtttatgccttgn

SEQ ID NO: 53398 - DNA, 664 bp, Zea mays
  misc_feature: Ceres CLONE 1474063-F
  misc_feature: Encodes the peptide sequence at SEQ ID NO. 53399
  misc_feature (164)..(164): n is a, c, t, g, unknown, or other
ctggagctccccgcggtggcggccgctctagaactagtggatcccccgggctgcaggaattcgtctcacccctagaaaagctcgcaagtcgcatcgcacgtacggtctcaggcgcatcggcctcgccgctgcacaacgccggagacgagacgacggcggctgcnggatgacggtcttccactttctcaactgcgccttcctcacctttcggccctcacgtcgtctactactcccgcacgcccctgtcagagtatgatacaatcgggcacttctataaaagcagctgctgtttatcttggaactgcgcttgtaaagcttgttggcttggcacattgctcaaagtacctgagatgatagctttgacccctatcagggagtaatgaaagtttttattggatcatagatggagctggactgtatttggctttgacccagctgacccacagaacatctctcagaatcataagtccagggctggtgggtcttggttgggctttttgctgattcagttttgcaccaactgggcacttctctggattggggccaggaagggcttgaatttccgtgggaagaccttttttcaagggacttgaagccgaatggctatcctggggaggacctctcctcccttggtgcatttggggccccttgaatgggggcttaa

SEQ ID NO: 53399 - protein, 33 aa, Zea mays
  misc_feature: Ceres CLONE 1474063-F
MIQSGTSIKAAAVYLGTALVKLVGLAHCSKYLR

SEQ ID NO: 53400 - DNA, 722 bp, Zea mays
  misc_feature: Ceres CLONE 1474072-F
  misc_feature: Encodes the peptide sequence at SEQ ID NO. 53401
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (309)..(309): n is a, c, t, g, unknown, or other
  misc_feature (319)..(319): n is a, c, t, g, unknown, or other
  misc_feature (355)..(355): n is a, c, t, g, unknown, or other
  misc_feature (359)..(359): n is a, c, t, g, unknown, or other
  misc_feature (365)..(365): n is a, c, t, g, unknown, or other
  misc_feature (366)..(366): n is a, c, t, g, unknown, or other
  misc_feature (369)..(369): n is a, c, t, g, unknown, or other
  misc_feature (376)..(376): n is a, c, t, g, unknown, or other
  misc_feature (387)..(387): n is a, c, t, g, unknown, or other
  misc_feature (399)..(399): n is a, c, t, g, unknown, or other
  misc_feature (400)..(400): n is a, c, t, g, unknown, or other
  misc_feature (405)..(405): n is a, c, t, g, unknown, or other
  misc_feature (406)..(406): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (464)..(464): n is a, c, t, g, unknown, or other
  misc_feature (467)..(467): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (483)..(483): n is a, c, t, g, unknown, or other
  misc_feature (484)..(484): n is a, c, t, g, unknown, or other
  misc_feature (487)..(487): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (513)..(513): n is a, c, t, g, unknown, or other
  misc_feature (514)..(514): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (546)..(546): n is a, c, t, g, unknown, or other
  misc_feature (547)..(547): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (637)..(637): n is a, c, t, g, unknown, or other
  misc_feature (638)..(638): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (668)..(668): n is a, c, t, g, unknown, or other
  misc_feature (669)..(669): n is a, c, t, g, unknown, or other
  misc_feature (676)..(676): n is a, c, t, g, unknown, or other
  misc_feature (682)..(682): n is a, c, t, g, unknown, or other
  misc_feature (690)..(690): n is a, c, t, g, unknown, or other
  misc_feature (699)..(699): n is a, c, t, g, unknown, or other
  misc_feature (706)..(706): n is a, c, t, g, unknown, or other
  misc_feature (707)..(707): n is a, c, t, g, unknown, or other
  misc_feature (711)..(711): n is a, c, t, g, unknown, or other
  misc_feature (712)..(712): n is a, c, t, g, unknown, or other
aagctggagctccccgcggtggcggccgctctagaactagtggatcccccgggctgcaggaattcgtctcacccctagaaaaagccttcccattcccccgtctcctcttcccttccgccatggcccagcccgctttcctctcctctctccgctcccgcctctgctccgcgccgccgcccccgccgaaccatcgcctccagcctaggcgcggctaccannncgtcgaagcctccgggggcttcgcggaaaaaagccgctttttggggaaagggaaaagaagaaaattttttcccctttttaaaaaaaggngtgttttcanaattctcttacacaaagaaaaaggggggggtggggnaggntaaagnncgncagcggncgcgggcgccncggcccgccggnncgcgnncgcggccacgcgagacgggnnnnnnnaacgccagccacacccgagcgcaagaaaaggnagnaatnnnnnnnncgacnncgngcgnnntgcagagagggaaggagggnngggggagggcggcggtgggggaagnnngcggnntagcggccaggggnnnngnnnnnnnnggggagagagggcggagtcgtcgctcgccnnncctccccctccgcgctgaatnnnttggcagannttgtgagcnnnaatgcggagtgggtgaggnngtggcgntggcanttggtggnttgggcggntgtgggnnttgnncgcgttggtg

SEQ ID NO: 53401 - protein, 80 aa, Zea mays
  misc_feature: Ceres CLONE 1474072-F
  misc_feature (33)..(33): Xaa is any aa, unknown, or other
  misc_feature (34)..(34): Xaa is any aa, unknown, or other
  misc_feature (64)..(64): Xaa is any aa, unknown, or other
  misc_feature (67)..(67): Xaa is any aa, unknown, or other
  misc_feature (79)..(79): Xaa is any aa, unknown, or other
MAQPAFLSSLRSRLCSAPPPPPNHRLQPRRGYXXVEASGGFAEKSRFLGKGKRRKFFPLFKKRXVFXILLHKEKGGGGXG

SEQ ID NO: 53402 - DNA, 646 bp, Zea mays
  misc_feature: Ceres CLONE 1474074-F
  misc_feature: Encodes the peptide sequence at SEQ ID NO. 53403
  misc_feature (406)..(406): n is a, c, t, g, unknown, or other
  misc_feature (519)..(519): n is a, c, t, g, unknown, or other
  misc_feature (612)..(612): n is a, c, t, g, unknown, or other
ctccccgcggtggcggccgctctagaactagtggatcccccgggctgcaggaattcgtctcacccctagaaaaactctcgctccgttgctcgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgagggagccgagaagatgggacttgactacatggatgttgaggctctcnagaaaatgaaacagaacaagaagcttgttaagaggcttgccaagaagtaccatgctttcttggcatcagaggccatcatcaagcagattccccgtctccttgggtctggtcantcacagggcaggcagttcccgaccctggttactcaccaggaatccctcgaaatcaaggtgaacgagactaaggccaccgtcaagttccagctncagaaggtcctttgcatgggcgtcgccgtcggca

SEQ ID NO: 53403 - protein, 169 aa, Zea mays
  misc_feature: Ceres CLONE 1474074-F
  misc_feature (9)..(169): Pfam Name: Ribosomal_L1 Pfam Description: Ribosomal protein L1p/L10e family
  misc_feature (90)..(90): Xaa is any aa, unknown, or other
  misc_feature (127)..(127): Xaa is any aa, unknown, or other
MSKLQSESVKDAISQIVGDAKEKNRKFTETVELQIGLKNYDPQKDKRFSGSVKLPHIPRPKMKVCMLGDAQHVEGAEKMGLDYMDVEALXKMKQNKKLVKRLAKKYHAFLASEAIIKQIPRLLGSGXSQGRQFPTLVTHQESLEIKVNETKATVKFQLQKVLCMGVAVG

SEQ ID NO: 53404 - DNA, 665 bp, Zea mays
  misc_feature: Ceres CLONE 1474076-F
  misc_feature: Encodes the peptide sequence at SEQ ID NO. 53405
  misc_feature (378)..(378): n is a, c, t, g, unknown, or other
  misc_feature (406)..(406): n is a, c, t, g, unknown, or other
  misc_feature (409)..(409): n is a, c, t, g, unknown, or other
  misc_feature (412)..(412): n is a, c, t, g, unknown, or other
  misc_feature (415)..(415): n is a, c, t, g, unknown, or other
  misc_feature (452)..(452): n is a, c, t, g, unknown, or other
  misc_feature (453)..(453): n is a, c, t, g, unknown, or other
ctccccgcggtggcggccgctctagaactagtggatcccccgggctgcaggaattcgtctcacccctagaaaaagcccaccctccccgcggatcacagacagcctgtgcccgccttccagtccacaatctccctgcctctcctctcccaccctccgaaaagcaagctccggccggaccgccccaccgcgcgcgcgcatacacacagagatagagagaccgcacggtcgttcggggttcctttgggccagcgcacgacacgagcatggcgcagcgcgacaagaaggaggagccccacgagctgcgggcgccggagatcgcgctctgcgccaacaactgcggctttccggggcaaccggccacgcaaaaactgtgccagnacctgcttctcggcgtcaaggtccttcntcntcntcntcttcggaaggccgtcccctacctccttctccctcannttcccgcggccggcccgccgcggtgccccaaccgagggccggccctcctggggggcgggcctgcagctgggccccccggcccgggggcccgggcccaccctggggagggcctccggcaaggattttttccaaacgggggttccatcttcccgaaaagccgtggggggttaacggggtttccgggcccccttggggaaacttgttttgggggg

SEQ ID NO: 53405 - protein, 134 aa, Zea mays
  misc_feature: Ceres CLONE 1474076-F
  misc_feature (39)..(39): Xaa is any aa, unknown, or other
  misc_feature (48)..(48): Xaa is any aa, unknown, or other
  misc_feature (49)..(49): Xaa is any aa, unknown, or other
  misc_feature (50)..(50): Xaa is any aa, unknown, or other
  misc_feature (51)..(51): Xaa is any aa, unknown, or other
  misc_feature (63)..(63): Xaa is any aa, unknown, or other
  misc_feature (64)..(64): Xaa is any aa, unknown, or other
MAQRDKKEEPHELRAPEIALCANNCGFPGQPATQKLCQXLLLGVKVLXXXXLRKAVPYLLLPXXPAAGPPRCPNRGPALLGGGPAAGPPGPGARAHPGEGLRQGFFPNGGSIFPKSRGGLTGFPGPLGETCFGG

SEQ ID NO: 53406 - DNA, 660 bp, Zea mays
  misc_feature: Ceres CLONE 1474078-F
  misc_feature (235)..(235): n is a, c, t, g, unknown, or other
  misc_feature (275)..(275): n is a, c, t, g, unknown, or other
  misc_feature (278)..(278): n is a, c, t, g, unknown, or other
ggagctccccgcggtggcggccgctctagaactagtggatcccccgggctgcaggaattcgtctcacccctagaaaaaacccgagacctccagccgtccgcccctgaaccctcagccttctccgtcccgcctcggcactcgacggccgccggcacacaccgcgcagtctcgagacaggaaccggaggaacgaggatgggagatgactcgccgctgacaaaacgatgaagggtgcngtgacaggactcgccgcggggaccatctggggcaccgtcntcnccacctggtacgacgtgccccgtgtggagcgccacgtcgcgctccctggcctatccggacgctcaaagatgtgcggcacctacggggccacccttcggcaccatcggggggcctctacatcggcgtcaagcagctcgtgcagaggcagcgcaagaagcgcgacttcttcaacgggcccttcggcgctttccttgccgggaccttctgtctgcggctacagaggaaaaatattcattcacccctcatcggagggctcctgtctggctttcacatctgctgggctggaacattgcgggaataccaaccagagttgacaacggcaaaaaagtactttccctacacaattgaagaaaaacctggaaattgattcccaggcctgcct

SEQ ID NO: 53407 - DNA, 645 bp, Zea mays
  misc_feature: Ceres CLONE 1474082-F
  misc_feature: Encodes the peptide sequence at SEQ ID NO. 53408
  misc_feature (584)..(584): n is a, c, t, g, unknown, or other
  misc_feature (585)..(585): n is a, c, t, g, unknown, or other
tccccgcggtggcggccgctctagaatagtggatcccccgggctgcaggaattcgtctcacccctagaaaaaaggaccccagcagctcttgcggtcgtccctcagccgcgtcgcaccgcatcgcattctacgattcgaagctctctgctcgcaggggaccatggcgaagaactacccaaccgtgagcgccgagtacagcgaggccgtcgagaaggccaggcgcaagctccgcgccctcatcgccgagaagagctgcgcacccctcatgctccgcctcgcgtggcactccgcggggacgttcgacgtgtcgtcgaggaccggcggtcccttcggtactatgaagtgcccggcggaactggctcacggcgccaacgcggggctggacatcgcggtgcggctgctcgagcccatcaaggaggagttccccaccctctcctatgccgacttctaccagcttgccggagttgtggccgtcgaggtcaccggtgggcctgagatccccttccacccaggcagggagggacagcctcagccgccacctgagggccgtcttcctgatgcccaccaggggtctgacccactgnnagcagtctttggcaagcagatgggtttgagtgatcaggacatcgttgccctctctggtgg

SEQ ID NO: 53408 - protein, 161 aa, Zea mays
  misc_feature: Ceres CLONE 1474082-F
  misc_feature (19)..(161): Pfam Name: peroxidase Pfam Description: Peroxidase
  misc_feature: SWISSPROT Homolog: EC 1.11.1.11 L-ascorbate peroxidase
  misc_feature (142)..(142): Xaa is any aa, unknown, or other
MAKNYPTVSAEYSEAVEKARRKLRALIAEKSCAPLMLRLAWHSAGTFDVSSRTGGPFGTMKCPAELAHGANAGLDIAVRLLEPIKEEFPTLSYADFYQLAGVVAVEVTGGPEIPFHPGREGQPQPPPEGRLPDAHQGSDPLXAVFGKQMGLSDQDIVALSG

SEQ ID NO: 53409 - DNA, 654 bp, Zea mays
  misc_feature: Ceres CLONE 1474085-F
  misc_feature: Encodes the peptide sequence at SEQ ID NO. 53410
  misc_feature (625)..(625): n is a, c, t, g, unknown, or other
  misc_feature (637)..(637): n is a, c, t, g, unknown, or other
ctccccgcggtggcggccgctctagaactagtggatcccccgggctgcaggaattcgtctcacccctagaaaaaatccaaactcacagcacgctagctcttcagaacttgcggacgaaagactgaccgccgtacacggctagcagatcgatcgaccatggcgtcgtcctctcttctcctcctcgccgccgtcgccctcttcgcggcctccgcagacgcggccaccttcaacgtcatcaaccgctgcaagaacacgctgtggccggccgccctccccggcggcggcgcgcgcctggacccgggcaagacgtggaccgtgcaggtgccggcgggcacggcgcacgcgcgggtgtgggcgcgcacggggtgcagcttcgacggcagcggccgcgggacgtgccagacgggggactgcggcggcgcgctggcgtgcaccgtgtccgggagaacccccgcgacgctgggcgagtacacgctcaacaggaacggcccggactacatcgacatctccctcgtggatgggcttcacgtgcccatgtccttccagtgccgcggcaggggccccagctgcaagggcgacatcaacgcccagtgccccgccgcgctcaaggtgcccgggcgctgcngcagcgcctgcnagaagctcggcggcgac

SEQ ID NO: 53410 - protein, 166 aa, Zea mays
  misc_feature: Ceres CLONE 1474085-F
  misc_feature (28)..(165): Pfam Name: Thaumatin Pfam Description: Thaumatin family
  misc_feature (157)..(157): Xaa is any aa, unknown, or other
  misc_feature (161)..(161): Xaa is any aa, unknown, or other
MASSSLLLLAAVALFAASADAATFNVINRCKNTLWPAALPGGGARLDPGKTWTVQVPAGTAHARVWARTGCSFDGSGRGTCQTGDCGGALACTVSGRTPATLGEYTLNRNGPDYIDISLVDGLHVPMSFQCRGRGPSCKGDINAQCPAALKVPGRCXSACXKLGGD

SEQ ID NO: 53411 - DNA, 707 bp, Zea mays
  misc_feature: Ceres CLONE 1474088-F
  misc_feature: Encodes the peptide sequence at SEQ ID NO. 53412
  misc_feature (490)..(490): n is a, c, t, g, unknown, or other
aaagctggagctccccgcggtggcggccgctctagaactagtggatcccccgggctgcaggaattcgtctcacccctagaaaaaattcccaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcagacgccgtcgtacctgaccggcgagttccccggcgactacgggtgggacacccgcggcctctcggccgacccggagacattcgcgcgcaaccgggagctgggagtgatccactccccgtgggcgaatgctggcgcgctgggctgcntgttcccggaagatcttggccagaacggcttcaagttcgccgaggcggggtgtttcaggccggccccccaatttttctcgaaggcgggttggacacctggggaacccaaacctgggacccaccaaagatcccggcccattggggtggcccaggggggtcccaggggtttctcctaagggtacccgtccgggggggcccccttgggggaagggctcaa

SEQ ID NO: 53412 - protein, 165 aa, Zea mays
  misc_feature: Ceres CLONE 1474088-F
  misc_feature (59)..(166): Pfam Name: Chloroa_b-bind Pfam Description: Chlorophyll A-B binding protein
  misc_feature (108)..(108): Xaa is any aa, unknown, or other
MAASALHQTTSFLGQALVSRAAGVDAGGRITMRRTVKSVPQSIWYGPDRPKYLGPFSEQTPSYLTGEFPGDYGWDTRGLSADPETFARNRELGVIHSPWANAGALGCXFPEDLGQNGFKFAEAGCFRPAPQFFSKAGWTPGEPKPGTHQRSRPIGVAQGGPRGFS

SEQ ID NO: 53413 - DNA, 730 bp, Zea mays
  misc_feature: Ceres CLONE 1474090-F
  misc_feature: Encodes the peptide sequence at SEQ ID NO. 53414
agagctggagctccccgcggtggcggccgctctagaactagtggatcccccgggctgcaggaattcgtctcacccctagaaaaaacttccccggctcctgcctcccgccgccgacaccaccaaaaaccctagcagctccaccccgccgccgccgccgccgccatggatgaccctcggatgttcccatcaggatccgacgaccgctccgacgccgaacgccggctgtacaacccgtaccaggacctcaacatgccctacagctaccggacgctctacgacctccccacttcgccggagttcctcttccaggaggaggccctggcgcaacgacgctcgtggggtgagaacctcactttctatacgggcgtcgggtacctctccggcgccgttggcggcgccgtcctgggcctccgcgacgccgccaggggcgctgagccccgggagaccgccaagatctgcgccaaccgcgtggctcaacgcctgcagcagcttctgcccgccccgtccgggaattctttgggcgtcatttggctccatgtacccccgggattcaagaaccccctgggtccgggcccgctgacccgaacaactgggataaaacgcttcccccccggggcttgtgcccggggaaactctttcccgggccccaaaaggggccgaaaccccccccccctccagggcgcccctgagggaaaactcaccccccccccccccccggggggcaaaacac

SEQ ID NO: 53414 - protein, 189 aa, Zea mays
  misc_feature: Ceres CLONE 1474090-F
MDDPRMFPSGSDDRSDAERRLYNPYQDLNMPYSYRTLYDLPTSPEFLFQEEALAQRRSWGENLTFYTGVGYLSGAVGGAVLGLRDAARGAEPRETAKICANRVAQRLQQLLPAPSGNSLGVIWLHVPPGFKNPLGPGPLTRTTGIKRFPPGACARGNSFPGPKRGRNPPPLQGAPEGKLTPPPPPGGKT

SEQ ID NO: 53415 - DNA, 706 bp, Zea mays
  misc_feature: Ceres CLONE 1474097-F
  misc_feature: Encodes the peptide sequence at SEQ ID NO. 53416
  misc_feature (117)..(117): n is a, c, t, g, unknown, or other
  misc_feature (118)..(118): n is a, c, t, g, unknown, or other
aacctggagctccccgcggtggcggccgctctagactagtggatcccccgggctgcgggaattcgtctcacccctagaaaaaaaaaaaaactctggcctagggactcggcgcactcnngcgcacgtcgtcacgtccgcctccaccccaatcggatggggtatgagagagaaaaaacatctcctcagtctcagctaccctgagctgcaatgtttgtgcaaaagtataacccttcctgctagaagacccactctcagttagcaagttcgctcggctcgctgctggaggcatctccatctgctggctcctcctcctgtccaattagcaaatatgaaagggggcctccacgtgcaatcatgctaaacaacaaaagaggcccatacaatggcagggatgatgggtaaaccacttgtggcctccaaaccttcaaaaagggagtccagacccctggttgataaaaaccttctaaaaggggggttggacccttgggaccaataatcccttcccgtttttttggaacctgggaaagacccaaaatttcgtgggcctttctttttttgtggacgggggagaattgttctttattttaccggcccccaaggggggggggggatattttcaaataaaatacacacaaattttgggattttgttggggaaaaattgatttgttccccgcgccaaaagagaatttgacccaaatccgccc

SEQ ID NO: 53416 - protein, 37 aa, Zea mays
  misc_feature: Ceres CLONE 1474097-F
MAGMMGKPLVASKPSKRESRPLVDKNLLKGGLDPWDQ

SEQ ID NO: 53417 - DNA, 682 bp, Zea mays
  misc_feature: Ceres CLONE 1474100-F
  misc_feature: Encodes the peptide sequence at SEQ ID NO. 53418
aaagctggagctccccgcggtggcggccgctctagaactagtggatcccccgggctgcaggaattcgtctcacccctagaaaaagcaacagatacacacacactcgggtaaagctatctcgagctagctagctgctgtaagccgttgccatggccaaaatggtgttgctctgcgtgctcgtctccttcctcctgatgcccttggcctccctagccctgacgcaggacttctgcgtcgccgacctgacctgcagcgacacgccggcggggtacccgtgcaagtccagcgtcaccgccaacgacttctacttccacggcctggccggccagggcaaaataaacccactcatcaaggccgccgtgaccccggccttcgtgggccagttcccgggcgtcaacgggcttggcatctctgcggccaggctcgacatcgaggtgggcggcgtcgtgccgctgcacacccacccggcgggctcagagctcctcttcgtgacccagggcaccgtcgccgccggcttcatcagctccggctccaacacgtctacaccagacgctgtacgcgggcgacatcatggtgttcccccgggtctgctccactacagtacaacgccggcaccgggctgccgtgggctcgtcgctttagccgccccaactcgggctgaaatcacgacttgcgctctttg

SEQ ID NO: 53418 - protein, 177 aa, Zea mays
  misc_feature: Ceres CLONE 1474100-F
  misc_feature (55)..(173): Pfam Name: Cupin_1 Pfam Description: Cupin
  misc_feature: SWISSPROT Homolog: EC 1.15.1.1 Superoxide dismutase
MAKMVLLCVLVSFLLMPLASLALTQDFCVADLTCSDTPAGYPCKSSVTANDFYFHGLAGQGKINPLIKAAVTPAFVGQFPGVNGLGISAARLDIEVGGVVPLHTHPAGSELLFVTQGTVAAGFISSGSNTSTPDAVRGRHHGVPPGLLHYSTTPAPGCRGLVALAAPTRAEITTCAL

SEQ ID NO: 53419 - DNA, 676 bp, Zea mays
  misc_feature: Ceres CLONE 1474113-F
  misc_feature: Translation starting site: 327
  misc_feature (370)..(370): n is a, c, t, g, unknown, or other
  misc_feature (443)..(443): n is a, c, t, g, unknown, or other
  misc_feature (447)..(447): n is a, c, t, g, unknown, or other
  misc_feature (452)..(452): n is a, c, t, g, unknown, or other
  misc_feature (453)..(453): n is a, c, t, g, unknown, or other
  misc_feature (476)..(476): n is a, c, t, g, unknown, or other
  misc_feature (477)..(477): n is a, c, t, g, unknown, or other
  misc_feature (480)..(480): n is a, c, t, g, unknown, or other
  misc_feature (482)..(482): n is a, c, t, g, unknown, or other
  misc_feature (489)..(489): n is a, c, t, g, unknown, or other
  misc_feature (490)..(490): n is a, c, t, g, unknown, or other
  misc_feature (492)..(492): n is a, c, t, g, unknown, or other
  misc_feature (493)..(493): n is a, c, t, g, unknown, or other
  misc_feature (498)..(498): n is a, c, t, g, unknown, or other
  misc_feature (504)..(504): n is a, c, t, g, unknown, or other
  misc_feature (507)..(507): n is a, c, t, g, unknown, or other
  misc_feature (508)..(508): n is a, c, t, g, unknown, or other
  misc_feature (511)..(511): n is a, c, t, g, unknown, or other
  misc_feature (514)..(514): n is a, c, t, g, unknown, or other
  misc_feature (520)..(520): n is a, c, t, g, unknown, or other
  misc_feature (521)..(521): n is a, c, t, g, unknown, or other
  misc_feature (528)..(528): n is a, c, t, g, unknown, or other
ctccccgcggtggcggccgctctagaactagtggatcccccgggctgcaggaattcgtctcacccctagaaaaaatacaattccaactgcggggcaggggtccagctccttatcctgtctccctcccacctttcccttcctcgccgctctcgcttgcccgcgcaccgagatttcctgcctgctcgtgctcgctccgctgctctcctcgactcctcctgcatgcctgccgaccggtccgaggcacgccgcggcggaggctctgcgtctgccggccgggtcgtcggattcggccttaggttggttggttggttggttgggtcgcgggcatgtccacggcggtggcgcggccggcgcacggcggattccggcnggtcggggagcggaagccggatccgggacgagcggacaggatgatgcggagcgccaacgggtacttggtccangaangaganngagaagagcatggcgatgaggcnngcngncaagaannanngagangaggangcnngangcngtgtcnnaaggccntcgtcgatcggggcgggcgtcgtccgaacagctcctcctccatcggggagaactccgcgtcccccaccagggagggaggaggaggaggtttaaaacccaagggcccagggggctcgggaatgatgggggctgggccacgcctcgaatc

SEQ ID NO: 53420 - DNA, 615 bp, Zea mays
  misc_feature: Ceres CLONE 1474123-F
  misc_feature: Encodes the peptide sequence at SEQ ID NO. 53421
  misc_feature (224)..(224): n is a, c, t, g, unknown, or other
  misc_feature (273)..(273): n is a, c, t, g, unknown, or other
  misc_feature (289)..(289): n is a, c, t, g, unknown, or other
  misc_feature (297)..(297): n is a, c, t, g, unknown, or other
  misc_feature (300)..(300): n is a, c, t, g, unknown, or other
  misc_feature (323)..(323): n is a, c, t, g, unknown, or other
  misc_feature (351)..(351): n is a, c, t, g, unknown, or other
tggagctccccgcggtggcggccgctctagaactagtggatcccccgggctgcaggaattcgtctcacccctagaaaaacgtctccggctccggcgtccgcttccaaccaactcacaccaaagtggcgacatcgccttccgccgcctgacacgtctggagttgttgttttagccgccagctcgctcccatctatctccatggagtctgctcccgccgcggtcantggagcggagcgcctcacagccgagatgggcttccgcgggcgcgacaangcgcggcgggacggcngcaagccngcncccagcatcgtcatcaggatccngccgcggctcccggacttcccccgcagnatcaagctcaagtacgtcaggctcgggatccgacccggaagcacgcccaccgtcggggctgcccatgctctgggtggccgggggccgcccccccccccttattcttggtccgccttaaccccaaccaataccccctttaacctggttcacttgggtcccctgggttcggacccgggcttgtggttttcaccggttaattattttaagggggcccccgccgggggaaccctcggggaaattcccgggggtaaaacgccgggggga

SEQ ID NO: 53421 - protein, 139 aa, Zea mays
  misc_feature: Ceres CLONE 1474123-F
  misc_feature (9)..(9): Xaa is any aa, unknown, or other
  misc_feature (25)..(25): Xaa is any aa, unknown, or other
  misc_feature (31)..(31): Xaa is any aa, unknown, or other
  misc_feature (42)..(42): Xaa is any aa, unknown, or other
  misc_feature (51)..(51): Xaa is any aa, unknown, or other
MESAPAAVXGAERLTAEMGFRGRDXARRDGXKPAPSIVIRIXPRLPDFPRXIKLKYVRLGIRPGSTPTVGAAHALGGRGPPPPPYSWSALTPTNTPFNLVHLGPLGSDPGLWFSPVNYFKGAPAGGTLGEIPGGKTPGG

SEQ ID NO: 53422 - DNA, 675 bp, Zea mays
  misc_feature: Ceres CLONE 1474129-F
tcagaactagtggatcccccgggctgcaggaattcgtctcacccctagaaaaaaatctgtcagccgagccaagttccgaatgggggtggcttggcttggctggctacaagtcactcaaattgaaataagactgaaacggacaaaggcaaacacagcaagcaaagcaggcatcggaggtagacgacgaccaccacggggataacaaccaaacctcccaaataccatccacgaacgaaagggaagggaaggtcgtttaggcggcgcgccgaggccgtggctatggaccccaacggcggcggggacaccatcctcggcgatcccctcctttcccctctcccccccgggggggggggggggggatcctctcgccgggattttaaaaaaaccccccccccccccccacaaccgaggaaagatccgggggggaggggaaacccccccccctttcgcccgggggcccccaacaaccccaggccggcgccccccaaacttggggaccctgcgcgccaccaccaggccgccgaccctgacccgcccgccgctaaacagaggttcgccaccgcccccgccgcgctacccccggcacacagccccgcgccccggaccgcccccgggccccagtccccgctcgtcgagagccagcgacgccacaacgcccccccgtggggccgctcc

SEQ ID NO: 53423 - DNA, 652 bp, Zea mays
  misc_feature: Ceres CLONE 1474143-F
  misc_feature: Encodes the peptide sequence at SEQ ID NO. 53424
  misc_feature (430)..(430): n is a, c, t, g, unknown, or other
  misc_feature (545)..(545): n is a, c, t, g, unknown, or other
  misc_feature (652)..(652): n is a, c, t, g, unknown, or other
gctccccgcggtggcggccgctctagaactagtggatcccccgggctgcaggaattcgtctcacccctagaaaaaccctactccatcttctcgtgttgttcggcgcacgcggagacagcccgcgatcccgatcccgatccttcttcacgcgaatctcgacgatcccccccttccttccttcaagatgttcaatctttgtgggtatggatgatccgacggataaccccacatggttatggatataaagatgccattttatgcgggacgacaagacgatgctcatcggtgctgacccacgcacgtcggcgaccgctgcatcaggggtcacatccaccactgcttctttgacggcacgcggcagaggcacccccgcctccgcttcggaaaagggtcactctacaacaactacacgcgcagctggggcatctancgcgtctgcgcaggcgtagaagcccagatcgtgtcccagtgcaacatctacgaggcaggtgggagggcccccaaagaagacactgtattcaagtacatgccggaaaagggcggcnaccgagaggacgtggggggcaggttccatcagctcgggaaggggaccccttcctcaatggcgcgctgccctggcctgatcaatacccctgggtttgtctccagggcn

SEQ ID NO: 53424 - protein, 42 aa, Zea mays
  misc_feature: Ceres CLONE 1474143-F
  misc_feature (7)..(7): Xaa is any aa, unknown, or other
MPEKGGXREDVGGRFHQLGKGTPSSMARCPGLINTPGFVSRA

SEQ ID NO: 53425 - DNA, 614 bp, Zea mays
  misc_feature: Ceres CLONE 1474144-F
  misc_feature: Encodes the peptide sequence at SEQ ID NO. 53426
  misc_feature (281)..(281): n is a, c, t, g, unknown, or other
  misc_feature (288)..(288): n is a, c, t, g, unknown, or other
  misc_feature (295)..(295): n is a, c, t, g, unknown, or other
  misc_feature (296)..(296): n is a, c, t, g, unknown, or other
  misc_feature (311)..(311): n is a, c, t, g, unknown, or other
  misc_feature (314)..(314): n is a, c, t, g, unknown, or other
  misc_feature (319)..(319): n is a, c, t, g, unknown, or other
acccgcggtggcggccgctctagaactagtggatcccccgggctgcaggaattcgtctcacccctagaaaaaacttggcgctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcgctgcgtccgagcgagcgggtcgaggtacggcggaaccgctacanggtggcngttgacnncgaagaggggcggcngcngcccnaagaacatatgggtgagatccgcaggacccgcgtgaggagaccctctcaagaggcgccggggggggctcaagcccagggtcctgccccctccctcggggtcaaaaaaaactttgaaaacctcccaacctatgggttaggggggggttattccggaagaataataaaccttcaggctggggggcccaccaccacagtttccgaaaaattggctcctcctatggagaagggagccccccccctttcaaaaaaatttttccaaaacgggggggttatttccccaaaaattttttggcc

SEQ ID NO: 53426 - protein, 127 aa, Zea mays
  misc_feature: Ceres CLONE 1474144-F
  misc_feature (17)..(17): Xaa is any aa, unknown, or other
  misc_feature (22)..(22): Xaa is any aa, unknown, or other
  misc_feature (27)..(27): Xaa is any aa, unknown, or other
  misc_feature (28)..(28): Xaa is any aa, unknown, or other
  misc_feature (30)..(30): Xaa is any aa, unknown, or other
MSLRPSERVEVRRNRYXVAVDXEEGRXXPXEHMGEIRRTRVRRPSQEAPGGAQAQGPAPSLGVKKNFENLPTYGLGGGYSGRIINLQAGGPTTTVSEKLAPPMEKGAPPLSKKFFQNGGVISPKIFW

SEQ ID NO: 53427 - DNA, 688 bp, Zea mays
  misc_feature: Ceres CLONE 1474157-F
  misc_feature: Encodes the peptide sequence at SEQ ID NO. 53428
aaagctggagctccccgcggtggcggccgctctagaactagtggatcccccgggctgcaggaattcgtctcacccctagaaaaagagccgagtccaccaaggccaaacgaccgcactagcgagtcgacttcgccggtgatctgtctcagctcgtcgcgtctccggcgccgacagacacgggcgagtgggcaacgaggctccgacatcggcgggcaggatgatgatgctgatcgactgctcgaggtgccgtaccccgctgcagctgccgcacggggctccctgtatgcccatgcgccatctgtggggctatcgcgcacgtcgcccccgcccctcctgtcgagcccaaccgcggtgccatacagccgcctgccggggtggggtccaccgccgccgcacggtgcacgggcgaaacccagccctggtgtgccggatatcgtatctgcactcgcggtatgagctgaagggctgcctcaacgacgtctagtgcgtgccccacctcctcatgacgcgcttcaacttccccgacgactctatcattatgctcaacgaagaacagacctacccctacaaaatcccaacaaagcataacatatggatggtcatgtattggcttgtgcaaggttgtcaacctggagactcattgctgtcccattattctgggcatggagcacagcgtataagctacagt

SEQ ID NO: 53428 - protein, 62 aa, Zea mays
  misc_feature: Ceres CLONE 1474157-F
  misc_feature: The sequence is a functional homolog of SEQ ID NO 110 in the 11/479,226 US patent application
  misc_feature: The sequence is a functional homolog of SEQ ID NO 1289 in the 11/479,226 US patent application
  misc_feature: The sequence is a functional homolog of SEQ ID NO 180 in the 10/374,780 US patent application
  misc_feature: The sequence is a functional homolog of SEQ ID NO 234 in the 10/225,068 US patent application
  misc_feature: The sequence is a functional homolog of SEQ ID NO 596 in the 10/412,699 US patent application
  misc_feature: The sequence is a functional homolog of SEQ ID NO 1888 in the 10/412,699 US patent application
  misc_feature: The sequence is a functional homolog of SEQ ID NO 1715 in the 11/479,226 US patent application
  misc_feature: The sequence is a functional homolog of SEQ ID NO 1854 in the 10/412,699 US patent application
  misc_feature: The sequence is a functional homolog of SEQ ID NO 2098 in the 10/374,780 US patent application
MTRFNFPDDSIIMLNEEQTYPYKIPTKHNIWMVMYWLVQGCQPGDSLLSHYSGHGAQRISYS

SEQ ID NO: 53429 - DNA, 716 bp, Zea mays
  misc_feature: Ceres CLONE 1474164-F
  misc_feature (573)..(573): n is a, c, t, g, unknown, or other
  misc_feature (648)..(648): n is a, c, t, g, unknown, or other
agagctggagctccccgcggtggcggccgctctagaactagtggatcccccgggctgcaggaattcgtctcacccctagaaaaaaagaaagggaaaaaaactcgcctttttctctctgctggttcaagaacgccatggaaaatctggagcgctcgctgtgattcctgcgagtacccaagcccaaccaaaccctagcccggcagccattctcttcgttccctctttgctctgcgcgccacaccacacgacctccccgaagcagacgtgcccgctgcccgtccgtcccccgtggccatggccgcgacgtggtcttcgtcttgctgcgccgcgaccgcgtcgagcagcgctctgcttcgtcatgcccgcgtcaagagcgcgccttgggtagccggtgccagccagagtagctaccacaccagcggcggcggcgggagctgtccatccgcgccacggacgcggtgccgccgccagccgtggtctacgctgacgacggcgccgacaacgtggcctcgctgaagatcaagcatctgagcgcgctgtccgggctgaaccgtgacctgacagcgagccagnacgacctggaccgcgcggacgcgacggctcaggatctggagagcgcagcggcatgacccgtccacctcagcaggnacctctataacctgcaggggcggatgcggctgctgtacactagcgcgttctcttcgcggacgctcggc

SEQ ID NO: 53430 - DNA, 621 bp, Zea mays
  misc_feature: Ceres CLONE 1474173-F
  misc_feature: Pfam Name: FAD_binding_3 Pfam Description: FAD binding domain
  misc_feature: SWISSPROT Homolog: EC 1.14.13.90 Zeaxanthin epoxidase
  misc_feature (411)..(411): n is a, c, t, g, unknown, or other
  misc_feature (412)..(412): n is a, c, t, g, unknown, or other
  misc_feature (458)..(458): n is a, c, t, g, unknown, or other
ctccccgcggtggcggccgctctagaactagtggatcccccgggctgcaggaattcgtctcacccctagaaaaaccctctgctcctcctttcagtctcagcccaatgacaaagttctaagcagagtagtgcacgggcagcacggcaacggcatagcacctccctccaccgatccagttccgcttgcgtaacgacttcccttcgcaagcaagcttcccgttcagcccacccgcaggccgccgtgctcgcgcgaccatggcgttgctctccgccacttcgcccgcaaaggcgcacctctcggcgctcctctcctgccacgacgagccgcagcagcaccaacacgcgctcccggtcccgcacccgcgctgcttcggtggcggcaagggcccagcgcgcgcgcggggcaggtgcnncgcgtcaatgcggcccgccgacgcgtccgtcgctcccgcgtccgcncccgcgggcgaggcgcggccgaaaagaaccccccggtgctggtggccggcggccgcatcggcgggctggtgttcccgctggcggccccgcccaaggggtaccacctgacggtgttcgagcccaacatgaaccgggggcgcggggagggccagacccccggccc

SEQ ID NO: 53431 - DNA, 797 bp, Zea mays
  misc_feature: Ceres CLONE 1474174-F
  misc_feature: Encodes the peptide sequence at SEQ ID NO. 53432
  misc_feature (36)..(36): n is a, c, t, g, unknown, or other
  misc_feature (37)..(37): n is a, c, t, g, unknown, or other
  misc_feature (40)..(40): n is a, c, t, g, unknown, or other
  misc_feature (797)..(797): n is a, c, t, g, unknown, or other
ccccaagttccctcctcctcctccccacaaccaaannganccccccataactggagctccactcggtggcggccgctctacaactagtggatcccccgggctgcaggaattcgtctcacccctagaaaaaccccggcgcgcaccatgagccgcgccacgccacgccactcctcctcgtcctcgcaccatgcccccactccccgcgccagcctcctccatcccctccgccccgccgcggggcaccgccaacgacgccgcccgctcctccgtcaacctcctccgctccctcgcgcgcgcgcggcgcgcggacctgtcccaccgcgcgctgctcctcttccgcacgctgcacgcctccccgtccccgccgccgccgcgctactccctgcccgccgcgctctccgcggccgccttcctcgccgcgctcccggagggccgccagctccacgctttctcccccaacatcgccctcgcgcccgcccacaccgtcatcgccaactccctcgtccacttctacgcctcctgcggccgcccgggcgccgcgctcaccgtcttctgccgcatcccggaccggacgctcgtgtccgtggaacaccgccgtcgaacagcttcgctgggcaaagagaaacaacatcagccccgcttctacctagttacaaggaaaatgcaactccgaccagggcccggacctcggaaacccgaacgaccctaccacccggggccagaaatgtgggactccgggcagcactaggcgatagggaagcacagggagagcgggttgtctaggcgtcaagaggagn

SEQ ID NO: 53432 - protein, 186 aa, Zea mays
  misc_feature: Ceres CLONE 1474174-F
MPPLPAPASSIPSAPPRGTANDAARSSVNLLRSLARARRADLSHRALLLFRTLHASPSPPPPRYSLPAALSAAAFLAALPEGRQLHAFSPNIALAPAHTVIANSLVHFYASCGRPGAALTVFCRIPDRTLVSVEHRRRTASLGKEKQHQPRFYLVTRKMQLRPGPGPRKPERPYHPGPEMWDSGQH

SEQ ID NO: 53433 - DNA, 639 bp, Zea mays
  misc_feature: Ceres CLONE 1474180-F
  misc_feature: Encodes the peptide sequence at SEQ ID NO. 53434
ctccccgcggtggcggccgctctagaactagtggatcccccgggctgcaggaattcgtctcacccctagaaaaaaggcagtccccccacccacccagcgtgcgaggcgatcaaaccgtgtgcggccgtgcgggcatggcggccacgctgctcctggcctcggcgaccgcgctcctggcgctggcggcggcgtggttctgggactacgtcgtggtgcgtctcctttggcggccccgcgccgtggccggcatgttcagggcgcagggggtccgcgggccgccctacagcttcctcagcggctgcaaccgcgagatgaggaggatgaaggcggaggccgacgacgggctccggctggacgtccgcgaccacaactacctccccagggtgatgccccacttcctcgccctggagcagcagtacggggagccattcctgtactggatgggtccgcggccccgggtctgcctcttcgactacgagtcggtaaggcaagttctttttcacaagtccgggcatttcttcaaggacgacgcccacccgactatcctgggcatgatgggcaaaggggctgtccctgttggaagcaccgactgggtgcgccatcggagggtggtcaacccagcctttcgcatggacaagc

SEQ ID NO: 53434 - protein, 168 aa, Zea mays
  misc_feature: Ceres CLONE 1474180-F
  misc_feature: SWISSPROT Homolog: EC 1.3.3.9 Secologanin synthase
MAATLLLASATALLALAAAWFWDYVVVRLLWRPRAVAGMFRAQGVRGPPYSFLSGCNREMRRMKAEADDGLRLDVRDHNYLPRVMPHFLALEQQYGEPFLYWMGPRPRVCLFDYESVRQVLFHKSGHFFKDDAHPTILGMMGKGAVPVGSTDWVRHRRVVNPAFRMDK

SEQ ID NO: 53435 - DNA, 759 bp, Zea mays
  misc_feature: Ceres CLONE 1474183-F
  misc_feature (51)..(51): n is a, c, t, g, unknown, or other
gggtggtgcccacccggcgcccacccaccctccgccccccggctcaatctnattcaaaaacggggactccccgcggtggcggccgctctagaactagtggatcccccgggctgcaggaattcgtctcacccctagaaaaactactgcttcctgagatttgagagctcgggcgccagatctgaaacctcttgtgttgtgcctttggtagttcggtgtagcattgagctagcagaggtgctgttctagttccaggatgagcaaggaggatgtcctcaaggtgcagacattgatgctgagagtgaacatacactgtgacgggtgcgagaagaaggtcaaagaagaccctccacaagatcgacggtgtctaccagagcagcatcgacgcggaacagggcaaggtgacggtgtccggtttgctggatccggataccatcatcagggagctcaacaaggccgggcaagccggctcagctgtggggccccaggcccggcatcactcaaaacgcctaccttggcggcgggaaggcccattccagggacgctgggcggcggcaagaagccttcccaagactcccggaggtggccaggggccatttccaaaggattgccgggcgggcggcaaagcccccaaaagggtgggttgcccgttgggccacccgttcacaaaggggccccttggcaggttgcccggttgcccaaaaagcctgtgtggccttggcccaaatcccctaaaaataggtggggatgcccccccacccc

SEQ ID NO: 53436 - DNA, 871 bp, Zea mays
  misc_feature: Ceres CLONE 1474184-R
ccgattgggtacctcgagcgtctcgtttttttttttttttttgtgcaaaaggcaaggctcaatatgaagtttgcgttgttaacaacaaatttcaggtaacaggtttcagaacccttgaagcaataatcatcatgaaaaatggggttccctttctagctgttgatgcaggtctgatgcctcacataacaatctagctgttgttgcaggtctgatgcctcacataacaatctagctgttgttgcaggtctgatgcctcacataccaatatagctgttgttgcaggtctgatgcctcacataccaatctaactgttgttgcaggtatgatgcctcacataccaatgccaggagactggtctaggcatttacagaacatatcggggtttccagcctccttggacactaaacgttcaggcaaaaacttcccaagctatttctcccattcagggctggtttagtggacaaaaaaatggaggggttcatagagaagggatcccaaacaggaaaataaaggagatccatggagagagatcctctagggcttgttcatttcaccgttaatccatgtggattgaatagtattgagtcggtttaaattcatagcaagtcaaaatctacccaatacattccaatacacttcaatccacatggaattggaataaccaaacaagcctaaatagcaagaggatccctgctcatggatctcctcaatttctctatccaccgaaccagcccctccggtggagggcttttagacttttcctttggtctccatctaatcgactcattggagggttcatgaaatgtgaaatccttggctgaaagtttttgactttctgagacccatcacctttttccaagagggaaggagg

SEQ ID NO: 53437 - DNA, 723 bp, Zea mays
  misc_feature: Ceres CLONE 1474192-F
  misc_feature: Encodes the peptide sequence at SEQ ID NO. 53438
aaagctggagctccccgcggtggcggccgctctagaactagtggatcccccgggctgcaggaattcgtctcacccctagaaaaaattcctacgcgcgtgttctgtctgtctctctcggccccctctcgctctccgacgactggtgggccgctgccggcgccgccgccttaacccaggtgttgaggctttcgttggtctcctcgccgtcgacgagcacccaccaggatgaattctaaacgtaggaggagtcatagcccagttgaatacaaggaaggccgtgacaaagattatgggacttctggaaagaaggataagtcaagagatctagatgacacatgtgatgctagaagaggtcatgaaaccgataggcactctgataagcattcctttgaacctcacgtgaatccaaaaccccccacaccttccgaggtcccatgaaaagatggggaataattatggtgggacccttcaaaaaccctccggtcaaacgggaaataaggggtgagaactttctggggccccccaagacagaataaccttttggggaaactccccggttacccccgaagttttgctgttatttttggaaaaatttttttttccctcttcgggggtttcttattgggaagtgggggcccctccctgggttctataaaaagaggggggggaaaaacaaaaaaaaatttttttcataaaaaaacaacactattgttttgggggaaa

SEQ ID NO: 53438 - protein, 70 aa, Zea mays
  misc_feature: Ceres CLONE 1474192-F
MNSKRRRSHSPVEYKEGRDKDYGTSGKKDKSRDLDDTCDARRGHETDRHSDKHSFEPHVNPKPPTPSEVP

SEQ ID NO: 53439 - DNA, 650 bp, Zea mays
  misc_feature: Ceres CLONE 1474196-F
gctccccgcggtggcggccgctctagaactagtggatcccccgggctgcaggaattcgtctcacccctagaaaaaaaacttattttcctgttactttatctatggagtttcattcctagttcattgcacattggttatcgtgacaaatgggggtgtcgctagcaggtctctcttctctggataaccacaccaccaatcatgagggaatcaccttcaacacagggggggccatctacatcttctgcggttgatgatagttactcagctgacggtgttgaagattcacaactattcctctccgtgccagctttaaaccaagctgcatcttatcttgcccagacagcttcattcctcactcaatgcctccctgtacctggttttgtgggtctatctgaggagggccaagagttattaacactgccacctgcatcggcttcaggcagactttctgttcagacttcttcagtagagccttccggtaccaattcatcccttggtcagtcagattgtggtggaaacccctctcaaaaaacgctgggacgatggtgccttcccatgtttttcagaatgaagtttcattgttccaaggcacctgcctaaaaatttgataaaccctttggtggaacgcgcctcggaaaacgttccgtggg

SEQ ID NO: 53440 - DNA, 765 bp, Zea mays
  misc_feature: Ceres CLONE 1474204-F
  misc_feature: Encodes the peptide sequence at SEQ ID NO. 53441
tggagctccccgcggtggcggccgctctagaactagtggatcccccgggctgcaggaattcgtctcacccctagaaaaaggagccagcaactccactcctgagtcctcacctcgtgctgcccgcgccatttccacctcccactgtcctttcgtccagtccccagccctgcagcccaaccgtggaggttctggaaggcggtgtatcccttctagaaccttctcgagatgcagagcgccgcggctttccggccgtgccccactcggctgctggtgagcagcccttgtcgccccctcctctcggccctgccgcttcgtgtctccgccgctggcgccgtcgctaccagaagcagcgccgtgggacttcgcgatctggggctcgggctgctgccaggctccccccgatcgggaggcaaagtgcccccagcaaacaggggtcatgccatcccggcccgggaagctttgggcggcccccaaagcggaaaaaaagagagcgggttttttaaaaaaccctgggggtccggctccctttttgccccccgggaaaccgtttcaaattcccctttcaccccttttaaaaaccggggcccagggggttttccctaccccctaaaaactacaaaaaattttttttttttttggaaaaaaagaaacccccctttttagggggaacccggggttattaaaaaggaaaaaaattttcttggacaccattgggggccccccccccccccggggttttttaacaaaggggaacctcctcccccc

SEQ ID NO: 53441 - protein, 57 aa, Zea mays
  misc_feature: Ceres CLONE 1474204-F
MPSRPGKLWAAPKAEKKRAGFLKNPGGPAPFLPPGKPFQIPLSPLLKTGAQGVFPTP

SEQ ID NO: 53442 - DNA, 675 bp, Zea mays
  misc_feature: Ceres CLONE 1474209-F
  misc_feature: Encodes the peptide sequence at SEQ ID NO. 53443
agagctggagctccccgcggtggcggccgctctagaactagtggatcccccgggctgcaggaattcgtctcacccctagaaaaagaccggggaagtcacactcacacgttcgcgtgttagactctcctgaaaccagcgtgctgtgccgcccgggacgatggcgccgcgccagccgctgctccccagtttcctctacgcggcgtcgtccggcgtcaacggcagcagggaggcgcctccggtggtggcgggcgccccgagcgagccgctcggcaagatcgagatgttctcgcccgcatactacgcagcgggcgccttgggaggcgccgcggcctgcgggttcacgcacgccgccgtcacgccgctcgacgtcatcaagtgcaatatccagatcgaccccgccaagtacaagaacacctcgtcggcgttcagcgtggtgatgagggagcagggcctccggggcttctacagggggtgcgcgccgacgttcgtgggctacagcgctcagggtgcgttcaagtacggcctctacgagttcttcaagaagacgtacgctgacatggccggtcccgagcacaccgccaggtacaagaccctcatctacctggcgggctcggccaccgcggaggtattcgccgacgtcgcgctctgccccatggaggccgtcaaggtccgggt

SEQ ID NO: 53443 - protein, 172 aa, Zea mays
  misc_feature: Ceres CLONE 1474209-F
  misc_feature (47)..(135): Pfam Name: Mito_carr Pfam Description: Mitochondrial carrier protein
MAPRQPLLPSFLYAASSGVNGSREAPPVVAGAPSEPLGKIEMFSPAYYAAGALGGAAACGFTHAAVTPLDVIKCNIQIDPAKYKNTSSAFSVVMREQGLRGFYRGCAPTFVGYSAQGAFKYGLYEFFKKTYADMAGPEHTARYKTLIYLAGSATAEVFADVALCPMEAVKVR

SEQ ID NO: 53444 - DNA, 641 bp, Zea mays
  misc_feature: Ceres CLONE 1474214-F
tccccgcggtggcggccgctctagaactagtggatcccccgggctgcaggaattcgtctcacccctagaaaaagacaaccaagagagtgcctcctgtcctcctaacatcgattttcctccggaatcgtaacctcagaaagccaaatctcattctccggcgctcaggcccacccaagcgtcgactctcccgatccaatcggtacctcctagttcctcgccggcggtagcggcgtcgggcgaacagcggtgacttggcgagggcgcttggccggcgaccatcatccactaggatggaaggtgaggcagagaccgtggttgggtccttgttctaaaccatgtgggcctctgggagactactacattcccagattacattctgaaagccaggtgcccaacaagtacttgttgatcatcccccaccctgccccccctgtagtgttcatcaactcaagatcctgaagcccaattgggaagtattttaatcaaaacattttcgggggccttctcaatgaaagcacaagtaccctttttgtcttttttggaaatgctaacaccatgggaaaattgccttccggggccttaattgctttttggaacccggaaattttttggagagaacctccccccgtttctttgtcggg

SEQ ID NO: 53445 - DNA, 768 bp, Zea mays
  misc_feature: Ceres CLONE 1474222-F
  misc_feature: Encodes the peptide sequence at SEQ ID NO. 53446
aagctggagctccccgcggtggcggccgctctagaactagtggatcccccgggctgcaggaattcgtctcacccctagaaaaaaaaacgtccgcacgccgttttccccatctcgcgcagcgctactgccggctgtcccgagtcccgaccaccgtcctccgcggctccgctccccgccgtgaatccttcctcctcccgcgatggagaccttcccgttggtgaagaacatcctcctactggactccgaggggaagcgcgtcgccgtgaagtactacagcgatggctggcctactctctccgcgaagctggccttcgagaagtcggtcttcgccaaaacccagaaagcgaatgctggaacggatgcagagattgtaatgtttgatggtcaaattgtggtatacaagttcatccccccccctgcactttttttgttacctggaggaagaagaggagaatgagcttattttagcctccgttcttcagggattcccctgatgcttgccaaacgactttctcaaaaacatgggttgacaaaagggactgcccctccaaaatttgggaccggaacccaattggggcctgggaaaaaatttgtttgattggaggggtattttcccttgaaccacaaagggaaaaaggaattttcttaaaaagggtgttttggtccccgaataccgaaggggtgctttctctggggtggaacgaaactttttgcccaagggcccttacccccgagggaagagaaagctttttgggggaaaatctcttt

SEQ ID NO: 53446 - protein, 85 aa, Zea mays
  misc_feature: Ceres CLONE 1474222-F
METFPLVKNILLLDSEGKRVAVKYYSDGWPTLSAKLAFEKSVFAKTQKANAGTDAEIVMFDGQIVVYKFIPPPALFLLPGGRRGE

SEQ ID NO: 53447 - DNA, 693 bp, Zea mays
  misc_feature: Ceres CLONE 1474243-F
  misc_feature: Encodes the peptide sequence at SEQ ID NO. 53448
aaagctggagctccccgcggtggcggccgctctagaactagtggatcccccgggctgcaggaattcgtctcacccctagaaaaactggcggagggcacgtctgcctgggcgtcacgaacctcagtacatcagagcagccgaacacgcccgcggcaaccgccgccattctaccccaggtcggacggacccttgccggagacgagcacacgccacagcaggaattatcgggcgtagagcagcgcgaagcgagagatccaatggcggcggcggaggggcagtgggtgctcatggcaacggggcggacgccgaccaacattgcggtgatcaagtactgggggaagcgggacgaggcgctcatcctccccatcaacgacagcatcagcgtaacgctcgaccccgaccatctctcccccaccaccactgtcgccgacagcccctcattcccttccgaccgcatgtggctcaatggcaaggagatctcgctattaggaggaaggtttcagagctgcctcagagacatcagaaagcgtgctcgtgactttgaggacaaggagaacggcgtcaagatcaagaaagaggactgggacaagttgcatgttcacatagcctcgtacaacaacttccccactgctgctggtttggcctcttcagctgctggccttgcctgtttcgttttcacccttggaaagctga

SEQ ID NO: 53448 - protein, 145 aa, Zea mays
  misc_feature: Ceres CLONE 1474243-F
  misc_feature: SWISSPROT Homolog: EC 4.1.1.33 Diphosphomevalonate decarboxylase
MAAAEGQWVLMATGRTPTNIAVIKYWGKRDEALILPINDSISVTLDPDHLSPTTTVADSPSFPSDRMWLNGKEISLLGGRFQSCLRDIRKRARDFEDKENGVKIKKEDWDKLHVHIASYNNFPTAAGLASSAAGLACFVFTLGKL

SEQ ID NO: 53449 - DNA, 695 bp, Zea mays
  misc_feature: Ceres CLONE 1474249-F
  misc_feature (396)..(396): n is a, c, t, g, unknown, or other
  misc_feature (475)..(475): n is a, c, t, g, unknown, or other
  misc_feature (482)..(482): n is a, c, t, g, unknown, or other
  misc_feature (495)..(495): n is a, c, t, g, unknown, or other
agagctggagctccccgcggtggcggccgctctagaactagtggatcccccgggctgcaggaattcgtctcacccctagaaaaacccccgtccagattcatccacccttccccttcgtctccctccctccatccaatccaccccctctcccccttctcgtcgtcgccgccgccgccgcccatccggggcttggactgtcctttccccgttctgctggtaggtaaggaattcctcttctggctccgacggattctctcgctccgtttgtctctggtacaattcgttcgctgctgcgagccctcgaatccgtttgtatccggagcagcggcggagtagtaatactagtacaattccttagtcgtgttcccaagtgggtggatgcgtctttgactgccnggggccccgccgcaccccgcagcagcaatggacgacggggacctggatttctccacccggacacgtacctgtgtccggncctcggnacggaccgccagnagctgctcatggacagctactcgacgaaatcttcaggaacggagcacttcgcttgcacgaaccccaaacttggaacccggcgggggacaacctttggaaaacccaacctggtttcccgttcatacaaaaatgttcgggccttcccgggagaaaccaattcccctctaaaaaaaaaaaaaagggaaaccccccctaaaaag

SEQ ID NO: 53450 - DNA, 659 bp, Zea mays
  misc_feature: Ceres CLONE 1474257-F
  misc_feature: Translation starting site: 331
  misc_feature (475)..(475): n is a, c, t, g, unknown, or other
aaagctggagctccccgcggtggcggccgctctagaactagtggatcccccgggctgcaggaattcgtctcacccctagaaaaattgaggaggatagggtaatagcagtttcacttgcaagcaagatggttgaatctgctaagtttcaggctgtccaggcgcgcttttatgagggaaaagaaccgattcagttctttgtgatatttcaaagcttcccagtgtttaagttctggatacaagagatttattgctgaaaatggcatcgatgatgaaagttattctgaagatgggcttgcactctttcgtattcaagggtcaggaccagaaaacatgcaggcgattcaagttgaacctgtggcctcatcattgaattcatcatattgttacattctacataatggaaacactgtgttcacttgggctgaaaatctgaccactgcattggaccaagagttaatggaaaggcagctttgantttattaagccaaacaccagtctaggtcacaaaaaggagggtcagaaacggaccagtttttggagtttactgggagggaaatctgagtactcccggcaaaaaatggggcgaaaacctcgaagggacccccctcttttctcatgcatcctgggcaaagggaatttgaagggaaaaaaaatccccc

SEQ ID NO: 53451 - DNA, 754 bp, Zea mays
  misc_feature: Ceres CLONE 1474260-F
  misc_feature (317)..(317): n is a, c, t, g, unknown, or other
aaagctggagctccccgcggtggcggccgctctagaactagtggatcccccgggctgcaggaattcgtctcacccctagaaaaactcccggcctctcgcctctcggcctctccatcgttcgacctcgcgacgcgtcaagtaggggggcggcggccttcgcggagatgaccaccttcctgatcaccggaggcgatttcccgcgacactcctcccccctccccgtgctctgctagacagatagatccgggctcttccttgatttgttcggtgaggacatcatgtggagttttgcatcaaatgccatagctggaagcttnaagaaaaagcacaaccctcaaaatgcagcatatcccatgcagattattctgatgatgaaagttcctcatgtaacagcagaaagaaggcctttgatgccccaattgctgggaatccttccacctcggggaaaggttccctatggcttgggggggggcccccaatgggcaaaaactgcccccttggcttttcctgggaagtggggaatttcgccccctttttataaagggtgttttttttctcccccgcccccggggaacccgttttttttccccccgggttaaagggggcccctcttgttcccccaaaaaaaatttttttttttttggggggcaaaacaaaaacgggggggaaaaaaaatttccttttcaaaagaaaaaaaattttcttccgggggtatatggggggcgccccctctcctacaaaaaaaaaagagggg

SEQ ID NO: 53452 - DNA, 689 bp, Zea mays
  misc_feature: Ceres CLONE 1474275-F
  misc_feature: Encodes the peptide sequence at SEQ ID NO. 53453
aaagctggagctccccgcggtggcggccgctctagaactagtggatcccccgggctgcaggaattcgtctcacccctagaaaaaagtttgaagctagaggtgtcagaaaagttaccacagggataactggcttgtggcagccaagcgttcatagcgacgttgctttttgatccttcgatgtcggctcttcctatcattgtgaagcagaattcaccaagtgttggattgttcacccaccaatagggaacgtgagctgggtttagaccgtcgtgagacaggttagttttaccctactgatgaccgcgccgcgatagtaattcaacctagtacgagaggaaccgttgattcacacaattggtcatcgcgcttggttgaaaagccagtggcgcgaagctaccgtgtgccggattatgactgaccccctctaagtcagaatccaagctagcaaccggcgcctctgctcgccgcccgccccgacccacgttagggcgttcgcgccccaagggcccgtgccattggttcagcccgcccggccgacgcgccgcgggggggccgcctcgaagcttcctttcacaagggcggggtgctgtatcctttgcggaccacttaaaacccgaccggggattgtaaattggaaagtggccttgctgcccccacccccggaaaatccaccccccctccacggaaac

SEQ ID NO: 53453 - protein, 41 aa, Zea mays
  misc_feature: Ceres CLONE 1474275-F
KAGAPRGGGRSRTSGSPGLQEFVSPLEKSLKLEVSEKLPQG

SEQ ID NO: 53454 - DNA, 645 bp, Zea mays
  misc_feature: Ceres CLONE 1474287-F
aaagctggagctccccgcggtggcggccgctctagaactagtggatcccccgggctgcaggaattcgtctcaccccttcaaaaaacggcagctctgaagggaaagagatcgatcgtatctgcggaacaagcagcgaaagatcggagcctatccaattggccgagggcaactgcagctccggcggcaacttgttctccaccgccagctggtggaggcggccgccgggttcccgtcgaggaaaagatcgtggaaaaccccgacaccaaggagaaaacccgcgcggcacccgagctcctgcagcaaaaaccgcgtacggtaagctcgacgactatgcggccggttagtacgtctagaagacgagatgcacctgaaggagtcagaactggctcctgaaccccactagctcgaccagcctggggggccgacagttaccacctggcgcccaaggcaccgggcaacggattccccaaggagccaggggcgggcctaccccgcccccctaggaatgaccctgtctctgaaggtttcggcctcgccaatttcttattggaacaaaccacttggggcccgttaacccccacccctttgggaaggaagcccccgggggcgcctgttttttttaaaaagggccaaagaacccccccc

SEQ ID NO: 53455 - DNA, 669 bp, Zea mays
  misc_feature: Ceres CLONE 1474288-F
  misc_feature: Encodes the peptide sequence at SEQ ID NO. 53456
  misc_feature (456)..(456): n is a, c, t, g, unknown, or other
  misc_feature (457)..(457): n is a, c, t, g, unknown, or other
aaagctggagctccccgcggtggcggccgctctagaactagtggatcccccgggctgcaggaattcgtctcacccctagaaaaaaccccgagccgccaaaaccctaccgccgccgcgaatcccgcacgaccccaaccatgaccgtgctgagccgccctaccccgggcacggcccagtgcttcgggcggaagaagaccgccgtcgcggtcgcgtacacgaagccggggcgcggcctgatcaaggtgaacggcgtcccgattgagctgatccgaccggagatgctccgcctcaaggccttcgagcccatcctgctggcggggcggtcccggttcaaggacatcgacatgcggatccgcgtccgcggcggcgggaagacgtcgcagatctacgccatccgccaggccgtcgccaaggggctcgtcgcctactaccagaagtacgtcgacgaagccgccnnagaagagatcaaggacatctttacccgctacgatcgcaccctcctcgtcgctgacccccggcgctgcgagccgaagaagttcggcggacgtggtgccccgcgcagttccagaagtcgtaccgttgaggcgctgcctgctccatctcgatttttcagatcggttgtgggtggtcctccgctttatttccctatcatggatctgcttatctggt

SEQ ID NO: 53456 - protein, 177 aa, Zea mays
  misc_feature: Ceres CLONE 1474288-F
  misc_feature (16)..(144): Pfam Name: Ribosomal_S9 Pfam Description: Ribosomal protein S9/S16
  misc_feature (107)..(107): Xaa is any aa, unknown, or other
MTVLSRPTPGTAQCFGRKKTAVAVAYTKPGRGLIKVNGVPIELIRPEMLRLKAFEPILLAGRSRFKDIDMRIRVRGGGKTSQIYAIRQAVAKGLVAYYQKYVDEAAXEEIKDIFTRYDRTLLVADPRRCEPKKFGGRGAPRSSRSRTVEALPAPSRFFRSVVGGPPLYFPIMDLLIW

SEQ ID NO: 53457 - DNA, 665 bp, Zea mays
  misc_feature: Ceres CLONE 1474299-F
  misc_feature: Encodes the peptide sequence at SEQ ID NO. 53458
aaagctggagctccccgcggtggcggccgctctagaactagtggatcccccgggctgcaggaattcgtctcacccctagaaaaagaagcttatcgcttatcatccgcgcctctacatttcttctctctctgctcctccgcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaaagtattgttccttcatcacaccactgcgacattccgcatgtgaaccgtactgagtatcagctgattgatatttctgaggatggatttgtgagccttcctacttcagatggcaacactaaggatgatcttacactcccaacggaagagactccttgtggcccaaattaaggaagggttcgaaaggcgggaaaggatcttgtttgcgcctggcccagtccggcgatggggggaagaagcatatcttgcgccgctgaaaggaagttggccc

SEQ ID NO: 53458 - protein, 128 aa, Zea mays
  misc_feature: Ceres CLONE 1474299-F
  misc_feature (86)..(127): Pfam Name: eIF-5a Pfam Description: Eukaryotic initiation factor 5A hypusine, DNA-binding OB fold
  misc_feature (30)..(64): Pfam Name: KOW Pfam Description: KOW motif
MSDSEEHHFESKADAGASKTYPQQAGTVRKNGFIVIKNRPCKVVEVSTSKTGKHGHAKCHFVAIDIFNGKKLESIVPSSHHCDIPHVNRTEYQLIDISEDGFVSLPTSDGNTKDDLTLPTEETPCGPN

SEQ ID NO: 53459 - DNA, 644 bp, Zea mays
  misc_feature: Ceres CLONE 1474310-F
  misc_feature: Translation starting site: 328
ggagctccccgcggtggcggccgctctagaatagtggatcccccgggctgcaggaattcgtctcacccctagaaaaaatcctccgcccatacacacacagccccatcccgccgccgcaggcgagaaccagcgccaccttaggttagggcggccgccgccggagaagtgcgcggttgccaagatgcagatcttcttgaagaccctgacggggaagaccatctcgctggaggtggagtcctcggacaccatcgacaacgtgaaggccaagatccaggacaaggagggcatcccagcctgaccaacagcgcctcatcttcgccggcaagcatgctcgaggatggccgcaccctcgccgactacaacttccaaaaggagtcgacgctgcacctggtgctcagcctcaggggaggcacctacaagcgcacgaagaacacttacaccaagcccaagaagatcaagcacaagcacaacaaggtgaagctcgccgtgctccacttctacaaggttgacgacaccaccggcaaggtcaccctcctccgcaaggagtgccccaacacccagtgcggcgcgcgggtcttcatggccaaccacttcgaccgccactactgcggtaagtgtgggctcacctacgtctaccaccagga

SEQ ID NO: 53460 - DNA, 674 bp, Zea mays
  misc_feature: Ceres CLONE 1474315-F
  misc_feature: Encodes the peptide sequence at SEQ ID NO. 53461
  misc_feature (539)..(539): n is a, c, t, g, unknown, or other
  misc_feature (572)..(572): n is a, c, t, g, unknown, or other
aagctggagctccccgcggtggcggccgctctagaactagtggatcccccgggctgcaggaattcgtctcacccctagaaaaaaaatgatgatggaggaaggcgcaggcatggtagcccctcaaggcgtgcaaggagcccagtcagggaaagcagcgaggagcgaagggccaagattgagcagtggaaccgtgaacgggagggaaaacagtgagctctccgtggctactgttcgccggacttgttgcttagctccggctctcatcgctatattctaagtatgcttgtgtggatggcattctgcctggctaagtaaaaccttttaagatcaggaattcaggattcctcggttcattttatggttaaaccagacatcatttgtttccatctgtgttgtgtcggatcctttgctattatgttattttgacaattggtgtcaaatcttttgtggtgtgctattagcttatgatgatgtcagttgtggtttgtcactagatttgccatctggctttcagtcgtgtgttatgctgttccatggcngatttcttgttttccctcttctcatttttgctncatgcctcctagacagtgcttgggctgccgtcattgtactatgtgcagtagcacggagcaggttccattcaaaaaaaaaaaaaaaagagacgctcgaggtac

SEQ ID NO: 53461 - protein, 63 aa, Zea mays
  misc_feature: Ceres CLONE 1474315-F
MMMEEGAGMVAPQGVQGAQSGKAARSEGPRLSSGTVNGRENSELSVATVRRTCCLAPALIAIF

SEQ ID NO: 53462 - DNA, 690 bp, Zea mays
  misc_feature: Ceres CLONE 1474322-F
  misc_feature: Translation starting site: 378
  misc_feature: SWISSPROT Homolog: EC 3.1.4.4 Phospholipase D
  misc_feature (558)..(558): n is a, c, t, g, unknown, or other
aaagctggagctccccgcggtggcggccgctctagaactagtggatcccccgggctgcaggaattcgtctcacccctagaaaaaatacccgactccgatcttccaccccgctgccgcctgccggcgtgcgtgacccgggtcccattccatatccggtgccattttttaatactactagtctcgttcgatcggatcggcttcccgtcttggctgcatttttctatccccgcgtggccgcgtgtagtcctagtctctcgccagcaccatcatcatcaatcacggcggcgaccccgccccgcctcgatcgcccacgctgcccgactggaaccggacgctgctgctgctgctgctaggctgacagcgacgacgagggggccatggctcagatcttgctccacggcacgctccacgccaccatcttcgaggccgagtcgctctccaacccgcaccgcgccaccggcggcgcccccaagttcatccgcaagcttgtggaaaggattgaggataccgtgggtatcggcaagggcaccaccaagatatacgccaccgttgatctgnagaaggccggcgtggggcgcacccggatggtctccaacgagtctgtgaaccctcgctgggacgagtcttccacatctactgcgcgcacatgcccgccgacgtagtattcaccgtcaagatcgacaactccac

SEQ ID NO: 53463 - DNA, 652 bp, Zea mays
  misc_feature: Ceres CLONE 1474323-F
  misc_feature: Encodes the peptide sequence at SEQ ID NO. 53464
ggagctccccgcggtggcggccgctctagaactagtggatcccccgggctgcaggaattcgtctcacccctagaaaaaaaccggagccatggcaaagaccgccgcaatgccggcagcggtggcggtgatcgctctcctgcttattacgactctacccgtcgggcgcggcgaggagaggaggcccaccgcggcgcacccgcacgggctccccttcgagagcccgctcgcgctgtctccggccgcttacgacttcttccaccccagcgcgcgcgcccatcgagatcgcggcgtcgccccggagccggcgccggcgctcgcgcctcgcgggcagcagcagcagctgagagagtccgcggtccgaggaggaacatcgtctgcaagcgtggccaaggccgaccgggagaaaggccgcgtgcgccctgtgtgtcgcgtcgttagccctaattgaaacgaggccacaccttgtggcctacgttcgcctagtgtgcaggtggttgcggaaaaaaaaaaagtatgatcccgcttcctgtactttaataccaagggtcccctggaaataatggtgacgtctcccggggaaaaaaaaaaaaatacctggcaaagcctccaaaccctttccccgaaaaaaccaaaaggaagaagggaacggtgg

SEQ ID NO: 53464 - protein, 119 aa, Zea mays
  misc_feature: Ceres CLONE 1474323-F
MAKTAAMPAAVAVIALLLITTLPVGRGEERRPTAAHPHGLPFESPLALSPAAYDFFHPSARAHRDRGVAPEPAPALAPRGQQQQLRESAVRGGTSSASVAKADREKGRVRPVCRVVSPN

SEQ ID NO: 53465 - DNA, 717 bp, Zea mays
  misc_feature: Ceres CLONE 1474346-F
  misc_feature: Encodes the peptide sequence at SEQ ID NO. 53466
aaagctggagctccccgcggtggcggccgctctagaactagtggatcccccgggctgcaggaattcgtctcacccctagaaaaactccctccctcctccattggactgcttgctccctgttgaccattgggtattctgaaccatcgagccatggctgccaagctgactcgcctccacagtcttcgcgaacgccttggtgccaccttctcctcccatcccaatgaactgatagcactcttttccaggtatgttcaccagggcaagggaatgcttcagcgccatcagctgcttgcggagtttgatgccctgtttgatagtgacaaggagaagtatgcaccctttgaagacattcttcgtgctgctcaggaagcaattgtgctccccccatgggttgcacttgctatcaggccaagccctggtgtctgggattacattcgggtgaatgtaagtgagctggctgtggaggagctgagtgtttctgaatacttggcattcaagaacacctggtggatggaccatccaacagcaacctttgtgcttgaccttgaatttaaaccctttcaaggccccctttcctcggcctttccatggccaaagcccatcgggaaatgggagtgcaattccttaaacccaaccccctgtcgtccaagtgtgtttcccggaaaaaggaagaaattgttcccccctttggtaaacctccccccagggctctaaaaa

SEQ ID NO: 53466 - protein, 187 aa, Zea mays
  misc_feature: Ceres CLONE 1474346-F
  misc_feature: SWISSPROT Homolog: EC 2.4.1.13 Sucrose synthase
MAAKLTRLHSLRERLGATFSSHPNELIALFSRYVHQGKGMLQRHQLLAEFDALFDSDKEKYAPFEDILRAAQEAIVLPPWVALAIRPSPGVWDYIRVNVSELAVEELSVSEYLAFKNTWWMDHPTATFVLDLEFKPFQGPLSSAFPWPKPIGKWECNSLNPTPCRPSVFPGKRKKLFPPLVNLPPGL

SEQ ID NO: 53467 - DNA, 645 bp, Zea mays
  misc_feature: Ceres CLONE 1474353-F
  misc_feature: Encodes the peptide sequence at SEQ ID NO. 53468
aaagctggagctccccgcggtggcggccgctctagaactagtggatcccccgggctgcaggaattcgtctcacccctagaaaaaacttccacgccctcgcaaaattcatggaggccattgtcgtcgccgcccttccgcctcatcctttccacgcccgctactcttgccccctcccacgacctctactctgccatggcacctcttcatgaagtattcctcctccatgacgcccttgccctcctgtggtcgacgcctccacctcaagcacactcgcctcatgcccacggcctaatctgctcaactgagaaagagcgaggtggcggaggtatcgtctcgcttgcccgcaaccccttcgcttctttccatccggtttctcggcgctggagaagaggaaggggatggcgcaccggcttctgtgggacgtgcatgcaaatgggtgggagcgatcaaatttcaccatcgtctgcgagtcatgcctcgacgacaaaccctacgtccggatgtaacacatcaaaccctagcccttcctgaatgatttgtgtgattctctttggcgttgttatgcgattgaaggcgtgcctgatctcttgatttggatttttgtatagatgtgctattgaacttgggattaaatcgttgagaaaa

SEQ ID NO: 53468 - protein, 35 aa, Zea mays
  misc_feature: Ceres CLONE 1474353-F
MAHRLLWDVHANGWERSNFTIVCESCLDDKPYVRM

SEQ ID NO: 53469 - DNA, 678 bp, Zea mays
  misc_feature: Ceres CLONE 1474356-F
  misc_feature: SWISSPROT Homolog: EC 3.1.2.15 Ubiquitin thiolesterase
  misc_feature (414)..(414): n is a, c, t, g, unknown, or other
aaagctggagctccccgcggtggcggccgctctagaactagtggatcccccgggctgcaggaattcgtctcacccctagaaaaatggagaactgttgaggagcttatggaccactgacggaaaaccagttccacctcattatttcaaggaaaaaattgcatgttttgctcctcagtttggtggctttaatcagcatgattcacaggaacttcttgcttttttactggatggtctccatgaagatcttaaccaggttaaatgtaaaccgtatgaagaagcaaaggatgcaagtggccgtcctgacgaagaagtagcagatgagtactggagcaaccatttagctcgaaatgactctgttatagttgatacatgccatggacagtacaaatctacattaacttgtcctacttgcantaaaacatctgtcacctttgacccatttatgtacttatctttgcctgtaccttccacggcaaagagggtaatgactgtaacagttttcagcactgatggtagcagagaaccatgctcgtatgacgtcagtgtgccaaaatttgggactctgagtgatcttgttcaggctttaagcattgtttgcctacttggagatgatgagatcctgctggttacagaggtctataataactgcatcatccgatacttggaggagccttcagg

SEQ ID NO: 53470 - DNA, 687 bp, Zea mays
  misc_feature: Ceres CLONE 1474357-F
  misc_feature: Encodes the peptide sequence at SEQ ID NO. 53471
  misc_feature (411)..(411): n is a, c, t, g, unknown, or other
  misc_feature (687)..(687): n is a, c, t, g, unknown, or other
tggagctccccgcggtggcggccgctctagaactagtggatcccccgggctgcaggaattcgtctcacccctagaaaaatcttctccaatctccaccctctgcccctctcgatttcttcttcccatctcccgatccatcgcaacccaaaccctactccaggcagatctccgtctccgccgacgctgccggcgtgagcacagcatcagatccgctgtgatggcgttccgccgcatcctatccaccgcggtgcgccgccgctcggccgtggccgccgcggcggccgggaacgcgcgcgaggcctccacggccgtcgctgcggcgccaggtgtgctcgcccccgatgcgaccgcggtgcgcgctcccgtgatgccgtatgaccgcatcgccgaggccgtcaacgccaccccccngcggctcgagcacccagacccgcgcttcctccgctacgccagccccgtgccgtcccacgcggaccacatggccatccttgcggcgccagagacccgggtcaccacactgcccaacggcctgcgcatcgccccggagtcttccctcgccgcgccgccggctacggtcgcggtgtggatcgatgcgggcagcaggtaccaaaacgagaaggcggtcggcgtcccgcattttgtccaccacatgcctgttcaagggcaccggggaagcgcaccgccgcn

SEQ ID NO: 53471 - protein, 156 aa, Zea mays
  misc_feature: Ceres CLONE 1474357-F
  misc_feature: SWISSPROT Homolog: EC 3.4.24.64 Mitochondrial processing peptidase
  misc_feature (65)..(65): Xaa is any aa, unknown, or other
MAFRRILSTAVRRRSAVAAAAAGNAREASTAVAAAPGVLAPDATAVRAPVMPYDRIAEAVNATPXRLEHPDPRFLRYASPVPSHADHMAILAAPETRVTTLPNGLRIAPESSLAAPPATVAVWIDAGSRYQNEKAVGVPHFVHHMPVQGHRGSAPP

SEQ ID NO: 53472 - DNA, 885 bp, Zea mays
  misc_feature: Ceres CLONE 1474367-F
  misc_feature: Encodes the peptide sequence at SEQ ID NO. 53473
ttctgtcccccccgtccttcccgttcccccccccccaatcagccccctcataaattgcgactccctcggtggcggccgctctagactagtggatcccccgggctgcaggaattcgtctcacccctagaaaaattcgtgggcaacgcgctgggtggcctccgcgggtggagtaacctcgcctcctggactgtcgccggaaccctcgcctactacctctgaggtgagcccgtgcgcccgctccagaaggatcaggaggagcgaggcgctttggttgctgcaagggatccttatctgtgacgcgagaagcggaaacccattcctgatccacgtggccctgggccttttcctagggaaagaagaggggagcctcctcaacccccaaattaccttagccccccggggcccttctttgttttaaaatgtttcctccccctctattccccagtaatttacagggaagggttttttaaccccccccctcccccatatccgtggtaagaggtccctctttttccccataacaacgccccccctcttttttttgcgcgatttataaacaaacatccttaatcgggtgtgtttttagaggccgccgtggcgcccttctgtgctcctgttttaatacccccctgagacgggttgtgcgcggtgttccttctttatcccccccccttatgtagcagggtgagatcggttgtttttccgcgtctgttgtggcgcacgcggctggttaagtcggagccatcttttttctgcttttttctgttccccccgtttattcgttcgccgcccgccctttctttcatttttctacctgtgaatagcgcgctcttccccgcccgggtacacgttttttactgcctacttcgtcgcggatgttcctgt

SEQ ID NO: 53473 - protein, 41 aa, Zea mays
  misc_feature: Ceres CLONE 1474367-F
SVPPVLPVPPPPISPLINCDSLGGGRSRLVDPPGCRNSSHP

SEQ ID NO: 53474 - DNA, 680 bp, Zea mays
  misc_feature: Ceres CLONE 1474371-F
  misc_feature: Encodes the peptide sequence at SEQ ID NO. 53475
aaagctggagctccccgcggtggcggccgctctagaactagtggatcccccgggctgcaggaattcgtctcacccctagaaaaacccgccacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaggaatgttgttttggagagcaagtatgcccctcctaaaattgttaacgatggtgttacagttgccagagaggttgagctggaggaccctgtggagaacattggtgctaaattggtcaggcaagcagcagctaagaccaatgatctagctggagatgggacaaccacctctgtggtccttgctcaggggctgatcgctgagggtgttaaggttgtggcagctggtgctaatcctgttcagattactcgtggtatcgagaaacagcgaaagcactatttgaagactac

SEQ ID NO: 53475 - protein, 164 aa, Zea mays
  misc_feature: Ceres CLONE 1474371-F
MASTFGATSTVGLMAAPTGKNVRLQRRVNFRVRAAKELYFNKDGSAIKKLQTGVNKLADLVGVTLGPKGRNVVLESKYAPPKIVNDGVTVAREVELEDPVENIGAKLVRQAAAKTNDLAGDGTTTSVVLAQGLIAEGVKVVAAGANPVQITRGIEKQRKHYLKT

SEQ ID NO: 53476 - DNA, 706 bp, Zea mays
  misc_feature: Ceres CLONE 1474375-F
  misc_feature: Encodes the peptide sequence at SEQ ID NO. 53477
aagctggagctccccgcggtggcggccgctctagaactagtggatcccccgggctgcaggaattcgtctcacccctagaaaaaattcgttgatcccatcggcttccccttcctcttccccgatccccttcctcccccgatcccatccaattccacttccacaccccgggcctcgccgccgacgccgacgccgacgccgccggccatgtccaagtacggcaccattcccacctcctcctccgcgggcggagggcccgtgcccctcggcggcgcctccccgctcgatttcatctcccgcgccaaggctcggggcgcctcggcgctggcgacgcgccggccctggcgcgagctcgtggacgtccacgccgtcggcctgcccccgagccctcgcgacgcgtacctccgcgtgcgcgccaacctcgcccacttcgccatgaactacgccatcgtcgtcctcgtcgtcgtcttcctctccctcctctggcaccccgtctccctcatcgccttcctcgtctgcatggctcgctggctcgtcctctacttcctcgggacgagcccctcgtctcctcgggccggtcgtccccgacggtacgtcctttgcggggttcgccgtcgtcacgcttggcctggtggttcccaccgaaggccctgtgcaaaatctttcccctgtgggtaaagggcctggcccttgctcttgtcaagccggg

SEQ ID NO: 53477 - protein, 156 aa, Zea mays
  misc_feature: Ceres CLONE 1474375-F
  misc_feature (35)..(143): Pfam Name: PRA1 Pfam Description: PRA1 family protein
MSKYGTIPTSSSAGGGPVPLGGASPLDFISRAKARGASALATRRPWRELVDVHAVGLPPSPRDAYLRVRANLAHFAMNYAIVVLVVVFLSLLWHPVSLIAFLVCMARWLVLYFLGTSPSSPRAGRPRRYVLCGVRRRHAWPGGSHRRPCAKSFPCG

SEQ ID NO: 53478 - DNA, 697 bp, Zea mays
  misc_feature: Ceres CLONE 1474377-F
  misc_feature: Encodes the peptide sequence at SEQ ID NO. 53479
aaagctggagctccccgcggtggcggccgctctagaactagtggatcccccgggctgcaggaattcgtctcacccctagaaaaaatacgaacctcgatttcttccgtccggcgtttttttttctctcagtttctgaggtatttctccccctttctttcttccctccctcccagtagattcttcactgctcggggatttggaacaaaggccgtggttcgaagctggtgtgttcgttcaattgtgcggaaagaaaggccagtgttatgtgtgaagctgaagcagtgaaggctagcaggtaggctggctctcgccgagcgatggatctcgagttcggaaggggcctgaggtccccaaagagagactcgtggaagaccaccttgctgctggcgtaccagagcctgggggtggtctacggcgacctcagcatctctccgctgtacgtgtacaagagcaccttcgccgaggacatccagcactcggagacgaacgaggagatcttcggcgtgctctccttcgtcttctggacgctcaccctcatccctctcgtcaagtacgtctccgttgtcctgcgagctgacgacaatggcgagggaggaacgtttgccctctactctctgatttgcaggcacgccaatgtgagcctcctcccgaacctgcagatcgccgatgaggagctttccatctactagctggaatg

SEQ ID NO: 53479 - protein, 123 aa, Zea mays
  misc_feature: Ceres CLONE 1474377-F
MDLEFGRGLRSPKRDSWKTTLLLAYQSLGVVYGDLSISPLYVYKSTFAEDIQHSETNEEIFGVLSFVFWTLTLIPLVKYVSVVLRADDNGEGGTFALYSLICRHANVSLLPNLQIADEELSIY

SEQ ID NO: 53480 - DNA, 743 bp, Zea mays
  misc_feature: Ceres CLONE 1474388-F
  misc_feature: Translation starting site: 194
  misc_feature: SWISSPROT Homolog: EC 1.3.5.1 Succinate dehydrogenase (ubiquinone)
agagctggagctccccgcggtggcggccgctctagaactagtggatcccccgggctgcaggaattcgtctcacccctagaaaaactaaaaaaaagttgtttcgtctccaccggcgatctcctttccagtctccaccaccgctcgtctccccgtaccgcccgcaacccccctcccctgcgagatccggggcgcgatgtggcgcatctgcgtctcgcggggactctccagggccaatgtctccgcctccaggctcctctccacggcgtcgacatcctacacggtggtcgaccacacctacaacgctagtggtggtggagaccggcagcacgagactccgggaggaaatcggcctctccgagcacggcttcaaaacctcaagcatcaacaaactcttccccacgagctcgaacaccaccccccctccaggaaggcataaatgctcccctttgtaaaccttagttgaagatccactggaggtgggcttttgtattgaaccgggaaatggcaagcgatttgccttggaggaccaaaaattctttttcccttttaggtgccaaaaagggccccaaaagcttttaattaaactttaaaaaacttcggggctaccattttttataaaacttgggaaagggaaaaaaataccccacgcgtcccttttgggggggcaaaaatttaaacatttttgtggaaagggggcacaaaactcccccctgtgtcccttgggcctcagtgaaaaaaaaaag

SEQ ID NO: 53481 - DNA, 707 bp, Zea mays
  misc_feature: Ceres CLONE 1474392-F
  misc_feature: Encodes the peptide sequence at SEQ ID NO. 53482
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
ggagctccccgcggtggcggccgctctagaactagtggatcccccgggctgcaggaattcgtctcacccctagaaaaaaaaacgctctccgccgccacttctcctccggcatcgacgaggcgaagccccagcgcccgagtccctctccctgctcccacgacccatggcggcggatatggcgtacgcgccgccgatgaaggcgggcaaggccgggttcgaggctggcatgatggatccgcagcacaggatccgcatcacgctctcctccaagagcgtcaagaacctcgagaaagtctgcggggatctggtgaagggcgccaagggtaaggagctcaaggtcaagggccccgtgcggatgcctaccaaggtgctccacatcaccaccaggaagtctccctgtggagaaggtaccaacacctgggatcgctttgagatgaggattcacaagaaggtgatcgatctcgtcagtacaccagacgtgtcagcaatcactcatcacattgaccagtgcgagtgagtgactatcatgactatatgactcttccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 53482 - protein, 117 aa, Zea mays
  misc_feature: Ceres CLONE 1474392-F
  misc_feature (28)..(113): Pfam Name: Ribosomal_S10 Pfam Description: Ribosomal protein S10p/S20e
MAADMAYAPPMKAGKAGFEAGMMDPQHRIRITLSSKSVKNLEKVCGDLVKGAKGKELKVKGPVRMPTKVLHITTRKSPCGEGTNTWDRFEMRIHKKVIDLVSTPDVSAITHHIDQCE

SEQ ID NO: 53483 - DNA, 728 bp, Zea mays
  misc_feature: Ceres CLONE 1474394-F
  misc_feature: SWISSPROT Homolog: EC 2.7.11.24 Mitogen-activated protein kinase
agagctggagctccccgcggtggcggccgctctagaactagtggatcccccgggctgcaggaattcgtctcacccctagaaaaagtgggcggcctcgagctctgcttaaatcacagctgtgttcgtttgtggggtgatccgcccccctgtcggattctttcacctccgagctctgggacaggggagatctgtggtgtcgcagcctcgcctttcttgtacgcgcgcgtgtgggcactcagcagtgagctcccgtcttccccagcctcattttcccccctttcttgctggatctggctcgcaagatccgacctttcgtgcctaccttggctaaagtttctcgcttggttggctcgcgttgactgctgagaggatgcagcacgaccagaagagaaaggcaccttccgaaatggactttcttacagagtatgccgaggggagcaggtacaagatagaaaaagtcttaggggaagggcagttccggggtggtttgctctgccttggaccctctaactgtggaaaagttcgcccttaaaaaaaaaaaatgaatttttttaaccttgttttttaatcccccagggtatctttgggaaaccaagttgtttaaaacccctgcggcccccggaatttttgggaaataaagaatatttctttttccccctcctgggggggggaattccggggatttttctcccgggtgttaaaaactttggggggctggtttttccccc

SEQ ID NO: 53484 - DNA, 745 bp, Zea mays
  misc_feature: Ceres CLONE 1474397-F
  misc_feature: Encodes the peptide sequence at SEQ ID NO. 53485
caccgcggtggcggccgctctagaactagtggatcccccgggctgcaggaattcgtctcacccctagaaaaaacacaaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgagggtgttgttcttgctaaccccaaggagctttcccgcgggccgaggagcagggtgccccccccagccggaaggcggcggcttcccggcctggtgcccaaggaagccccgtcggcggcccgaaaccgggcccccctagagcggaaggctggccggctccctggttgggccccgaaagaaaaaccctctggcggtcaaaacaagaaaggccatccctcccaaagaaggaaggccggttgccttgccccctcccggtagggaggcgcaaagaaaccccgccgccgggaccaaaacccctgtcctccaaaggaagaaagggttcctttgcccaccaaaagaaattccccccccgaaacaaaagccgagaagggcccactgggtctcggtgtcccggggaggccg

SEQ ID NO: 53485 - protein, 126 aa, Zea mays
  misc_feature: Ceres CLONE 1474397-F
MATAEVQTPTVVAAEEAPVVETPPPAVVPEESAPAEAEAEAEGVVLANPKELSRGPRSRVPPPAGRRRLPGLVPKEAPSAARNRAPLERKAGRLPGWAPKEKPSGGQNKKGHPSQRRKAGCLAPSR

SEQ ID NO: 53486 - DNA, 683 bp, Zea mays
  misc_feature: Ceres CLONE 1474408-F
  misc_feature: Encodes the peptide sequence at SEQ ID NO. 53487
ggagctccccgcggtggcggccgctctagaactagtggatcccccgggctgcaggaattcgtctcacccctagaaaaactctccaagcagacagacgggaagggagggcaaccgagagcgatcggcgatgggctccttcctctcgagcttagtcacgccccctccggccgccgacgaccccaactgcgccgtggtggccgcccactccaaggccacctacgacgagcagtgggcggcccacaagagcagcagcaagctgatggtgatcgacttctcggcctcgtggtgcgggccctgccgcttcatcgagccggccttcaaggagctggcctcccgcttctccgacgccatcttcgtcaaggtcgacgtcgacgagctcgcggaggtcgcaaggacatgaaaggcacacgcgatgccaacgttcgtacttgtaaaggacggagaggaggtaagccgtgtggttggggccaagagggacgagcttgagaggaagatcccggatgttcacgtcatcttccatcatcagaaactccttgtggttccccctggggacggagttggcttgaaagggaaatgggtcccccttctctgaatggctgaaaaaaataaaaaaaaaaaaacgaagacgcctcgaggggtacccaatattccccccctaaagggggaggccctaattacgccca

SEQ ID NO: 53487 - protein, 90 aa, Zea mays
  misc_feature: Ceres CLONE 1474408-F
  misc_feature (22)..(91): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MGSFLSSLVTPPPAADDPNCAVVAAHSKATYDEQWAAHKSSSKLMVIDFSASWCGPCRFIEPAFKELASRFSDAIFVKVDVDELAEVART

SEQ ID NO: 53488 - DNA, 692 bp, Zea mays
  misc_feature: Ceres CLONE 1474413-F
  misc_feature: Encodes the peptide sequence at SEQ ID NO. 53489
gcggtggcggccgctctagaactagtggatcccccgggctgcaggaattcgtctcacccctagaaaaatcacacagcgccaccgcgtggttcgttaggaaaggaaatcgattcccccgcatccgatctcttcggtgctagagaaatataggccgccgcctcctcctcattcggtgaaaggagggcggttagggttgggagatctcttgactcacgacacgagcagcagaattcgtcgagggccgctggttgctgcaagaggtccgggccttcgtgggatcttgaaaattgaatgttctaatggagtccacggttgtcaagaagaagtctagcagtagtcgttcctccctgatgttagaagctccccttggctacagcatcgaggatatacgccctgcacccccccgggacaagttctcatctgcttactcgaactgcgcgaggacagcatcctgatttctctgttcgtcctccccatcctagtagccccagaaaccaccctggctttttcctttttgaatttccctaatccctccgggttagcctgcctttcccatgggccctgaacatttttcgaggaacctttttcccggttttcccacccagggggtggttctgtatatttgggcttctgaaacgcgaaggggcgtgcacttgccagattgcgcttgatttctcgtcccctccccccct

SEQ ID NO: 53489 - protein, 45 aa, Zea mays
  misc_feature: Ceres CLONE 1474413-F
GGGRSRTSGSPGLQEFVSPLEKSHSATAWFVRKGNRFPRIRSLRC

SEQ ID NO: 53490 - DNA, 652 bp, Zea mays
  misc_feature: Ceres CLONE 1474418-F
  misc_feature: Encodes the peptide sequence at SEQ ID NO. 53491
  misc_feature (463)..(463): n is a, c, t, g, unknown, or other
aaactggagctccccgcggtggcggccgctctagaactagtggatcccccgggctgcaggaattcgtctcacccctagaaaaattttgaagaaacagatcagcaaatggcacccttccatatttcagcagtttgagatggtcttccctgatggcctcttcccagctggtgggaagtcagagatagagggcatatttccaccaccatatttcgagtggttccagttcaataaggaattcactgaatacacaaatctggacgagtgcatttcatatctatgtgattacatggtgaaaaatgggccttttgatggcctgctcggattctcccagggcgcaacactttcagcccttttgataggctaccaagcacagacgacgtgtctgtgaaacagctttctgaatggagctcacgcgtcctggaagacctcaagagtgcagatgttcctgaggccttagattcangcaaaccatctgataaggaggctgctggtgcggaatcacagaaaacctggtgaaagcttgaggcatgctcactagtcacttcagccttgttcgattattcctatctcacatggattgacatcgaaacgaacaatcccttccatggcatggctgcatctgggacttgtaccgtttttactatgatctgag

SEQ ID NO: 53491 - protein, 83 aa, Zea mays
  misc_feature: Ceres CLONE 1474418-F
  misc_feature: SWISSPROT Homolog: EC 1.5.1.3 Dihydrofolate reductase
MVFPDGLFPAGGKSEIEGIFPPPYFEWFQFNKEFTEYTNLDECISYLCDYMVKNGPFDGLLGFSQGATLSALLIGYQAQTTCL

SEQ ID NO: 53492 - DNA, 705 bp, Zea mays
  misc_feature: Ceres CLONE 1474419-F
  misc_feature: Encodes the peptide sequence at SEQ ID NO. 53493
aagctggagctccccgcggtggcggccgctctagaactagtggatcccccgggctgcaggaattcgtctcacccctagaaaaaaaaaaaaacaaagccagagcggcagatacaataagccgcagctgcagcaagcggcaagccgcatcacagcaggggccaccgtcacgccaccgcgcagccgagaggggacggacgaaagggggaaatcgcctgcctgcctgccgcggtgggttggtgggtgccgcctccgcatcctgctgctctgttccccagcccacccccatttacctcgcatggaatcctgctctcttcttctccactccacgcgccgatccgccacctgccaggagagcgcggcgcgatccagttgaggaggtacacacaggaggcgggggtgcctgcacgggcacggcacccccccagttctccttgtttccgccccaagcctggcctgacgtcatcgcgcgcctgcacggcgtcttggtggtgtggtcgaagcagcataggccgccgccgcgcgggagaagccggcgcgaggaagcggtggccggggtgggggagcacgatgctgtggggtgcgcgcctgtcctgctccatatcccgcgccatggtgatggtggtgctgtcgccgtcgctccagtccttcccgcccgccgaggacattcgctcgtcgcatttcgacggcagcgtccgcttcccgggc

SEQ ID NO: 53493 - protein, 46 aa, Zea mays
  misc_feature: Ceres CLONE 1474419-F
MLWGARLSCSISRAMVMVVLSPSLQSFPPAEDIRSSHFDGSVRFPG

SEQ ID NO: 53494 - DNA, 722 bp, Zea mays
  misc_feature: Ceres CLONE 1474426-F
  misc_feature: Encodes the peptide sequence at SEQ ID NO. 53495
  misc_feature (368)..(368): n is a, c, t, g, unknown, or other
  misc_feature (380)..(380): n is a, c, t, g, unknown, or other
aagctggagctccccgcggtggcggccgctctagaactagtggatcccccgggctgcaggaattcgtctcacccctagaaaaacctctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcngtccagaaacangtcgcccatgacccccatcacaccgtctttgatgcaagcgtctcatttggcaggaggttaatgatgcctcttgtccagagtgatataaacttggggccctcaaggtcattctggggcccgggaaaaaccattaaagttgttcaccccaggggggaggagaaaaaattttgccctcaaaaaaattccccccctggtcccacaaaaaaggtggaaaaccctaaattttcctgggcgccaccacaaaaaagggtttttaaagggccccgcctttttaaaaatcttaaaaaaggggccccaaaaaaactcggggggaattttggccccacaggggcgggcacaaaa

SEQ ID NO: 53495 - protein, 175 aa, Zea mays
  misc_feature: Ceres CLONE 1474426-F
  misc_feature (61)..(61): Xaa is any aa, unknown, or other
MAGKGDGPAIGIDLGTTYSCVGVWQHDRVEIIANDQGNRTTPSYVAFTDSERLIGDAVQKXVAHDPHHTVFDASVSFGRRLMMPLVQSDINLGPSRSFWGPGKTIKVVHPRGEEKKFCPQKNSPPGPTKKVENPKFSWAPPQKRVFKGPRLFKNLKKGAPKKLGGNFGPTGAGTK

SEQ ID NO: 53496 - DNA, 690 bp, Zea mays
  misc_feature: Ceres CLONE 1474429-F
  misc_feature: Encodes the peptide sequence at SEQ ID NO. 53497
aaagctggagctccccgcggtggcggccgctctagaactagtggatcccccgggctgcaggaattcgtctcacccctagaaaaatcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcgacgaggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccacacatccccgtcatcgtgctggcccgcagcaccgagctgggcagcctcagccgcgacgagctgtggcacaaggtgtggggggaggccacctacgacctcagcaccgtgttcgccttcctcgccgtcctcgccttcaccatctccgtctacatcatgtccaggcccaggcccgtgtacctcatcgacttcacatgctacaagccggccgacgagctcaaggtgtccaaggcggagttcatcgacctggcgcgcaagtccggcaagttcgacgaggacgccctggcgttccagtcgcgtc

SEQ ID NO: 53497 - protein, 48 aa, Zea mays
  misc_feature: Ceres CLONE 1474429-F
  misc_feature: SWISSPROT Homolog: EC 2.3.1.119 Icosanoyl-CoA synthase
MSRPRPVYLIDFTCYKPADELKVSKAEFIDLARKSGKFDEDALAFQSR

SEQ ID NO: 53498 - DNA, 746 bp, Zea mays
  misc_feature: Ceres CLONE 1474432-F
  misc_feature: Encodes the peptide sequence at SEQ ID NO. 53499
  misc_feature (380)..(380): n is a, c, t, g, unknown, or other
  misc_feature (394)..(394): n is a, c, t, g, unknown, or other
  misc_feature (395)..(395): n is a, c, t, g, unknown, or other
  misc_feature (427)..(427): n is a, c, t, g, unknown, or other
  misc_feature (428)..(428): n is a, c, t, g, unknown, or other
  misc_feature (447)..(447): n is a, c, t, g, unknown, or other
  misc_feature (463)..(463): n is a, c, t, g, unknown, or other
aagctggagctccccgcggtggcggccgctctagaactagtggatcccccgggctgcaggaattcgtctcacccctagaaaaaacgaagtgggactgtgggaggcgcgagtgacgtgaggcgagccgctcctgctgcagccatggagcccgcggagaacgacacgtcctcgccgcctgagtatggcgcaggcaaggccgcggcgacggtaccggcgaggagctactggcggtggcgcagggacgacttcttcccggagccgtcgttcgcgagctggggcgcgtaccggcgggcgctgcgcgagacgccggcccgcctccgcgaccgcctcgcgggggcgtccaccgacgccgcgaagctgggcgcgctgcgccggcgcancgagcacgagatgnncgcgtgcctgacgtggtgggacctgacctggnntcgcttcgggtcggtcatncgggcctggatcttcntgctgacagggcagggaggcgcgggaacaccggggcccagcaatggggtttcctacgttgccctgggccccttccgcaagggtggccgtttttggtaaacgaaaatttcccgggggaatccccggggggcggggggtccttttcgtaaactcgcgcttaaaatttgggaaaaccccggttttttttccccccccccacactttcccctcaaagagtttttctaccgggggggggggggggggtttcagaacctaaaatggggggctcttttataagggccccc

SEQ ID NO: 53499 - protein, 139 aa, Zea mays
  misc_feature: Ceres CLONE 1474432-F
  misc_feature (80)..(80): Xaa is any aa, unknown, or other
  misc_feature (85)..(85): Xaa is any aa, unknown, or other
  misc_feature (96)..(96): Xaa is any aa, unknown, or other
  misc_feature (102)..(102): Xaa is any aa, unknown, or other
  misc_feature (108)..(108): Xaa is any aa, unknown, or other
MEPAENDTSSPPEYGAGKAAATVPARSYWRWRRDDFFPEPSFASWGAYRRALRETPARLRDRLAGASTDAAKLGALRRRXEHEMXACLTWWDLTWXRFGSVXRAWIFXLTGQGGAGTPGPSNGVSYVALGPFRKGGRFW

SEQ ID NO: 53500 - DNA, 813 bp, Zea mays
  misc_feature: Ceres CLONE 1474432-R
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
nnnnccgattgggtacctcgagcgtctcgtttttttttttttttttgatggaaggccataccacgcatagggacagccacgtatttatatacagagaggattacaatgaggcggcacaatggccgcccgagattgtagggattaccctaacagaatacatttcatgattctatttcctaacaatgtggagctgtagagctgtttgtgtgtgtggtatgagtgagacgtgcgtgtgtgtgtggaataggtgtacgttcgtatatgaacacgtacagcggcgaagactctcgtctccaaccgcaattgtcagcagccgcgcggcatgggacattcaaggccgccgacgccgatggatgggctaataattaacgggtaccgcctgccgcatcagccttctccacgtctgccgcggcaacaaccttcttgtcttcatcggcggcggccgcgtccccgtcgtcttcttcctcccaaccgcacgccccgtgcgcgacgtcgtaggtggcgtggaggccgacgaggacgtagtagacgagcatgacggcggtgcagacgccgaagcggatgaaggcgtccttgccgagcgagcccatgaggaagaggttggtggcgatggacagcgagggcagccacggcacgagcggcacgccccacaccttgggcgcccgcgccgcgggcaccagcagctggatgcccagcgtgccggccgcccacgccggcaccagcaccacgtagccctgccacccgctcggcgacgtgccccagcacgcggcgatgccgatgggacgagcgatgatgagcagcagcagcgccgtg

SEQ ID NO: 53501 - DNA, 675 bp, Zea mays
  misc_feature: Ceres CLONE 1474435-F
  misc_feature: Encodes the peptide sequence at SEQ ID NO. 53502
  misc_feature (665)..(665): n is a, c, t, g, unknown, or other
aagctggagctccccgcggtggcggccgctctagaactagtggatcccccgggctgcaggaattcgtctcacccctagaaaaagctagcacccatcgtcttgcagcaggcggagccgcccgacccgatccgtgcgtgtgttggtcgagatggctacaacagcttacgctcccatggcgagccaggtgatgaacagcagcccggtgcactcgaggccgaggggcctgtcaggcgctgcgctcacgcggccccggccccggttcagcgtcgtcaaggccgccatccagcccgagaaggcaacgtaccaggtggtgcagcccatcaacggcgacccgttcatcggcagcctggagacgcccgtcacctccagcccgctcatcgcgtggtacctatacaacctgccggcctaccgcaccgccgtgagcccgctgctgcggggcgtcgaggtcggcttctcccacggctacctcctcgtcgggcccttcgcgctcaccggcccgctccgcaacacgtccgtgcacggccaggcgggcacgctcggcgccgccggcctcgtcgccatcctcagcgtctgcctcaccatgtacggcgtcgcctccttcagcgagggcgacccgtccacgtagcccacgctcacgctcaccgggcggaatgatgcaggcgacnatctgcagac

SEQ ID NO: 53502 - protein, 150 aa, Zea mays
  misc_feature: Ceres CLONE 1474435-F
  misc_feature (44)..(149): Pfam Name: PsaL Pfam Description: Photosystem I reaction centre subunit XI
MASQVMNSSPVHSRPRGLSGAALTRPRPRFSVVKAAIQPEKATYQVVQPINGDPFIGSLETPVTSSPLIAWYLYNLPAYRTAVSPLLRGVEVGFSHGYLLVGPFALTGPLRNTSVHGQAGTLGAAGLVAILSVCLTMYGVASFSEGDPST

SEQ ID NO: 53503 - DNA, 633 bp, Zea mays
  misc_feature: Ceres CLONE 1474442-F
tggagctccccgcggtggcggccgctctagaactagtggatcccccgggctgcaggaattcgtctcacccctagaaaaaccagttacctcccctcgtcggataagaggtgacggctatacaaaccaaagtgccttccggcctccggccataaccccacgcatagcaccccattgacatgcatggtgaccaccacctcttcctcctcggtgaccactcctctcctgcgcccgaactgctatagcaaacctgctcccagatctctccaactcctcacgaccatgaggtgctctcgtgccgtaactaccgccggagacctacgtgtggtgcctcagtaggctcatccttgcacgagatttgctcgatcatgtatgacttggtggtgccaagactacctactgccagtgtaccccgcgcgcggcaggctctgagtcgactcccatgttgatgaagcgtgtccaaacgatcccggtcatttttttcatcacgtacgacggcaatggattggtaaaagggttggacccccttaagggcttggcatgggtgaaaaccccgcatccggatttgaaggcggattccccccctttgggcaaaaataaactaaaaggggggttttaccccccccccccaacccc

SEQ ID NO: 53504 - DNA, 758 bp, Zea mays
  misc_feature: Ceres CLONE 1474444-F
  misc_feature: Encodes the peptide sequence at SEQ ID NO. 53505
  misc_feature (425)..(425): n is a, c, t, g, unknown, or other
tagagctggagctccccgcggtggcggccgctctagaactagtggatcccccgggctgcaggaattcgtctcacccctagaaaaactctccgactcatccctctgtcctcacaagccgccgccggccaagtcctgtccttctcccttgtctggttcggatcgtcgttgctagccaggtgctggatccgtagcggcggcggcggccatggacaagagcatgctcggcgacctggacggcctccccgaggaggacaagatgcggatggccgccatgatcgaccagctccagatccgcgacagcctgagaatgtacaattcgctggtggagaggtgcttcacggactgcgtggacacgtttcgggcgcaagaacctggacaagcaaaaggagtcgtgcgtccgccggtgcgcggagagcccccccaancactcatgaagggtcggcatgaggtttcccgaagcttaaccagggcttgcccaccccggaataaaaaacccccctgccgcttgcttggttcctcacgttgtggcggggcccccccccccccccccaaggtttctgggtttttgcgggcccaaatttgtaccccaaaaaaggtatttcggcccttccccccccccaaaaataatcccccttttaaaaacccaaactcctgggggggccaaaataaaaaaaaaacctccctttaagaagaggtgggggaatttcctcctcaaaaaacgggttgggggcaaccccgtgtctctcttttttacggca

SEQ ID NO: 53505 - protein, 160 aa, Zea mays
  misc_feature: Ceres CLONE 1474444-F
  misc_feature (74)..(74): Xaa is any aa, unknown, or other
MDKSMLGDLDGLPEEDKMRMAAMIDQLQIRDSLRMYNSLVERCFTDCVDTFRAQEPGQAKGVVRPPVRGEPPQXLMKGRHEVSRSLTRACPPRNKKPPCRLLGSSRCGGAPPPPPKVSGFLRAQICTPKKVFRPFPPPKNNPPFKNPNSWGGQNKKKTSL

SEQ ID NO: 53506 - DNA, 744 bp, Zea mays
  misc_feature: Ceres CLONE 1474447-F
  misc_feature: Encodes the peptide sequence at SEQ ID NO. 53507
  misc_feature (405)..(405): n is a, c, t, g, unknown, or other
  misc_feature (499)..(499): n is a, c, t, g, unknown, or other
cgctctagaactagtggatcccccgggctgcaggaattcgtctcacccctagaaaaaaagaagagcacgcccactcctccggctcttcttctccaccggcaccagttcaccacctcctgccaccgcgcggccccaaccaaccacaccgcagcgcagcaatggcgggtaacggcgccatcgtggagagcgacccgctgaactggggcgcggcggcggcggagctggccgggagccacctggacgaggtgaagcgcatggtggcgcaggcccggcagcccgtggtgaagatcgagggctccaccctccgcgtcggccaggtggccgccgtcgactccgccaaggatgtgtcccacccctcccttcaacctcgacaaggaagggccgggcggcccccccaaggcccanaaactaatgggatcctctgacttgcatcccccacggggggggaaacttttaaggggggtcccccccccgggttttcgggggggacccttccccntgaccccgaacccagggaaaggggcccccgccccttccagggtttaaatattgcttcggggactttcccaagcgctggaaattttttgggaaacttggtggtcggcgggggaaaaaccctggccctctgggggaggcccccccccccccggcggaatccccgtgtcctaattataattttttttttattcggagtgtttcccccaggaccgcggtttctaaaaatattcgaaggccacctcccaa

SEQ ID NO: 53507 - protein, 88 aa, Zea mays
  misc_feature: Ceres CLONE 1474447-F
  misc_feature: SWISSPROT Homolog: EC 4.3.1.5 Phenylalanine ammonia-lyase
  misc_feature (83)..(83): Xaa is any aa, unknown, or other
MAGNGAIVESDPLNWGAAAAELAGSHLDEVKRMVAQARQPVVKIEGSTLRVGQVAAVDSAKDVSHPSLQPRQGRAGRPPQGPXTNGIL

SEQ ID NO: 53508 - DNA, 750 bp, Zea mays
  misc_feature: Ceres CLONE 1474449-F
  misc_feature: Encodes the peptide sequence at SEQ ID NO. 53509
  misc_feature (403)..(403): n is a, c, t, g, unknown, or other
atagctggagctccccgcggtggcggccgctctagaactagtggatcccccgggctgcaggaattcgtctcacccctagaaaaagagagacagagaactccatggccgccatggacctcctctccggcaagctcctacgctccctgcgtctccattcctcactcctcccctctgctccttcctcctcccgcgccgtccccacatcccgccgtctccggcgccgccgccatgcccccctgtactgccgccttaccaccacctcctcctcctcatctgcctccaccaccacaaccaccggggtggaggaagacgtcaaaagccaggacctttcctccctcctcacctcctccgacccttttctgcgcgccgccgtcggaaccaagaaaaaacgtcgggcgggaanaattttcccccccagcgatcccttccgggggtgcggttgggaggaaacctccaagtcctaaaagggtcttgaacggggctcagggaatttttccttgggagggcccaccccgaaaaaaagggggggtttttcccgcttgaaacgggcccccgaaaaaaaaaacaaattccccatattttggggggcttcaaaaaacccaaagggggggcccccttcttttgggccaaggaaaaaaataaaaaacccctctctctccacccaagaaatttaaaggtctcccctcccccccccccccgtggggagaaaatattttctccccccccccctaaggaaaaaaaggggggccc

SEQ ID NO: 53509 - protein, 120 aa, Zea mays
  misc_feature: Ceres CLONE 1474449-F
  misc_feature (101)..(101): Xaa is any aa, unknown, or other
MAAMDLLSGKLLRSLRLHSSLLPSAPSSSRAVPTSRRLRRRRHAPLYCRLTTTSSSSSASTTTTTGVEEDVKSQDLSSLLTSSDPFLRAAVGTKKKRRAGXIFPPSDPFRGCGWEETSKS

SEQ ID NO: 53510 - DNA, 716 bp, Zea mays
  misc_feature: Ceres CLONE 1474453-F
  misc_feature (417)..(417): n is a, c, t, g, unknown, or other
  misc_feature (418)..(418): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (468)..(468): n is a, c, t, g, unknown, or other
aagctggagctccccgcggtggcggccgctctagaactagtggatcccccgggctgcaggaattcgtctcacccctagaaaaagcaaatcgcaagaacaagagaagaaccaatccgacaacgtctccattctccctcacatctccttgctcgcccagcagctggcactccccgtctcccctcgcatccgcatcgaatcgaggcatatcgccctatatatcccattccgctcggttggattcagcttcccctccctctcccccatcgataaaaccgatgcgtcgcccggcctcgcgtaccctaccggcgacgggacgaggggaaggttacaggcacggcgcgtgaagggtcctgcccagtcctgcccggtccgccgcgatgccgtggtttgagatgtggctgcctcctgtgcctggcnnagggggctgnnngcgcggcgggggggctgttcttcgacggcgccaatgcngcggcgcaaggcgcgcttctcgccgccatgcctggttgctccctgtcggtcgtgctccggccccaactttcccgggggtcccccccggggtccctgtcctaaaaattccggtaaaggggggaaggggctttttccccgccccccggggggtttccccctgggcgcaaaaaaaaaaaacggggcaaaaaaatccaaaccccctttccccgggaaaaaaagcccttgaaaaaaaaaacgagagggggggg

SEQ ID NO: 53511 - DNA, 689 bp, Zea mays
  misc_feature: Ceres CLONE 1474455-F
  misc_feature (667)..(667): n is a, c, t, g, unknown, or other
aaagctggagctccccgcggtggcggccgctctagaactagtggatcccccgggctgcaggaattcgtctcacccctagaaaaaaaccgactgcgcgtcccctctcctcccaaacgcattccatcctctctcctccagtgacagcctccggcgcctcctcgggctgccatccagcccgtgccactgccactgcacttgctgtgccgacccgagctgcggtcgagtgagcaatggagcggcggcggcggcggccaccgagcctgccgctccttgtgttcgtcttggttgccaccacttgccccctcgggagctcagggattggaagcttcggagtcggtgcggagagcaatggagcttcgtctagttttaggaattccaggaccaggagtctgctgcagattggagacagaaacgaagatcgcctatttcatctgccacatacacgggctctcacgcacaagagcagatctcatagaaaagttccaacacccgcaccagcaccagcgtctgctccagcaccctcaccatccatgtctccaccagacagctcaccgtctccgtcaccacatggtgtgccacgccaatcaacttcacatcgtcatccatccataacacctccacatttggtcaggcctgggccctagcaagatggaaatgatcctttggntgatactccagctcattctcgg

SEQ ID NO: 53512 - DNA, 714 bp, Zea mays
  misc_feature: Ceres CLONE 1474898-F
  misc_feature (50)..(50): n is a, c, t, g, unknown, or other
  misc_feature (185)..(185): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (469)..(469): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (478)..(478): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (519)..(519): n is a, c, t, g, unknown, or other
  misc_feature (522)..(522): n is a, c, t, g, unknown, or other
  misc_feature (524)..(524): n is a, c, t, g, unknown, or other
  misc_feature (526)..(526): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (563)..(563): n is a, c, t, g, unknown, or other
  misc_feature (564)..(564): n is a, c, t, g, unknown, or other
  misc_feature (589)..(589): n is a, c, t, g, unknown, or other
  misc_feature (591)..(591): n is a, c, t, g, unknown, or other
  misc_feature (597)..(597): n is a, c, t, g, unknown, or other
  misc_feature (598)..(598): n is a, c, t, g, unknown, or other
  misc_feature (604)..(604): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (616)..(616): n is a, c, t, g, unknown, or other
  misc_feature (620)..(620): n is a, c, t, g, unknown, or other
  misc_feature (621)..(621): n is a, c, t, g, unknown, or other
  misc_feature (631)..(631): n is a, c, t, g, unknown, or other
  misc_feature (633)..(633): n is a, c, t, g, unknown, or other
  misc_feature (640)..(640): n is a, c, t, g, unknown, or other
  misc_feature (642)..(642): n is a, c, t, g, unknown, or other
  misc_feature (643)..(643): n is a, c, t, g, unknown, or other
  misc_feature (645)..(645): n is a, c, t, g, unknown, or other
  misc_feature (651)..(651): n is a, c, t, g, unknown, or other
  misc_feature (652)..(652): n is a, c, t, g, unknown, or other
  misc_feature (654)..(654): n is a, c, t, g, unknown, or other
  misc_feature (662)..(662): n is a, c, t, g, unknown, or other
  misc_feature (663)..(663): n is a, c, t, g, unknown, or other
  misc_feature (670)..(670): n is a, c, t, g, unknown, or other
  misc_feature (680)..(680): n is a, c, t, g, unknown, or other
  misc_feature (683)..(683): n is a, c, t, g, unknown, or other
  misc_feature (690)..(690): n is a, c, t, g, unknown, or other
  misc_feature (708)..(708): n is a, c, t, g, unknown, or other
ctggagctcaccgcggtggcggccgctctagaactagtggatcccccggnctgcaggaattcgtctcacccctagaaaaagcagcaccatggagaacgtcgccgcgaatccttccgctgcggccgccgccgcagggaatggcgtccaagcatccgggggccggatgggagcgcccgtgagactcntcgaagcagaacctggcgcaggtgaccaannnncccttccccccnnnnnnnnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnncnnnnnnnnnnnnnnnnnnnnnnnnnnnnnncncnnnccccncccccnnnnccccnnnccccccccccccccccccccccccnccncncncnnnnnnnnccccccccnnnccccccccccccccccnnccccccccccccccccccccccccncncccccnnccgccncccccccnnncncccnncccccccccncnccccccncnncnccgccnncncccccccnnccccccncccccccccnccnccccccncccccccccccccccccncccccc

SEQ ID NO: 53513 - DNA, 679 bp, Zea mays
  misc_feature: Ceres CLONE 1474902-F
  misc_feature: Encodes the peptide sequence at SEQ ID NO. 53514
  misc_feature (199)..(199): n is a, c, t, g, unknown, or other
  misc_feature (201)..(201): n is a, c, t, g, unknown, or other
  misc_feature (202)..(202): n is a, c, t, g, unknown, or other
  misc_feature (352)..(352): n is a, c, t, g, unknown, or other
  misc_feature (405)..(405): n is a, c, t, g, unknown, or other
  misc_feature (515)..(515): n is a, c, t, g, unknown, or other
aaagctggagctccccgcggtggcggccgctctagaactagtggatcccccgggctgcaggaattcgtctcacccctagaaaaactctcgcgccgccgcggaaacaacaccgcaccacactacccagcggaatccgcccacccgcacccggagcagaggaaatatgtcgcaggggaagggaggagcgtcaaggaaggangnnagtgtcaccagggagtacaccatcaaccttcacaagcgcctccacggctgcacattcaagaagaaggcacccaacgcccatcaggagatcagggagtttgcgcagaaggccatgggcaccacggacattaggattgatgtgaagctcaancagcacatctggagcagcgggatcaggagcgtgccgcggaggtttcgtgtaangatcccccgcaagagaacgacgaggaggatggccaaggagagctctactcctttgtcacgtcgcgaagatccccgccgagggcttgaaaggcctggggacaaagtccttnacaataccaattaagctgtcccgttatctacatctttagagagttcctagtttgtatttcaacaacaaaaactttttgtttccaaaaatttgtctattttcccaacagaattgcctgggtagtttttcctttcagtggctgccggatcctttttcttcattagc

SEQ ID NO: 53514 - protein, 121 aa, Zea mays
  misc_feature: Ceres CLONE 1474902-F
  misc_feature (10)..(99): Pfam Name: Ribosomal_L31e Pfam Description: Ribosomal protein L31e
  misc_feature (12)..(12): Xaa is any aa, unknown, or other
  misc_feature (13)..(13): Xaa is any aa, unknown, or other
  misc_feature (63)..(63): Xaa is any aa, unknown, or other
  misc_feature (81)..(81): Xaa is any aa, unknown, or other
  misc_feature (118)..(118): Xaa is any aa, unknown, or other
MSQGKGGASRKXXSVTREYTINLHKRLHGCTFKKKAPNAHQEIREFAQKAMGTTDIRIDVKLXQHIWSSGIRSVPRRFRVXIPRKRTTRRMAKESSTPLSRREDPRRGLERPGDKVLXNTN

SEQ ID NO: 53515 - DNA, 677 bp, Zea mays
  misc_feature: Ceres CLONE 1474903-F
aaagctggagctccccgcggtggcggccgctctagaactagtggatcccccgggctgcaggaattcgtctcacccctagaaaaacctagaaaaaatctttcgagatccaccctacaatatggggccaaaaagccaaaaaaataagtgattcgtttttagcccttataaaaagaaaacggattcttgaacctctttcacgctcatgtcacgtcgaggtactgcagaaaaaagaaccgcaaaatccgatccaatttttcgtaatcgattagttaacatggtggttaaccgtattatgaaagacggaaaaaaatcattggcttatcaaattctctatcgagccgtgaaaaagattcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtagatgctgccaaagggagtgggggtgccatacgcaaaaaggaagcgactcatagaatggcagaggcaaatagagctcttgcacattttcgttaatcca

SEQ ID NO: 53516 - DNA, 662 bp, Zea mays
  misc_feature: Ceres CLONE 1474909-F
  misc_feature (297)..(297): n is a, c, t, g, unknown, or other
  misc_feature (298)..(298): n is a, c, t, g, unknown, or other
  misc_feature (387)..(387): n is a, c, t, g, unknown, or other
aagctggagctccccgcggtggcggccgctctagaactagtggatcccccgggctgcaggaattcgtctcacccctagaaaaaaaaagcctccaccccatccggcagcagccaaaccctacataggcgccgccgcaggcggcccccccgcatcgtcgccaaagatgcagatctttgtgaagactctgacggggaagacatcactttggagggggagtcctcggacaccatcgacaatgtgaaggccaggatccaggaaaggagggcatccccccggaacagcagcggctcatcttcnncggcaagcagctcgaggacggtcgcaccctcgccgactacaacatcaagaaggagtccacactccccctggtgctccgcctcggcggcngctctagaagcgtaagaagaagacctccaccaggccaaagagatcaagcccagcacaggagggtcagcctctccgtgctggcattctataagggggacaacaccactagcaaggggacccgccttcggagggagggcccccacacggagtgggggggcgggcgtttttattggccaaccttttcgaccgtccatattgggggaggtggggccctcccttttgtctacaaccagaaggggttggttgttttccccgattttcctttatccgcctac

SEQ ID NO: 53517 - DNA, 703 bp, Zea mays
  misc_feature: Ceres CLONE 1474912-F
  misc_feature: Encodes the peptide sequence at SEQ ID NO. 53518
  misc_feature (221)..(221): n is a, c, t, g, unknown, or other
  misc_feature (270)..(270): n is a, c, t, g, unknown, or other
aagctggagctccccgcggtggcggccgctctagaactagtggatcccccgggctgcaggaattcgtctcacccctagaaaaatccgcgccagtccaaccaagtcagcacccgcgcgcggcaaggagttcacgcccatggcgagcaccaacatggcgtcggccacctcgcggttcatgctggccgcgggcgtgcccaccgccagtagcggcagcggccgcntcagcttcgccctcgcgcccaaccggtttggcaggaggctttgtgtccngggcgatgaggagtccccggcagagccggcgcccacggcggagggggagggccccttgcccaccaagcccaaggccgaaaaccgccgcccgatcgggccccaagagagggcgccagggggaagatcctgaaggcggaattcctactggtacaacggggatcgggaaccgtcgtccccgttcaatcaaggatcccaaaccccccgttacccgggtgggtggggccgtttcaacaaaggtaaacctaccccggggttttctaccaaaacaattacccccttgggaaaaaaattccttcgaagggaaaaatggagggaggcccttttttgcttaaagggacccccagggcccccggggggaaatttggaagttggagaaagggagggtttccctcctataacctgctaacggtggacgtggctagcgctcacaaaa

SEQ ID NO: 53518 - protein, 87 aa, Zea mays
  misc_feature: Ceres CLONE 1474912-F
  misc_feature (29)..(29): Xaa is any aa, unknown, or other
  misc_feature (45)..(45): Xaa is any aa, unknown, or other
MASTNMASATSRFMLAAGVPTASSGSGRXSFALAPNRFGRRLCVXGDEESPAEPAPTAEGEGPLPTKPKAENRRPIGPQERAPGGRS

SEQ ID NO: 53519 - DNA, 673 bp, Zea mays
  misc_feature: Ceres CLONE 1474914-F
  misc_feature (181)..(181): n is a, c, t, g, unknown, or other
  misc_feature (191)..(191): n is a, c, t, g, unknown, or other
  misc_feature (193)..(193): n is a, c, t, g, unknown, or other
  misc_feature (208)..(208): n is a, c, t, g, unknown, or other
  misc_feature (244)..(244): n is a, c, t, g, unknown, or other
  misc_feature (252)..(252): n is a, c, t, g, unknown, or other
  misc_feature (515)..(515): n is a, c, t, g, unknown, or other
aagctggagctccccgcggtggcggccgctctagaactagtggatcccccgggctgcaggaattcgtctcacccctagaaaaaaccaccagtaccacaccactccgcgctagctgaggacggtacagcggcacagaggtgcgacgtacgacgacgacgacgcaggcgccacacatggggcnattcccccangncttcttcccgcccgnccggtggcccccgggttccacgggccctccgggggnctacgccngcggccccaggtccccgcggtgggcagcgcctgcccgtcccgtgaggggtggggcaaggaaagagggtcgtccgtcccaagggcatccggctggcgactacttcgggctcccccccaaccaaccttggattcatgggtgaacaaccaaacaaccctttaatcgcttttccccccgggggcggttcccgggttttggccccccttccggcaaaaacccccaaaggggccaaacgcgccgggggcttaaaaactttggaagggcnccccaaaatttccgggcctttaaaaaaaagggggggaacccccccccccgggggtttttccccccctccccccaaaaaaaacctttttgggcccttgggggcgcccccttttggggccccaatttcccccgggggggcgggaattttttggtgttcgg

SEQ ID NO: 53520 - DNA, 660 bp, Zea mays
  misc_feature: Ceres CLONE 1474918-F
  misc_feature (306)..(306): n is a, c, t, g, unknown, or other
aaagctggagctccccgcggtggcggccgctctagaactagtggatcccccgggctgcaggaattcgtctcacccctagaaaaactttccagacccgagagccagagaccaaccacctgcggcggcgatggggatcggtgagcacttcgagggcgtgaagcagcactgggcgagcaacttcgccttcctcgactactacaagaaggtctacggccgcgccgagcccctcccccagtgtccgacgccgacgtcgacaagttcatcgcctccgaccccgtctacgggccccagctcaaggcccttgcngaaatccgggaaattccccctttgttgggggctttccccggggccccccccccctggggggggtgcccctcaaatactcccaagggccccaacagggtctttttggaaaaccggtttttgggaaaacaaccccccccctttgtgggccccaggggggaaaaacctttcccccttccaaaaaaaggaaaaaaggggggcccccctatttttttcctcttggggggggaaaaaccttcccccaaaaaaaaaaaaaccccccgggggaaaaaaagaagcgcttttttaaaccccccccccaaaaaaaaaaaaaagggggggttaaaccccccccccctttttgtttttttttttttt

SEQ ID NO: 53521 - DNA, 664 bp, Zea mays
  misc_feature: Ceres CLONE 1474919-F
  misc_feature: Encodes the peptide sequence at SEQ ID NO. 53522
  misc_feature (23)..(23): n is a, c, t, g, unknown, or other
caaaactggaagtcaccgcggtngcggccgccccaaaaatagtggatcccccgggctgcaggaattcgtctcacccctagaaaaacggagaagaaggaagagaagaaggaagaaaaagaaggacgaaaagaagccggcgccggccaaaacggagtacaagtttgtgccctacccgtacccgctgccgaaccccgcgatgtgcccgagctggccgtggcagtgcccgcctcagcagcagtgccagtgctgccagaagcctccgcctccgcctccgccgcccaagtcgccgccgaagccgccgccgtgcacctgttcgagccacgccgcctgtgtctgcggcaagacaccgcctgcggtctggccaccgatgccgccgccggtctggccgcctccgtggggcacctgcaacgtcgtcaccgaggagagcccgtgctccgtcatgtgacgctacgcgcttgctttgtcatgtactcgtcgctgttggcctgttgctgtgctgccatcggtactggacctcggtgctacttgggccggtgccattctgtgtagtgaaggtacagtgcatcgtctgcagatgtgcttgcctcctacagtctcttatacgaacgtgtcacaccttgttttattgcagtaattgtgtagcttccagctataatttgctact

SEQ ID NO: 53522 - protein, 147 aa, Zea mays
  misc_feature: Ceres CLONE 1474919-F
  misc_feature (8)..(8): Xaa is any aa, unknown, or other
KTGSHRGXGRPKNSGSPGLQEFVSPLEKRRRRKRRRKKKKDEKKPAPAKTEYKFVPYPYPLPNPAMCPSWPWQCPPQQQCQCCQKPPPPPPPPKSPPKPPPCTCSSHAACVCGKTPPAVWPPMPPPVWPPPWGTCNVVTEESPCSVM

SEQ ID NO: 53523 - DNA, 633 bp, Zea mays
  misc_feature: Ceres CLONE 1474921-F
cctttcctcgtggatcccccgggctgcaggaattcgtctcacccctagaaaaaccttgccgccggccagcccattaaccctcgttcctgtcgcgcggacacgacctccacttccacatctcccccggagtcagcatcggtcagttgaaccatggcggactcgcaaggcaacctctgaggtcaccctccgcacccgcaagttcatgaccaaccgcctcctggacggcaagcaattcgtacgaggtgaaggaccccaacaccatctatgacttcaagttccacacacacttgggaggaggaaagtccactggttccggcctcatctacgacaacctcaaggctgccaagaagtccgagcctacataccgcctcatcaggaatggtcttgctacataggttgacaagtctcgcaagtaatgaatgagcgtatgaacatggccaagaagatccgtgatgtctataccaccaatgctggtgacgccaagaaaaactaaacgttcttttacatttgtattactgtgctgggctctgagatgtctacctgcaatgtcataaatatgggccgtgttgggttttgtcccacccttggaactgaaatgattttttttgtattcccccggcacgaaagggaatt

SEQ ID NO: 53524 - DNA, 667 bp, Zea mays
  misc_feature: Ceres CLONE 1474925-F
  misc_feature (257)..(257): n is a, c, t, g, unknown, or other
aagctggactccccgcggtggcggccgctctagaactagtggatcccccgggctgcaggaattcgtctcacccctagaaaaagagtggctcaccttctttcccagccagcacgagcttgcaagcaagcgagctcctgagatttcagctcgcttctcctccagaggtcgagcagaccagactcctccgaccgaagctctaccacttcccagttatcctgtccaggaactgcttggccggatatccaaacaaacctctngtgttggggttctccggggttccttgcgctggagggaggtttcattctcgctggccatggtttggctgataagcagcagcggcagcatcttgatgcaaatctctgagctttatgatgatcgccactcacctgcgctgctcctgcttcctccactccttctcggttgtctccatctactggttgtatgtgatctcataacttgccctcccccggataccgcattcacccgtgccctctctccgtcccctcagcattctccctccttttctgcttccctcaacagtcgccaaataacagcactagtggcagcggaagaagatcttatcgaggtaagctaggccggcctggtccctgcggataaaaaaaaaaaaaaaacgagacgctcgaggtacctaatcggcctatagggg

SEQ ID NO: 53525 - DNA, 652 bp, Zea mays
  misc_feature: Ceres CLONE 1474927-F
  misc_feature: Encodes the peptide sequence at SEQ ID NO. 53526
  misc_feature (413)..(413): n is a, c, t, g, unknown, or other
  misc_feature (568)..(568): n is a, c, t, g, unknown, or other
  misc_feature (569)..(569): n is a, c, t, g, unknown, or other
ggagctccccgcggtggcggccgctctagaactagtggatcccccgggctgcaggaattcgtctcacccctagaaaaacgaagaggcgcccaaaccaggtcaagagaacctgctatgctcaggcatcccagatccgtcagatccgccgtaagatggttgagattatgatcaaccaggcttctacatgtgacctgaaagaacttgtttcgaagttcattccagaagttattggtaaggagattgagaagtctacctccagcatcttcccacttcaaaacgtcttcatccgcaaggtgaagatactcaaggcccccaagttcgatcttgggaagctcatggaggttcatggcgactacaaagaggatgttggtgtgaagcttgagacgcctgtcgagggagatgaggctgtgcangaggttgctgctgccgagtagtttgtttgctacttctatatctaggctgagtctggacatgaggttgcttatgacgtgaacttagagttgtctacttgttttcatccgccccctaagattttgtctggaaacaagtttaaaattaggattattcnntcacagtgtttaagattcctcggggtgatcttctgagttcgagtactgctataaaaaaaaaaaaaaaacgagacgctcgaggg

SEQ ID NO: 53526 - protein, 93 aa, Zea mays
  misc_feature: Ceres CLONE 1474927-F
  misc_feature (87)..(87): Xaa is any aa, unknown, or other
MVEIMINQASTCDLKELVSKFIPEVIGKEIEKSTSSIFPLQNVFIRKVKILKAPKFDLGKLMEVHGDYKEDVGVKLETPVEGDEAVXEVAAAE

SEQ ID NO: 53527 - DNA, 677 bp, Zea mays
  misc_feature: Ceres CLONE 1474938-F
  misc_feature (193)..(193): n is a, c, t, g, unknown, or other
  misc_feature (201)..(201): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
aagctggagctccccgcggtggcggccgctctagaactagtggatcccccgggctgcaggaattcgtctcacccctagaaaaaaccgcgctcaggagcattcgagaagccgaagaaaattcgaagacgaggagcagctacactgcggacggacttcgggcatggagggccagttccaggttggcaaggaggangtcatccnagcattggggtaccattgggacgacagtggaaaaaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 53528 - DNA, 673 bp, Zea mays
  misc_feature: Ceres CLONE 1474939-F
  misc_feature: Encodes the peptide sequence at SEQ ID NO. 53529
  misc_feature (389)..(389): n is a, c, t, g, unknown, or other
aagctggagctccccgcggtggcggccgctctagaactagtggatcccccgggctgcaggaattcgtctcacccctagaaaaaaaaccaatcagatagagagagcatagtcgatcatgaagggtggcaagaaggaagtggccggtgcggtggtggccatactgctggttctgcagctcatggcagctccaccgacggccatggccgcccgctcgccgcgcggagccgtgccggatggctccctcgccacgacgcccaaggtgacgatgctgtcggccacgctgtgctacacgggggagacatgcaaatacactccctgcttcactcctgcttgctcctgcagctttagtgatcgcctctgctacgtcatatttactccctgtgcttgangtgaggccattcccgcgagcacaactcttacatgcatgcgccggccgaccacgacgacgctgcctctcgtgagcttctgttcaagtgatgcatgtttcaaggcatccatggatgctttacgtatatgcgtattaattagccgtggcagggaccggaacagaaggggggtgttgtttatttcccctcctctgggtaatcaaataaaggggaaatttttggttggatgtgtgcataaaaaaaaaaaaaaaaacaagacgctcgaggtaccccatttccccctatag

SEQ ID NO: 53529 - protein, 90 aa, Zea mays
  misc_feature: Ceres CLONE 1474939-F
MKGGKKEVAGAVVAILLVLQLMAAPPTAMAARSPRGAVPDGSLATTPKVTMLSATLCYTGETCKYTPCFTPACSCSFSDRLCYVIFTPCA

SEQ ID NO: 53530 - DNA, 665 bp, Zea mays
  misc_feature: Ceres CLONE 1474940-F
  misc_feature: Encodes the peptide sequence at SEQ ID NO. 53531
  misc_feature (372)..(372): n is a, c, t, g, unknown, or other
  misc_feature (534)..(534): n is a, c, t, g, unknown, or other
  misc_feature (544)..(544): n is a, c, t, g, unknown, or other
  misc_feature (548)..(548): n is a, c, t, g, unknown, or other
  misc_feature (549)..(549): n is a, c, t, g, unknown, or other
aagctggagctccccgcggtggcggccgctctagaactagtggatcccccgggctgcaggaattcgtctcacccctagaaaaaaaaaaagctgcgccataaggctgcgactgcgagagccagccgcacccgcaccagtccataggccggcctcctctcttaccttcccacaccccttctcgaccgtacgtagcctagttgtgcttggtagccagccagaaggtcgtcggccgatgatgggaggaagaacagtggccccgccgctcgtcctcgcgctggtgaccatcatcgccatcgcggcggccgagggggacgaggtgaagtgtggcgggtgctctccgtgcggcggcgccgactgcccggtgctgtaccngtcgccgcccccgcccgcgtactactactacagccctcccccacccgcgacctaccccggggagtcctcgtcatactaccagccgcccgccgccgggcgcgtacatccagatcgggagcgcgccgccgggcaggggcccgctgtacccgcaggacccagggntcatcccggncggnngcgcggggcgcgccgcgccgttcggggtcgtcgctgcgctcgcgccggcgttgggcgtgcgcatggggccttattgtgatctctatgtgcctgacttggcaagcgcaagcgaactt

SEQ ID NO: 53531 - protein, 131 aa, Zea mays
  misc_feature: Ceres CLONE 1474940-F
  misc_feature (47)..(47): Xaa is any aa, unknown, or other
  misc_feature (101)..(101): Xaa is any aa, unknown, or other
  misc_feature (106)..(106): Xaa is any aa, unknown, or other
MMGGRTVAPPLVLALVTIIAIAAAEGDEVKCGGCSPCGGADCPVLYXSPPPPAYYYYSPPPPATYPGESSSYYQPPAAGRVHPDRERAAGQGPAVPAGPRXHPGRXRGARRAVRGRRCARAGVGRAHGALL

SEQ ID NO: 53532 - DNA, 677 bp, Zea mays
  misc_feature: Ceres CLONE 1474963-F
  misc_feature: Translation starting site: 159
  misc_feature (274)..(274): n is a, c, t, g, unknown, or other
  misc_feature (281)..(281): n is a, c, t, g, unknown, or other
  misc_feature (284)..(284): n is a, c, t, g, unknown, or other
  misc_feature (300)..(300): n is a, c, t, g, unknown, or other
  misc_feature (305)..(305): n is a, c, t, g, unknown, or other
  misc_feature (362)..(362): n is a, c, t, g, unknown, or other
  misc_feature (445)..(445): n is a, c, t, g, unknown, or other
  misc_feature (447)..(447): n is a, c, t, g, unknown, or other
  misc_feature (459)..(459): n is a, c, t, g, unknown, or other
  misc_feature (465)..(465): n is a, c, t, g, unknown, or other
  misc_feature (540)..(540): n is a, c, t, g, unknown, or other
aagctggagctccccgcggtggcggccgctctagaactagtggatcccccgggctgcaggaattcgtctcacccctagaaaaacccagcaacaagcaaccaccgcctccccgatctcgtcgagaggaagcccaatcccgaaaccgtcgccgtattccaatggcgcccaaggccgagaagaagcccgccgccaagaagcctgcggaggaggagccggcggcggaaaaggcacggcggggaagaagcccaagggccgagagcggctccccgcgggncagtccncanggcagggagggtggcnagaanaaagggaagaaaaaggcaaagaagtcgggtggagacgtacaagatctacatctttanggtgctgaagcaggtgcacccggacattggcatctcgtccagggccatgtccatcatgaactccttcatcaacgacatcttcnanaagctggcggcngaagcngcccaagcttgcgcggtacaacaagaagcctaccattacgtcccgcgagatccaaacctcggtccgcctcgtccntcccgggaagctcgccaagcacgccgtctccgagggcaccaaagccgtcaccaagtcactagctcctaggcgagcgatgcgacttgccctcgtctcctcttcttgcatagtgcaatagtggtacgggtaggtgggtt

SEQ ID NO: 53533 - DNA, 663 bp, Zea mays
  misc_feature: Ceres CLONE 1474971-F
  misc_feature: Translation starting site: 228
  misc_feature (206)..(206): n is a, c, t, g, unknown, or other
  misc_feature (370)..(370): n is a, c, t, g, unknown, or other
  misc_feature (400)..(400): n is a, c, t, g, unknown, or other
aagctggagctccccgcggtggcggccgctctagaactagtggatcccccgggctgcaggaattcgtctcacccctagaaaaagccaaaaccctagcagccgcccggtgctccctctctgcagatctcccttcgcagccgccgaggaaccccttcacagcgcggaagatgggctgacaggaggccccagtcgtggttgaggcaccnaccccagttcttggggaagctatggacttgatgactgctctgcagctcgtgatgaagaagtcaggtgctcatgatggacttgtgaggggtctccgtgaggctgccaaggccatcgagaagcacgccctcagctttgcgtgcttgctgaggactgtgaccacccngatatgggagggtggggggggcactctgcncgaaacacaatgttcacctggtcactgttcctgcccctaagacccttgggggagggggctgggttcccagatttactcctaaggcaagggcaaggaaggttttaggcctcctcttgtggccccttcaaggactacgggaaaagaatctgagggccttaacattggggcaggattttgccaggccccactggaggggggacatgtttcagggatcccttttgatttgggaccggggcttaaaaattttgctttttgcggtgggg

SEQ ID NO: 53534 - DNA, 684 bp, Zea mays
  misc_feature: Ceres CLONE 1475183-F
  misc_feature: Encodes the peptide sequence at SEQ ID NO. 53535
  misc_feature (416)..(416): n is a, c, t, g, unknown, or other
tggagctccccgcggtggcggccgctctagaactagtggatcccccgggctgcaggaattcgtctcacccctagaaaaagaacgccatccgttccatttcttatcccctcctcctcccagtcccagccatcgcctcccgatggcgtccctcgtcacgctccccgccatcgccttctctaaccccgccacagcctccggcgctgtccgcctacgcgccgcggccttccgctgctgggcgctccggcggcgcgggtgggcggtggcggctgccgtggcctcgcccaactccgtgctcagcgagcacgccttcaagcggctccagctcgggagtgacgacgaggacgaagaagggccgtactgtagcgacgccgacgaggggttccagggggacgaggaggagctcgccattgccaggntcggtctgcccgaagagctcgtcgccacgctcgagaagcgcgggattacgcacctgttccccataccgaggggctgtgttgattcccgctcttgagggccgcgaactggattgctaaagcaaagaccggaaacggaaaagacacctggcccatggggattcccgggggccccaaattaaggggaggcaggacgaaggggcgggaggaccaggcggagacgtgggtcgcccgaggagcgggggtagcagcccccccgccgagggagggt

SEQ ID NO: 53535 - protein, 123 aa, Zea mays
  misc_feature: Ceres CLONE 1475183-F
  misc_feature (93)..(93): Xaa is any aa, unknown, or other
MASLVTLPAIAFSNPATASGAVRLRAAAFRCWALRRRGWAVAAAVASPNSVLSEHAFKRLQLGSDDEDEEGPYCSDADEGFQGDEEELAIARXGLPEELVATLEKRGITHLFPIPRGCVDSRS

SEQ ID NO: 53536 - DNA, 800 bp, Zea mays
  misc_feature: Ceres CLONE 1475184-F
  misc_feature (17)..(17): n is a, c, t, g, unknown, or other
  misc_feature (26)..(26): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
tttcccccccccccttntcccccccntnnnnnnnnccgcccnnnnnnaattgttggattccccgcggtggcggccgctctagactagtggatcccccgggctgcaggaattcgtctcacccctagaaaaaagagcgccgaaccccaaggctcgcgaccgcgacactcttgtgtcctcctgctctccagatctcgccgtcggcggcggcatgctcccctccaccgtcggcggccgcggccgctacctcatgctcggcatcgcccttgccctcgctgccctgctcgcgctcgcctccgcttccgagtccgaccccaagtaccaaactgagaaacctgttaacctttggggggataaagttggccccttaccacattcctccaagaaacttccacctactccccgcctttcctttttttgtcccccccccccaaaaggcgggggggggggaatgcctcacgaccctaggaaaacaaattaacccccccttccgagcccccccccccttcccattttcccatttaccctccctttaccccctttccccccaaccccccctattttgcccccctttcccccttttgcccctccaacccgtcccttgccattttgcgcaatgcccccatccccccactctcacccccgccttttttaccttcctcattccccccccttcgtccctgttggcccggttcccgccccgcgcccccctgttgcattcccccccccccctcctgttccccgtccttccccccgcttgcccctctcgttccttttccgccctcccccccccgcgctccccc

SEQ ID NO: 53537 - DNA, 769 bp, Zea mays
  misc_feature: Ceres CLONE 1475185-R
  misc_feature: Encodes the peptide sequence at SEQ ID NO. 53538
  misc_feature (1)..(1): n is a, c, t, g, unknown, or other
nttttacgattgagtactcgagcgtctcgtttttttttttttttttctactacttttctgttgaaggtatttttacatcacgatgcacctctctttcttggattcacttcttgacggaggcggcacattggacatccttggaccaacaacaagtcctggtcggccagattgagctggttggtgctgcgtctgaggtggtggttgttgttgctgctgctgtggtggtggagcttggaacctttgtggttgccgctcaaactcttgctgttgaagtgctatagctagctccagatcagagtttccagaagtggagttgtcaaattgagcaagataatcagcagtactcgtcatagcttgctgttcattccatgaatcatttcttggagtttcagccttaaatggtgtgaagttgctagtaagaaaacccccatctccattcacctcatccaacctctgccataccaaatcagtttggcttataaaaccttgatcagttgctaggagatatagacttccgttgtacttgaacatagtgttgaagtggttattccggaagaagacacaaagctcattttccttaagttcctcttgtaagcagaagagaccatagacagtcagctggttagcagtggaccacagataattatcgatcaactcccattgatgttctgtggccttgtcatccacgggaaggactgcttttcctcattcttgtcaaagctgcttagcatagaacaccctccccctcattacactgggttcctggatt

SEQ ID NO: 53538 - protein, 92 aa, Zea mays
  misc_feature: Ceres CLONE 1475185-R
FTIEYSSVSFFFFFFYYFSVEGIFTSRCTSLSWIHFLTEAAHWTSLDQQQVLVGQIELVGAASEVVVVVAAAVVVELGTFVVAAQTLAVEVL

SEQ ID NO: 53539 - DNA, 655 bp, Zea mays
  misc_feature: Ceres CLONE 1475186-F
  misc_feature: Translation starting site: 248
tggagctccaccgcggtggcggccgctctagaactagtggatcccccgggctgcaggaattcgtctcacccctagaaaaaatcacacaccaccgccgctcaccaacaaccgagcaggagcagcctaccccatccacccaccccatcctctgcgctgcacggctgctgctggtgctggtccggccggtccggtccggtctcctctgttccagcgagctccctccgatccatcgggtaggacactccccatggcgtcgcacaacggcaccaagcacctggcgccgatggaggtgtcggtggaggccgggaacggcggcggcgccgagtggctggacgacgacgggcggccgcggcgcacgggcacgttctggacggccagcgcgcacatcatcacggccgtcatcggctcgggagccctgtcccctggcctgggccatcccgcagctggggtgggtggccggcccccgccgccatgctgctcttcgccttcgtcacctactacaccgccacgctgctcgccgagtgctaccgcacgggggacccggacccgggcaagcgcaactacacgtacattgacgccgtgcgctcccaccctcgcggggcccaggtcgccttctgcggggcccttccattacgccaacctcgtcggggtcccc

SEQ ID NO: 53540 - DNA, 684 bp, Zea mays
  misc_feature: Ceres CLONE 1475188-F
  misc_feature: Encodes the peptide sequence at SEQ ID NO. 53541
cgcggtggcggccgctctagaactagtggatcccccgggctgcaggaattcgtctcacccctagaaaaactcggccgttgccgcgagctcgctccgacccaccgccaatggcgacggcgatgggcgcgatggccgccacctgcatggcctcgatgccggccgccgctacgttccccggtgatctcggcgtcggacgacgccgagcggctgtaccagggtggcgcgccggtgggagacggctgcgtgcgacgccgcctgcccggaggccgttcctgttctcgccgaagggcgtttcggactcccggagctcgcaaacgtgccttgatccggacgccagcacgagtgttcttgggatcatccttggagggggtgctgggacaaggttgtatccactgacgaataagagggcgacccctgccgtgccgttgggcgccaacttacgggctcatagatatccctggcagccacctgtctcaaaggtaacgtctccaagatatatttcgctaacccagttcaacttctggcttcgctcaaacggccaccctctagaagggccttatggaaaccaaacattgcccgggtcaccacgaatggaagggattcccttggaaggtcccttgccagctcaacccgaagtcccagaagaaatccctcaacttggtttttcccggggtacttggcccg

SEQ ID NO: 53541 - protein, 192 aa, Zea mays
  misc_feature: Ceres CLONE 1475188-F
  misc_feature: SWISSPROT Homolog: EC 2.7.7.27 Glucose-1-phosphate adenylyltransferase
MATAMGAMAATCMASMPAAATFPGDLGVGRRRAAVPGWRAGGRRLRATPPARRPFLFSPKGVSDSRSSQTCLDPDASTSVLGIILGGGAGTRLYPLTNKRATPAVPLGANLRAHRYPWQPPVSKVTSPRYISLTQFNFWLRSNGHPLEGPYGNQTLPGSPRMEGIPLEGPLPAQPEVPEEIPQLGFSRGTWP

SEQ ID NO: 53542 - DNA, 704 bp, Zea mays
  misc_feature: Ceres CLONE 1475192-F
  misc_feature: Translation starting site: 133
  misc_feature (704)..(704): n is a, c, t, g, unknown, or other
ggagctccccgcggtggcggccgctctagaactagtggatcccccgggctgcaggaattcgtctcacccctagaaaaaagccgcatcccttctttcattcgccgccgccgcctgctctctgctgccgtcgccatggggagaaggcctgcgagatgctatcgccagatcaagaacaagccataccccaagtccaggtactgccgtggtgtccctgaccccaagatcaggatctacgatgttggcatgaagagaaagggtgttgatgagttcccctactgtgtgcaccttgtctcttgggagaaggagaatgtctccagggaggctcttgagggtgcccgtattgcctgcaacaagtacatgaccaagtctgcaggaaagggatgccttccaccttcgggtccgggttcaccttttccaagaccttccaaacaacaagatgctttcctggtgctggggcctaaaaggctcccagactgaaatgagggggtgccttttggcaaacccttagggtaccttgggttaggggcggcacctttgggtcagcgtcccccctttctggtgcgatggcaggggacaaccatggcttgccccatgcacatgtgaactctcctgccttcgggccccaatgtccaactttctcctggggccccccaaagaattgtcttgggcaaccactgaaaggggggggtttttccccccacgcn

SEQ ID NO: 53543 - DNA, 2090 bp, Zea mays
  misc_feature: Ceres CLONE 1475195
  misc_feature: Encodes the peptide sequence at SEQ ID NO. 53544
aaaccccccacaaagggaaggcccaaaccctaagcacagagctccccatggcagcatccacggcggcggcggccgcgcggaggggcgcgctgacggatcagaggttctcggagctttcccccgcgttgtccccggaggtggtggatgcactggaccgcggcggcttccagcggtgcacgcccgtgcaggcggcggccatcccgcacctgctgtcgcacaaggacgtcgccgtcgacgccgccacaggctccgggaagacccttgccttcatcgtccccgtcgttgagatcctccgccgccgctcctccccgcccaagtcacacgaggttcttgctctgattatctctcccacgagagaattgtcatcgcagatattcaatgtggcccagcccttcttcgcgaccctgaatggcgtgtcgtccatgctcctggtgggtggtctggatatcaaagcagagctcaagaaggtagaggaagagggcgcaaacatattggtgggcactcccgggaagctgtttgatataatgcacactgatgctctagagtacaagaatcttgagattttgatcctagatgaggctgataggctcttggatatgggattccagaaacatattaactttatactttcaatgttgccaaagctgaggaggactgggcttttctcagctacccagacgaaagctgttgcggacctatccaaagcagggttgagaaatcctataagggttgaggttaagacagaggcaaagtccacaagcaaagatgctggacagcaagagcttggtccatccataacaccattagggcttcggttggagtatatgttatgtgaagcatcaaagaagtcatctcagcttgttgatttccttgtgcagaatagtgggaagaaaataatggtatattttgcaacatgtgcttgtgtagattactgggctgttgttcttccactaattaactcgcttaaaggttctccaataattgcttaccatgggaagatgaaacagagccttcgagagaaagctttggcatcattttctgctctttcaagtggcgttctagtctgcactgatgttgcagcaaggggtcttgacataccaagtgttgatctgattgtgcagtatgatccacctcaagatcccaacgttttcatacatagagctggccgtacagcacgctatgatcaagaaggggatgctattgtatttctcttaccaaaggaggatacttatgttgagttcttgaagcttcgaggtgttcctctcacagaaagggaatgccccgcaaacactgatgatgtcgtaccacagattagaagtgctgcgctcgaagatcgtaatgtcatggagaaaggacttagagcgtttgtctcgtttgttcgagcatacaaggagcaccactgctcttacatttttaggtggaaagatctcgagattggaaaactagctatggagtatggtttactccagatcccatccatgccagaagtgaagcatcattctctttcactagagggatttatttctgttgatgatgttgatattacacaaatcaagtacaaggataaagctcgagaaaaacaacgcaagaaggcgctgaaaaggaaagcagaagaggaggctcaaaatccaaagccggagaggaagagacatccagagaagccggagaagccaaagcggaagaagacgggcaagcagcgtcagtcaatccaaactaaggaggacctggatgagctggcgcacgagtaccggcttctgaagaagctcaaacgtggagacatcgatgaagaggagtacgagaagctcactgggttcggagattctgatggcgaagcttccgatggggatgggagcaacttggacgagaggaagaagggcaacaaggcgcagaaaaagcccaagcagagaggaaaatgcaaaagtgggtctaagaagttcgaagggaggagtaaattgaggagcaaaagaagatagggaaccataaaaatgttgtttgatttttttttttttttttggaaatgctgatccaattttacagcaataggaattttgcacagaagctgtgcatgcccctaaaaaaaaaaaaaaaaa

SEQ ID NO: 53544 - protein, 641 aa, Zea mays
  misc_feature: Ceres CLONE 1475195
  misc_feature (44)..(217): Pfam Name: DEAD Pfam Description: DEAD/DEAH box helicase
  misc_feature (303)..(379): Pfam Name: Helicase_C Pfam Description: Helicase conserved C-terminal domain
MAASTAAAAARRGALTDQRFSELSPALSPEVVDALDRGGFQRCTPVQAAAIPHLLSHKDVAVDAATGSGKTLAFIVPVVEILRRRSSPPKSHEVLALIISPTRELSSQIFNVAQPFFATLNGVSSMLLVGGLDIKAELKKVEEEGANILVGTPGKLFDIMHTDALEYKNLEILILDEADRLLDMGFQKHINFILSMLPKLRRTGLFSATQTKAVADLSKAGLRNPIRVEVKTEAKSTSKDAGQQELGPSITPLGLRLEYMLCEASKKSSQLVDFLVQNSGKKIMVYFATCACVDYWAVVLPLINSLKGSPIIAYHGKMKQSLREKALASFSALSSGVLVCTDVAARGLDIPSVDLIVQYDPPQDPNVFIHRAGRTARYDQEGDAIVFLLPKEDTYVEFLKLRGVPLTERECPANTDDVVPQIRSAALEDRNVMEKGLRAFVSFVRAYKEHHCSYIFRWKDLEIGKLAMEYGLLQIPSMPEVKHHSLSLEGFISVDDVDITQIKYKDKAREKQRKKALKRKAEEEAQNPKPERKRHPEKPEKPKRKKTGKQRQSIQTKEDLDELAHEYRLLKKLKRGDIDEEEYEKLTGFGDSDGEASDGDGSNLDERKKGNKAQKKPKQRGKCKSGSKKFEGRSKLRSKRR

SEQ ID NO: 53545 - DNA, 830 bp, Zea mays
  misc_feature: Ceres CLONE 1475196-F
  misc_feature: Encodes the peptide sequence at SEQ ID NO. 53546
  misc_feature (29)..(29): n is a, c, t, g, unknown, or other
  misc_feature (31)..(31): n is a, c, t, g, unknown, or other
  misc_feature (35)..(35): n is a, c, t, g, unknown, or other
  misc_feature (36)..(36): n is a, c, t, g, unknown, or other
  misc_feature (43)..(43): n is a, c, t, g, unknown, or other
  misc_feature (44)..(44): n is a, c, t, g, unknown, or other
  misc_feature (47)..(47): n is a, c, t, g, unknown, or other
cggggggttaccttttgtccactataaananaaannaacccannccnaaaactggaactccccgcggtggcggccgctctagaatagtggatcccccgggctgcaggagttcgtctcacccctagaaaaaattccccgccgactcgcgcccccgctcgcttcacttctctaggtgcgcaccgatcagaaggtgcctgcctcctcctcgtcggcgaaaagatggcggtgccgctgctgacgaaaaagatcgtgaaaaaccggtcaagcagttcaagaggccccacctcgaccggtacaagtgccttaagggtggaattccaccttctttgtctattctggaaaggaatgggccatcggaagtggaacttgggaactttgaaaaaaacccaatgttttgtacaacccagcaaaaatccctcaagttgggcctagaccctcgggcttataaccattgattggtattgtaaaaaattattaattagaatgcccccccacccccccccccccccattatgaatattggttccgtttataaggttttataaaaactcgaaattactccatataaaaaaatatgaggggcacccaatttttaatgcttaaattcggccctaacaaacacctgcggcgcttatctttttttctaattgtcgccccgtaaaaaaagaaatttttcctctaacccgaaagaataaataaaacattttgggtaaaaatacacatgttttcaaaaatttagaaaatttgtaagctgttaacccggtttggggtaaaaaaagagggagtttttaacaccccccgcggcaagtgaatttaaaatactaataaat

SEQ ID NO: 53546 - protein, 70 aa, Zea mays
  misc_feature: Ceres CLONE 1475196-F
MAVPLLTKKIVKNRSSSSRGPTSTGTSALRVEFHLLCLFWKGMGHRKWNLGTLKKTQCFVQPSKNPSSWA

SEQ ID NO: 53547 - DNA, 661 bp, Zea mays
  misc_feature: Ceres CLONE 1475198-F
  misc_feature: Encodes the peptide sequence at SEQ ID NO. 53548
  misc_feature (404)..(404): n is a, c, t, g, unknown, or other
tccccgcggtggcggccgctctataactagtggatcccccgggctgcaggaattcgtctcacccctagaaaaaaacctcatcttctctccttttgctcggaacgcacacacagcccggtccccgatctccgatcccctcgtcgatccaagatgcagatcttcgtcaagaccctcactggaaagactatcaccctcgaggtggagtcttctgacaccattgacaacgtcaaggccaagatccaggacaaggagggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcantgcaccagactatcaccctcgaggtggagtcttctgacaccatcgacaacgtcaaggccaagatccaggacaaggagggcatccctccggaccagcagcggctcatttttgctggcaagcagctcgaggacgggcgcacgctggccgactacaacattcagaaggagagcaccctccacttggtgttgcgtctcaggggcggcatgcagatatttgtgaagactctgactggcaagactatcacccttgaggtcgag

SEQ ID NO: 53548 - protein, 96 aa, Zea mays
  misc_feature: Ceres CLONE 1475198-F
  misc_feature (6)..(74): Pfam Name: ubiquitin Pfam Description: Ubiquitin family
  misc_feature: SWISSPROT Homolog: EC 3.1.2.15 Ubiquitin thiolesterase
  misc_feature (85)..(85): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLXAPDYHPRGGVF

SEQ ID NO: 53549 - DNA, 662 bp, Zea mays
  misc_feature: Ceres CLONE 1475201-F
  misc_feature: Encodes the peptide sequence at SEQ ID NO. 53550
ggagctccccgcggtggcggccgctctataactagtggatcccccgggctgcaggaattcgtctcacccctagaaaaagctcaggcaggggaacccaacggaactcctcctccccagcagacagcagagagtacataggagacgagaagatcccatccactaccgcccggtcgcggtcctccgccctccgccctccccgccgctcgttcggtgcaggtcgccctcgcgtggatcggaatgggcgcctgcgtgtccaaggccgcctgctgctgccgccagccgcacaacggggttaccaacgagaggactgatactgtgacggaggacgaggaggcatacgacctgcctgcgttccaggagttcaccttcgagcagttgcggctagctacatcggggtttgcggtggagaacaccccccccgagcaaggtgagaaggcgcccaatgtggtatacaaggggaagctcgatgcccagcgccgcattgctgtcaagcgctttaaccgctctgcctggcccgacccgcgccagttcctggaagaagctagatcagttggcctgctccgaagcaaaaggttggcaaatttgcttggttgttgctgtgaaggtgatgagagattgcttgttgcagaatacatgcccaatgatacgctagcgaagcactt

SEQ ID NO: 53550 - protein, 141 aa, Zea mays
  misc_feature: Ceres CLONE 1475201-F
  misc_feature: SWISSPROT Homolog: EC 2.7.11.1 Non-specific serine/threonine protein kinase
MGACVSKAACCCRQPHNGVTNERTDTVTEDEEAYDLPAFQEFTFEQLRLATSGFAVENTPPEQGEKAPNVVYKGKLDAQRRIAVKRFNRSAWPDPRQFLEEARSVGLLRSKRLANLLGCCCEGDERLLVAEYMPNDTLAKH

SEQ ID NO: 53551 - DNA, 861 bp, Zea mays
  misc_feature: Ceres CLONE 1475203-R
  misc_feature (803)..(803): n is a, c, t, g, unknown, or other
cgaattgggtacctcgagcgtctcgtttttttttttttttttactgaatatagcaggctaaaataggataatagaaatgtgtgtacaaatagtagtggtgtctaaaatagctaaaactgactatagcgcctgctataggtgactacatagttttctagagacaaaagaattgggcacactgcaccaaaatatttccccttttcctttatattgggaaacataaataaacaaaaggatgattttttgcttctattgttgatcaagcaagagataaacctcatatttcaaataacattcgagaacatctaaaaacattggaccactttcagcactcttgctcccctcagctccacttttgttagagaagtctttcagttcattctatcaaaagtccggcaggttacactctggaaagtaaagtttcattgggtgacttagttggggtcactccaagtattcaaaaacaagtgcagccagtaacctacccattgcaaattcttgtttgcaccagtagggcgaaaaatggatgcttaaagatataatttgaagaggaatgtattcatgtcaccataaaaatcattgtgcctttcccaagtctgtggcagggatggggctcatgtcaaatacccattatgaggagcactcgcttgctcacagatctccccaaacaagcaagttgaaaggtcagttggggttcctgcttcctccgggagcttgggaaaaatgacagatggtgttctaagatcatccaacctcagggaggggacgggttccggggctaacttgtggaaaagaaatgcaantttgttcacacctctgggcccgggaaagcattttatggccgcgttggaataaccttcc

SEQ ID NO: 53552 - DNA, 646 bp, Zea mays
  misc_feature: Ceres CLONE 1475203-F
  misc_feature: Encodes the peptide sequence at SEQ ID NO. 53553
ggagctccccgcggtggcggccgctctagaactagtggatcccccgggctgcaggaattcgtctcacccctagaaaaagccatagcgcgctcgcctccctcaccgcgcccgcagtccccgctgccgagcagtcctgccgcgccccctcccctgcaaaccccaccacgacgcagcaacagatccaccatcgacgtgcgcgccgcgcgccccgacgcggaacgctggatcccacgcaacaggaggcggccaaccagtcgccatcgcccccggcccccaccccgcctgctgcagcaagcggcgtccgctaccgcacgccctcgtccccggacctcctcctccctgccgacgccgccaagatgcgccgctactccgcgctgcccaacggcggccgccaggagacgctggccgaccgcgcgcaccgctaccggggcatcgtgctcgtcatcctcgccccgctcgcgctcgtctctctcgtcctcctcctcatgccacgctcacccgctggcaccatgggcagcgcccgggatagacagcgagatcgagctcttcgtccaggtacacactcccccgcccggtgacccgttgccggacctggagtcacgctgcctagactcgccgctgggtggattcgtcgaggtggaggtcg

SEQ ID NO: 53553 - protein, 73 aa, Zea mays
  misc_feature: Ceres CLONE 1475203-F
MRRYSALPNGGRQETLADRAHRYRGIVLVILAPLALVSLVLLLMPRSPAGTMGSARDRQRDRALRPGTHSPAR

SEQ ID NO: 53554 - DNA, 660 bp, Zea mays
  misc_feature: Ceres CLONE 1475205-F
  misc_feature: Encodes the peptide sequence at SEQ ID NO. 53555
  misc_feature (660)..(660): n is a, c, t, g, unknown, or other
cgtggatcccccgggctgcaggaattcgtctcacccctagaaaaaacagagcagccacttggatccggtgctcagcggaacagctagctatagcctgtagctagcagctagcttcagtcacaggccggacggtcggctcacacacagctagccgccgccgccgctagcttagccaccagtagtccgatctgatctacaggcaaggggcaactagctagctagccgcgcgccggcgccatgatgaacctgaacctgaagcagcctctggtgctgcccgcgcaccacagcaatgtcgtcggctcgcgcctgtcgtcgtcgtcgccctcggcagtcgccgcccagcaggaggaccggcggtggagtgttcctcccggttaggctcccccgcggcacgtgcggctgccgaggatcagctgcagcgcccccgaggagggcagcggggccgtgtcgtccgtcaccggggagaggatgcttcacggtgacggccgtccggggaggcgtcgcccggcccttcgggcagaatgtactttccagcggcgcccgtcaacaaaaaatcgggcaaccttcctcggcaaagacacctgctggctccaaagcttcgtccggtttctgaggctctgaccccaaaaagttcgggccggtgtggacaaagaaccccgn

SEQ ID NO: 53555 - protein, 46 aa, Zea mays
  misc_feature: Ceres CLONE 1475205-F
MMNLNLKQPLVLPAHHSNVVGSRLSSSSPSAVAAQQEDRRWSVPPG

SEQ ID NO: 53556 - DNA, 649 bp, Zea mays
  misc_feature: Ceres CLONE 1475207-F
  misc_feature: Encodes the peptide sequence at SEQ ID NO. 53557
  misc_feature (649)..(649): n is a, c, t, g, unknown, or other
ggagctccccgcggtggcggccgctctagactagtggatcccccgggctgcaggaattcgtctcacccctagaaaaagcgctctttctctttcctcacgacgccgccgttgggagccctgcttcgggagagccccaacccttatcaaaccctaaatcagaaactacccagaaaaatccgcaaaatccagaaaaaaatcccaaaaatcaccacttgattggagatggcgacgcaagggcaagcggcggctggatccgcgtccgagtccggcggctctccggctgccttagctgcagcagccgcggcggcggccgcgttcccggcgacttcgctctacgtgggtgatctgcacgagagcgtgcaggacgcgcagctcttcgacgttttcaggcaagacggcggcgacgtctccgtgcgcgtctgcagggacatcaactcccgcaagtcgctcgggtacgcctacgtcaactacaacaaccagggcgacgctgcacgagcacttgaactgcttaacttcactcctatcgatggagagcctatcatgatcatgtattctaaccgtgaccctagctcgcgcagaagcgggacaggaaatatatttattaggaatcttgatgagtcaatagacaacaaagctttatatgacacan

SEQ ID NO: 53557 - protein, 142 aa, Zea mays
  misc_feature: Ceres CLONE 1475207-F
  misc_feature (37)..(108): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MATQGQAAAGSASESGGSPAALAAAAAAAAAFPATSLYVGDLHESVQDAQLFDVFRQDGGDVSVRVCRDINSRKSLGYAYVNYNNQGDAARALELLNFTPIDGEPIMIMYSNRDPSSRRSGTGNIFIRNLDESIDNKALYDT

SEQ ID NO: 53558 - DNA, 648 bp, Zea mays
  misc_feature: Ceres CLONE 1475215-F
  misc_feature: Encodes the peptide sequence at SEQ ID NO. 53559
tgtggatcccccgggctgcaggaattcgtctcacccctagaaaaagattcgtcaggctcaatggaattcttttcacgaggaccagtttggaaacattcggggagctgttttcttcagttagcaatgatttgcagattcttctttcgtctggtcttgacgaggaccttaatttcggttctgatgctgcagaaaatgcattggctgctgttaggcttactgtcatccttatattcacagtgcacaatgtaaataaagaacctgataggcagtcttatgctgaaattgtgcaacgcacagtactgctccaaagtgcgtttacggctgcttttgattttgttggacgaattctcagaaggtgttcagagctccatgatattgcatcaaacttctatctgccagccattttggtctatattgaatggctggcgtcccatcccagagttggctgttgattccgacatggaggagaagcatgcaaatgcccaggtctttcttctggaaccaatgcctctcatttatgaataaagtgataccttaccaaccttgcatctgtgaattgatgatgaatgacgagggtttgctttttctaatatggagcattttgggagggaggggtgaaaactgggcaacagggttttgcccttttgg

SEQ ID NO: 53559 - protein, 149 aa, Zea mays
  misc_feature: Ceres CLONE 1475215-F
WIPRAAGIRLTPRKRFVRLNGILFTRTSLETFGELFSSVSNDLQILLSSGLDEDLNFGSDAAENALAAVRLTVILIFTVHNVNKEPDRQSYAEIVQRTVLLQSAFTAAFDFVGRILRRCSELHDIASNFYLPAILVYIEWLASHPRVGC

SEQ ID NO: 53560 - DNA, 658 bp, Zea mays
  misc_feature: Ceres CLONE 1475216-F
  misc_feature: Encodes the peptide sequence at SEQ ID NO. 53561
  misc_feature (394)..(394): n is a, c, t, g, unknown, or other
  misc_feature (396)..(396): n is a, c, t, g, unknown, or other
  misc_feature (399)..(399): n is a, c, t, g, unknown, or other
  misc_feature (404)..(404): n is a, c, t, g, unknown, or other
  misc_feature (405)..(405): n is a, c, t, g, unknown, or other
  misc_feature (469)..(469): n is a, c, t, g, unknown, or other
aagctggagctccccgcggtggcggccgctctagaactagtggatcccccgggctgcaggaattcgtctcacccctagaaaaagccgcagcagtagaaggtagaacaccttcttgacccgaattcaatccgtgcgcacgcaccctccgccggcgacggctcacgcatcgctcggcgcccgccccgcgtccccgagacgacgaccggcagagcgcgccctcgcggcgctacccgacacctgcgacgaaacgccccgagtccactagtcgaggagtgcgtcgacgcaggggctcgggaacgcggtgtcgccatcgcggagccctagcgagatcgtcgggaaggtccgaaggcgagcacgtgtttgtgtaccttttctccccttctccctttgcggncnggncctcnncagcgcgacagtgcccaccaggcggtgggttacgtgagctgaagagtgaggagatgtctggaantccagtcggcgtcgacacacttctaggaggaaatttgacagggagaatactggaaaaaaactcgaccaagggaccaaagggaaagggtgaacctcgaagggcaaggaaagggccctcctgggcaaaaaaagcttggaaccgggggcttgaaattgatctggttccccctttggaaaacccgggggggca

SEQ ID NO: 53561 - protein, 66 aa, Zea mays
  misc_feature: Ceres CLONE 1475216-F
  misc_feature (4)..(4): Xaa is any aa, unknown, or other
MSGXPVGVDTLLGGNLTGRILEKNSTKGPKGKGEPRRARKGPSWAKKAWNRGLEIDLVPPLENPGG

SEQ ID NO: 53562 - DNA, 618 bp, Zea mays
  misc_feature: Ceres CLONE 1475218-F
  misc_feature: Encodes the peptide sequence at SEQ ID NO. 53563
acccgcggtggcggccgctctagaactagtggatcccccgggctgcaggaattcgtctcacccctagaaaaaatctcggtgtcagacgcatacgcacccaggagatacagcgagcgagcgaccaaagccatggctctccgcaccctggcatcgaagaaggtcctatccttcccgttcggcggcgcgggccggccgttggcggcggcggcgtctgcgaggggggtgacgacggtcacactccccgacctctcctacgacttcggcgcgctggaaccggccatctcgggggagatcatgcgcttgcaccaccagaagcaccacgccacctacgtcaccaactacaacaaggcgctggagcagcttgacactgccgtcgccaagggcgacgcctccgctgtcgtccagctgcagggcgccatcaagttcaacggcggcggtcatgtgaaccattcaatcttctggaagaacctcaagcccattagcgaaggtggcggggagccgcctcatgggaaacttggctgggccatcgatgaggattttggttcgtttgaagcacttgtaaagaagatgaatgcagaaggcgctgctttacaagggtctgggatgggtgtggttagc

SEQ ID NO: 53563 - protein, 163 aa, Zea mays
  misc_feature: Ceres CLONE 1475218-F
  misc_feature (34)..(115): Pfam Name: Sod_Fe_N Pfam Description: Iron/manganese superoxide dismutases, alpha-hairpin domain
  misc_feature: SWISSPROT Homolog: EC 1.15.1.1 Superoxide dismutase
MALRTLASKKVLSFPFGGAGRPLAAAASARGVTTVTLPDLSYDFGALEPAISGEIMRLHHQKHHATYVTNYNKALEQLDTAVAKGDASAVVQLQGAIKFNGGGHVNHSIFWKNLKPISEGGGEPPHGKLGWAIDEDFGSFEALVKKMNAEGAALQGSGMGVVS

SEQ ID NO: 53564 - DNA, 527 bp, Zea mays
  misc_feature: Ceres CLONE 1475220-F
gctctagaactagtggatcccccgggctgcaggaattcgtctcacccctagaaaaaactcgcctcgacgcgcctctgaaagttcggagccgccggcccgtccgcctccctctcgcctcccgtccccaagccatagttttcagtggcataggcggacatgctaaccaaccactgtccttcatagctcgtggcagttcacctgcctcgatctctctgaagtgtacgggccgtactatgccatctgctcatctatgaaagaaatggccccaggactactggaccaaagcctgggccctcaggcccgtaaccggggtccagtccccaggagcaaccccccttggtatggccctgttaaaaggggaaaaactcttgatatttctgaagggggggtttcctcctgttttaaaaaggggtgtccccccaaggggggagggctttttttaaaaccaataaaaaaaaaattccggggggtttctaacccccccaaggggtttttgtgccccttcccacaccccctttgggggaagc

SEQ ID NO: 53565 - DNA, 606 bp, Zea mays
  misc_feature: Ceres CLONE 1475224-F
  misc_feature (508)..(508): n is a, c, t, g, unknown, or other
  misc_feature (518)..(518): n is a, c, t, g, unknown, or other
  misc_feature (522)..(522): n is a, c, t, g, unknown, or other
  misc_feature (526)..(526): n is a, c, t, g, unknown, or other
agtggatcccccgggctgcaggaattcgtctcacccctagaaaaaaataaaatcattcctcgatccaaaaactgcttccaagatccatgttcttgggaataagtatcaacataagttgctcgaaataattgacgagtgtgaactgccagaatttcttggtggcaaatgcaattgtattgaaggttgccaaagatctgacaaaggtccttggaaggatcccaacataataaagagagtcctcaatgacgaggcaaactacggcagacaaattgtgaccatatccagcattgatggaaaaataatacgttatgctaggccagatcacccaactagaaaagggagtgatgcatctgccgagtctggatctgaagtggaagatgtaacatctcctactgcatcaaggaacctgattacacatcctattttgacccctggtcacgaagagtcaaaattgtcgccacatggttccacattttgtgctcatgcttctattgaagaaaacattccntgtgtaaacnaggntgtngatgatggaatggggtactcccagaggtagtctccaagcttcttcagggttcgtgcccctcgagaacccgcacggccatt

SEQ ID NO: 53566 - DNA, 656 bp, Zea mays
  misc_feature: Ceres CLONE 1475226-F
  misc_feature: Encodes the peptide sequence at SEQ ID NO. 53567
  misc_feature (496)..(496): n is a, c, t, g, unknown, or other
ggagctccccgcggtggcggccgctctagaactagtggatcccccgggctgcaggaattcgtctcacccctagaaaaaaaagccgcctctcgccgccgactgcaaaccctcgtttttctctctcctgcgctgcgccgtccttcacctccgccgccgaatccgagactctgatctcgggttcaccgcagcgcacagagcacccccgactcccgtcccgatccgcgctctcctctacgacgcttcagtcatggcaggaatggcacccgagggttctcagtttgatgctaagcactatgattctaaaatgcaggagctgctgagcactggtgagactgaggagttcttcacttcatatgatgaagtttttgaaagttttgatgacatgggccttcaagagaatcttgttgagaggcatttatgcatatgggttttgagaaaccatctgcatttcagcagaagagaattgttccctctgcaaggggcttgatgtcattcncaagcacaatctggtacaggaaagacagcaaccttctgttcttggatcttgcaccggcttgactatggcctgggttgatggccggccctggttcttgcccaacccgggaccttggcccgcaattggaaaagttttgccgcccctggggaatacccggggg

SEQ ID NO: 53567 - protein, 79 aa, Zea mays
  misc_feature: Ceres CLONE 1475226-F
MAGMAPEGSQFDAKHYDSKMQELLSTGETEEFFTSYDEVFESFDDMGLQENLVERHLCIWVLRNHLHFSRRELFPLQGA

SEQ ID NO: 53568 - DNA, 687 bp, Zea mays
  misc_feature: Ceres CLONE 1475229-F
  misc_feature: Encodes the peptide sequence at SEQ ID NO. 53569
aagctggagctccccgcggtggcggccgctctagaactagtggatcccccgggctgcaggaattcgtctcacccctagaaaaaatctccagcggattcttccattgctccaactacggaaagaaccgccactcctcgaaatctccaaggattttctgcggcgaagcccttcttgacgtgacacagtgggacatgcctcgccgtcgatcgacaatgacgtcaccgagttgatccggaacacggcgctggtgcacctccacaaggtgaccgatgggtgcgtcggccgcgtcaccgccgagctcgagtccatggagccctgctccagggtcaacgataagattggctacagcatgatcacgcacgcacaggagaaagggctgattactccaggcctgagtgctctgattgaaccaactaacgaggacagcggcattggactggcctttatggctgctgccgatggctacaaacttacactctctatgcctgcctccatgagcatggagaggaggatcatattgaaggcttttggaggtgaaattgtccttactgacacactcctgggaatgaaatgagctgtcaagacagccgaagacatacgagcagagactccctactcgtacatccttcaataatttgaacatccagctaaccagaagattcactatgagactactgcgcctgagat

SEQ ID NO: 53569 - protein, 88 aa, Zea mays
  misc_feature: Ceres CLONE 1475229-F
  misc_feature: SWISSPROT Homolog: EC 2.5.1.47 Cysteine synthase
MEPCSRVNDKIGYSMITHAQEKGLITPGLSALIEPTNEDSGIGLAFMAAADGYKLTLSMPASMSMERRIILKAFGGEIVLTDTLLGMK

SEQ ID NO: 53570 - DNA, 632 bp, Zea mays
  misc_feature: Ceres CLONE 1475230-F
  misc_feature: Encodes the peptide sequence at SEQ ID NO. 53571
tggcggccgctctagaactagtggatcccccgggctgcaggaattcgtctcacccctagaaaaaatcccccacgccacgctctccaacgccacagcttgcgcccgtaatggcactcgtctccgcctcctcgtcctccaccaccgccgtcacggcgctccccaggaatgggcagcgggcgtcgtcctccttcctcggcggcaagacgctgctgagacaggccgaggcggcccggccgtcgttcgccgtgcgcgccgcggcggaccccaacaggccgatctggttccccggcagcacccctccgccgtggctcgacggcagccttcccggcgacttcggctttgatccctggggcctcggatctgacccggagagcctgcggtggaacgtgcacgcggagctggtgcactgccggtgggcgatgctcggcgcggcgggcatcttcatcccggagttcctgaccaagatcggcgtcctcaacacgcccttctggtacaccgccggcgagcagcagtacttcaccgacaccaccaccctcttcatcatcgagctcatcctcatcggctgggccgagggccgccgctgggctgacatcatcaagcccggaagcgtcaacaccgaccccatcttcccc

SEQ ID NO: 53571 - protein, 175 aa, Zea mays
  misc_feature: Ceres CLONE 1475230-F
  misc_feature (63)..(173): Pfam Name: Chloroa_b-bind Pfam Description: Chlorophyll A-B binding protein
MALVSASSSSTTAVTALPRNGQRASSSFLGGKTLLRQAEAARPSFAVRAAADPNRPIWFPGSTPPPWLDGSLPGDFGFDPWGLGSDPESLRWNVHAELVHCRWAMLGAAGIFIPEFLTKIGVLNTPFWYTAGEQQYFTDTTTLFIIELILIGWAEGRRWADIIKPGSVNTDPIFP

SEQ ID NO: 53572 - DNA, 645 bp, Zea mays
  misc_feature: Ceres CLONE 1475233-F
  misc_feature: Encodes the peptide sequence at SEQ ID NO. 53573
tggagctccccgcggtggcggccgctctagaactagtggatcccccgggctgcaggaattcgtctcacccctagaaaaaacttccactcccacccacccacacgcacggccgcaggcagcagcaccatgtggtcggcagcaacggcggcggcggcgcgcgcggtgtccgtgtccccagtcccggcgccttcgctcctcaacggccggcgcggcgggtcgcggggcggccgggggtcggtgtctgtgcgcaacacggtgtgaagacttcgtgggcggcgacctggtgcgaccggacctgggcaagtggctggacgacgtgaataagcacaaggggctggccatctacccaccgcacgaaggcggctacgagggccgctacctgaaccgcctccgttaccagggctactacttcctcgacctctccgcgcgggggctcggcgacccggagaccacgctcaccaaggtccaccccgtctgcccgcctagcctcggcaggcagccggtggcgcggtggtacttcccgccggaagtggactacaggctcagcctgctgcacccagacgccaaaagcctcgtcggctggatcatcgaagacaaggttctgtccaaggctgaactgcagttcctggccatgctcgcggacat

SEQ ID NO: 53573 - protein, 214 aa, Zea mays
  misc_feature: Ceres CLONE 1475233-F
GAPRGGGRSRTSGSPGLQEFVSPLEKTSTPTHPHARPQAAAPCGRQQRRRRRARCPCPQSRRLRSSTAGAAGRGAAGGRCLCATRCEDFVGGDLVRPDLGKWLDDVNKHKGLAIYPPHEGGYEGRYLNRLRYQGYYFLDLSARGLGDPETTLTKVHPVCPPSLGRQPVARWYFPPEVDYRLSLLHPDAKSLVGWIIEDKVLSKAELQFLAMLAD

SEQ ID NO: 53574 - DNA, 668 bp, Zea mays
  misc_feature: Ceres CLONE 1475241-F
  misc_feature (656)..(656): n is a, c, t, g, unknown, or other
acccgcggtggcggccgctctagaactagtggatcccccgggctgcaggaattcgtctcacccctagaaaaactctctccccaccattcagctgccgctgcccccgattgagccgccgccgcctcagattcgccgtcgccacctcagattcgccgccgccgccgccgatttggacgctgtcgccggcgattcagcctccgccgccctggatttggcctccgccgctcccgattcggcgctgccaccctgaaacagcgccgcccctttcccttcccctatgccctatgccctcttgctgcttctcacctaggcgacggggacgccttggatccttcgggcgcctggacgcctaggcgacgcctttaaaacaagggtcttctctgtattaaatattttctgatgtacagtagctaccttgttaattcatgcctccagcatgattctccgttgtgctccatctgtttgttgcttgaccttgcgccttgttattctgccatttggttgaggatagattaatcctcaattgtctgacaattgttcacgtctaatttaggttttttcggcatttgggtttgttcacaagatagctacttttgagaaagcagctggtttccaggcacttatccagtatactgatgccccaactgctcttgaangctaaaactcat

SEQ ID NO: 53575 - DNA, 660 bp, Zea mays
  misc_feature: Ceres CLONE 1475243-F
  misc_feature: Encodes the peptide sequence at SEQ ID NO. 53576
ggagctccccgcggtggcggccgctctagaactagtggatcccccgggctgcaggaattcgtctcacccctagaaaaactcgggcagcttctcccgtgcccctcgcgtgcgctctacgactgggcggccgccggcaccctacaccagttgcccaggtctctgtcttcgggaccttccccggcgacgagcatccaccaggtcattgctgagaaggccgagaagagcgacaccctggaaattcacagcaaagctgatgacgaggacaaacgatgcaagtggtggtgggaagcttccccggaagcgcttctatcgcgccagggcacacagcaacccgctcagcgactcgcacttcccagtcccaatatcgcctgaagaggtcgatctctcacagcactacccgcggtacttccctgctgacaagggcagcgacggtgaggaggctgcagcgccacagcagatccgcttcgccgatgtggggcgcggatttggcgggttgcttgtagggctctcgcctctcttcccagatacgctcatgattggcatggagctcagggacaaggtaacggagtatgtgaaggagaggattttagctctaagaggggcaaacccaggacagtatgataacatatccgttgtccgcacgaactcgatgaaatacat

SEQ ID NO: 53576 - protein, 135 aa, Zea mays
  misc_feature: Ceres CLONE 1475243-F
  misc_feature: SWISSPROT Homolog: EC 2.1.1.33 tRNA (guanine-N(7)-)-methyltransferase
MTRTNDASGGGKLPRKRFYRARAHSNPLSDSHFPVPISPEEVDLSQHYPRYFPADKGSDGEEAAAPQQIRFADVGRGFGGLLVGLSPLFPDTLMIGMELRDKVTEYVKERILALRGANPGQYDNISVVRTNSMKY

SEQ ID NO: 53577 - DNA, 718 bp, Zea mays
  misc_feature: Ceres CLONE 1475258-F
caccgcggtggcggccgctctagaactagtggatcccccgggctgcaggaattcgtctcacccctagaaaaaaacgcgaatcctcaaatctgcccttgccgccgccactgccctatccaggtgtggatactgctccctcctcctctccgctccgaatgggccgcacgaatcatacggagcgcaggtctaccggcggctaggcgccgcggaagcacctggccaccaacgcggcgcgaaagtccgccccggacacgggcggcgtgaagaagcctcaccgcttcctccccggaaccgtagagctccgcgagatacgcacctaccgatattaccacggaagctgctcatccgcaaacttcccttccacgcgcctcgtccagcaaaatcggctcaagactttctaaaagggaccctgccggttccagtactaaggccgctgcccggcgcttgcaagaacccaatgggaacgccttaccggggggggggggttttccaaagacccttaaccctttagctccatttcctccccaaagaggggtaaaactttcctgggccctagggaatttaaaactcccgcctcttttttccgggggcaaaagagggttttggagatttcccccggggcctgcgggtttttacaattcaaagtcccaaaaaaaaatggggggaggggggcctctccggggccggggccaatttgccttttttgggaagggggggg

SEQ ID NO: 53578 - DNA, 636 bp, Zea mays
  misc_feature: Ceres CLONE 1475268-F
  misc_feature: Encodes the peptide sequence at SEQ ID NO. 53579
  misc_feature (576)..(576): n is a, c, t, g, unknown, or other
  misc_feature (577)..(577): n is a, c, t, g, unknown, or other
gctctgacctagtggatcccccgggctgcaggaattcgtctcacccctagaaaactagtttctatcttgctccccaaaccagcgcaaaccctgccctgacaccggcagcgacacgtccaccggcggcgccatggtgctcgaggcaacgatgatctgcatagacaattcggaatggatgcggaacggcgactacgctccgtcgcggttccaggcgcaggccgatgccgtcaacctcatctgcggcgccaagacccagtcaaacccggagaacacggtaggcgtgatgacaatggccgggaagggtgttcgcgtgcttgtcactcccaccagcgacctcgggaagattctcgcctgtatgcacgggttagaagttggcgctgaggcgaacttggctgcggcaatccaggttgcccagcttgctctaaagcatcgccagaaacagaggcagcagcagaagattatagctttcattgggagtcctgtgaagtacgacaagaaagttttggagacattggggaagagctgaaaaagaacatggtgctcttgacatttgtgactttggtgaatccgatgatnngaaacctgaaaaactggaagcattgattgctgctggtaacagcagtgaatacagtccct

SEQ ID NO: 53579 - protein, 131 aa, Zea mays
  misc_feature: Ceres CLONE 1475268-F
MVLEATMICIDNSEWMRNGDYAPSRFQAQADAVNLICGAKTQSNPENTVGVMTMAGKGVRVLVTPTSDLGKILACMHGLEVGAEANLAAAIQVAQLALKHRQKQRQQQKIIAFIGSPVKYDKKVLETLGKS

SEQ ID NO: 53580 - DNA, 656 bp, Zea mays
  misc_feature: Ceres CLONE 1475300-F
  misc_feature: SWISSPROT Homolog: EC 3.2.1.23 Beta-galactosidase
  misc_feature: SWISSPROT Homolog: EC 1.1.1.40 Malate dehydrogenase (oxaloacetate-decarboxylating) (NADP(+))
  misc_feature (181)..(181): n is a, c, t, g, unknown, or other
aagctggagctccccgcggtggcggccgctctagaactagtggatcccccgggctgcaggaattcgtctcacccctagaaaacgacctggtgaaatatgcagagaactgcatgtacactcccgtctaccgcaactaccggtagtgctgcggggatcaattttggcagtataaaatctatcnacgcggatgggactctgttgtttatagtccctgctgctaaccacccttgttgctggtgctgctggagaggcattgtacctgtccatgcatatatgatatatatgttggaacgttgggaaagcaaacaatcttgggtaccaatgtttgctaaaaaaaaaaaaaaaagagacgctcgaggtacccaattcgccctatagtgagtcgtattacgcgcgctcactgagcgtcattttacaacgtcgtgactggaaaaacctggcgttacccaacttatcgcctttagcacatccccctttcagccggtggggtaatagcagggaggcccgcaccgatcgccctttccaacagttgcgcaccctgaatgggccaaatggaattgtaagcgttaatattttgttaaaattcgcggttaattttttgttaaatcagctcatttgttttaacaaattgggccaaaatcgggaaaaatcccttt

SEQ ID NO: 53581 - DNA, 642 bp, Zea mays
  misc_feature: Ceres CLONE 1475305-F
  misc_feature (411)..(411): n is a, c, t, g, unknown, or other
gcggtggcggccgctctagaactagtggatcccccgggctgcaggaattcgtctcacccctagaaaaaaagacacaccgacgcgtacgtagcacagtccattattgccgtctcccttttgcgtgagcaaagaaagagagcgagaagcagtcgccatgtctggcatcttccacaagatcgaggagaagctccacatggggggcgaccactagaataaggaggaggagcaccacatgacggccgaggagcaccacaagaaggagggagggggagcaccacaagaaggacgggggtgagcacaaggaaggcatcgtggagaagatcaaggacaagatcaccggcgagcacggcgacaagtccgggcgacttctgggacgaaaagggcaagaacaacaatggataatatgaagcncggcgaaggccacgaccacgacggcggtcactgtagcagcagcagcgacagcgactgagatctggtgtcgcagcacaggtgcaacacaattatgcttgctggatggatgattctaccagctgatgctgatgtagtggttccctgggtcatgcatgcatgtatcgagcttttataatcaaaaaaaaaaaaagacgagatctcgaggtccaatttcgcctataggggtcttat

SEQ ID NO: 53582 - DNA, 645 bp, Zea mays
  misc_feature: Ceres CLONE 1475310-F
  misc_feature: Translation starting site: 103
  misc_feature: SWISSPROT Homolog: EC 3.2.1.23 Beta-galactosidase
  misc_feature (586)..(586): n is a, c, t, g, unknown, or other
ggagctccccgcggtggcggccgctctagaactagtggatcccccgggctgcaggaattcgtctcacccctagaaaaatcatttaatttttccttttgttgcatgtttaggttggcaaaaagggtacgtaaattattctcctcatcactacaattatcctcatcaccagaggtttcatatttagtggaggattttgattttaccttcttccttttgtcgtcctttgccatgaggcacttgtggccgacgttggggaagagaagtcccttggtgacggcgatgttggcggcgtcctcgtcggaggaagagtcggtggagctctcatcggagtcccattcgtgacacacatgggcatcgccgcccttcttcttgtggtacctcttcttttctctcctcttgcccttcttgtcgttatccctgtcaccgtcactaagatagtggacattttgcaataaagtgaccgggcttaccacaaaaaaaaaaaaaaaaacgagacgctcgaggtacccaattcgccctatagtgagtcgtattacgcgcgctcactgggcgtcgttttacaacgtcgtgactgggaaaaccctgncgttacccacttaaatcgcttgcagcacacccccttttcgcagctggcgtaatagcgaa

SEQ ID NO: 53583 - DNA, 634 bp, Zea mays
  misc_feature: Ceres CLONE 1475313-F
  misc_feature: Translation starting site: 199
  misc_feature: SWISSPROT Homolog: EC 3.2.1.23 Beta-galactosidase
gcggtggcggccgctctagaactagtggatcccccgggctgcaggaattcgtctcacccctagaaaaagtaacttccgagtcggcgtgctaattcctgcggtgtcaacatctggatccgcacggcgagtgctgtgctgtgctgcgctgtatctttctgtcaggcacttgttttttggtcggtaaaaatcagatgcctgatgttgtatcatgtaaaaaacccctaccgacgtgtgctgctgatctgcctcgcaagatctgttgggagggtgaattgccactcggttctacccgccgcctatgtactctactcagggatttgtatatcaatccattattctttcggctgttggaaaagaaaaaaaaaaacaagacgctcgaggtacccaattcgccctatagtgagtcggattacgcgcgctcactggccgtcgttttacaacgtcgtgactggtagaaccctggcgttacccaacttaatcgacttgcagcacatccccctttcgtcagctggcgtaatatcgaacaggcccgcgctgatcgcccttccccaactgtgcgcagcctgaatggcgaatgaaaattgcaaccgttaatattttgtaaaaatcgcgttcagttctagttaactcgctt

SEQ ID NO: 53584 - DNA, 644 bp, Zea mays
  misc_feature: Ceres CLONE 1475326-F
  misc_feature (198)..(198): n is a, c, t, g, unknown, or other
  misc_feature (199)..(199): n is a, c, t, g, unknown, or other
  misc_feature (282)..(282): n is a, c, t, g, unknown, or other
tccccgcggtggcggccgctctagaactagtggatcccccgggctgcaggaattcgtctcacccctagaaaaaggacctgcattatatgatatgacgaatacgaaaggcactcaagtacttgtttgccgtctatgccaatgttttacctatatgacggcatcatggattcagatacctgagatgaggttgtgcttganncgccgaaagatgaggcagagatccaagtaggctgatgcgggtcgctcgatgtacccactacgccctatagtgactcatattanacgcgctcactgtccgtcatttatccacgtcgtgactgcgacaaccctgtctgtacccaacttaatcgccttgcaggaaatcctgcctttcgccaggtgatgtaatagcggataggccctcaccgatagcccttcccaaaaatggctcagcctgaatggctaatgacatttgaagacgtaacattttgttaaaatacacctaaattcttgttaatcagctcatttttttaacgatacgccgaatcggcaaattcccttattagcaaaacgaataaccgagataggtttgagtgttgtaccagtttgaacaggagtccactcttgaagaaccgcgactccaacggcaagggcaataacccttt

SEQ ID NO: 53585 - DNA, 608 bp, Zea mays
  misc_feature: Ceres CLONE 1475346-F
  misc_feature: Encodes the peptide sequence at SEQ ID NO. 53586
  misc_feature (341)..(341): n is a, c, t, g, unknown, or other
  misc_feature (342)..(342): n is a, c, t, g, unknown, or other
  misc_feature (455)..(455): n is a, c, t, g, unknown, or other
  misc_feature (504)..(504): n is a, c, t, g, unknown, or other
aagctggagctccccgcggtggcggccgctctagaactagtggatcccccgggctgcaggaattcgtctcacccctagaaaaaacttactaggattcccctattaacggcgagcgaacctggagcatcccatcttgagaatagggcggcctctccgcccgaattgtagtctggagaggcgtcctctgcgacggaccgggcccaagttctctggtaaggcacgcctgttagggtgagagccccgatccgccaggaccctgtcgcaccacgaggcgccttcaacgagtcgggttgtttgagaatcgcacactcatgcgggcggaaagtcggtccaaggctaanngaagaaatccatctgagagtctcgaggtacgaaatcgcgctatagagaacatattacgcacgctcctaggcgtcgatttacgacatcgtgactgagagaaccatggcataaanaaggtaaatcggcgtgcaggaaatcccccctttcgacaggtgggcctantgacaaagacgcccccaacaggtcgccttttccaaaaatttgggaaggcctgaattgccaaatgggaaattggtcccctggattcttttggtaaaagtcccggt

SEQ ID NO: 53586 - protein, 41 aa, Zea mays
  misc_feature: Ceres CLONE 1475346-F
  misc_feature (10)..(10): Xaa is any aa, unknown, or other
  misc_feature (11)..(11): Xaa is any aa, unknown, or other
MRAESRSKAXXRNPSESLEVRNRAIENILRTLLGVDLRHRD

SEQ ID NO: 53587 - DNA, 643 bp, Zea mays
  misc_feature: Ceres CLONE 1475355-F
  misc_feature: SWISSPROT Homolog: EC 3.2.1.23 Beta-galactosidase
  misc_feature (382)..(382): n is a, c, t, g, unknown, or other
  misc_feature (643)..(643): n is a, c, t, g, unknown, or other
aagctggagctccccgcggtggcggccgctctagaactagtggatcccccgggctgcaggaattcgtctcacccctagaaaaaacaccgtacctccggcgccccctccgacaccggtcctccggcctgcgcaggctagctagctctatataccaccgtgcctccgccgcgcaggcaggggagatccaagggtccgagcaaaaggccggcggcggcgagccagccagccagctaaagcgatcaatatatacatatatactatcgagcaacaaaaaaaaaaaaaaaaacgagacgctcgaggtacccaattcgccctatagtgagtcgtattacgcgcgctcactggccgtcgttttacaacgtcgtgactgggaaaaccctgncgttacccaacttaatcgccttgcagcacatccccctttcgccagctggcgtaatagcgaagaggcccgcaccgatcgcccttcccccacagtgcgcagcctgaatggcgaatggaaattgtaagcgttaatattttgttaaaatccgcgttaaatttttgttaaatcactcatttttttaaccataggccgaaatcgggaaaatcccttataatcaaaagatagaccgaatagggttgagtgttgttccagttgggaacn

SEQ ID NO: 53588 - DNA, 618 bp, Zea mays
  misc_feature: Ceres CLONE 1475358-F
  misc_feature: Encodes the peptide sequence at SEQ ID NO. 53589
  misc_feature (340)..(340): n is a, c, t, g, unknown, or other
aagctggagctccccgcggtggcggccgctctagaactagtggatcccccgggctgcaggaattcgtctcacccctagaaaaaaaagcgaaaggagagaaggaatccgatccatccaagccaagccaaggcagagaagaagaagaagaggaggaagaagaagcatcggcagcatgtcggaggggactgccaactgcgtggacatcctgatcgccatcatcctggctccgctgggggtgttcctcaagtacgggtgcggccacgagttctggatctgcctcctcctcaccttcctcggctacatccccggcatcatctacgccatctacgccatcaccaangaacactagctagtcatccttgccgacgacgatccatgtctctgtatctgcgtctgttcatatgcctgatgccgacttgtgctgtatgtagttgcttgaatacaggcgtgttttgctaccgtacccaccccatgcatcatctgtccacgcgacgcaatattcatagtaatacccagttcagagattgattcaaaaaaaaaaaaaaaacgagacgctccgaggtcccaattcccccctataggggaggcgtattacccccccctcctgggccgtctttt

SEQ ID NO: 53589 - protein, 58 aa, Zea mays
  misc_feature: Ceres CLONE 1475358-F
  misc_feature (6)..(56): Pfam Name: UPF0057 Pfam Description: Uncharacterized protein family UPF0057
  misc_feature (56)..(56): Xaa is any aa, unknown, or other
MSEGTANCVDILIAIILAPLGVFLKYGCGHEFWICLLLTFLGYIPGIIYAIYAITXEH

SEQ ID NO: 53590 - DNA, 753 bp, Zea mays
  misc_feature: Ceres CLONE 1475365-F
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (753)..(753): n is a, c, t, g, unknown, or other
aactggagctccccgcggtggcggccgctctagaactagtggatcccccgggctgcaggaattcgtctcacccctagaaaaacctccgaatttactgatccatccatctccatccccatcccgtgacccgtgcacgccgccgcttcaagtcctaacaagccgcatcgcatcgcatggcgtgtgctgtccgaccgccatctcggaggcggctgggctagctacctcacctcacctcaggcaggcacactgcacacacacccatggtgggtgggggcaatgcggcgggccccgggcccccggggggggggaccggggatccaactcggggtggcttaaactcccttcctcaacaaggccagactggccccccgctacctcgacccccggggagggcccggnnnttgaccccccaaacagccccttggttgccccaaaacccccccggggccttgcacacgcttcaaaacgggggtggggggttttggaaaaatcccctccgcggggggcgcccccgaattctttggggggagaggccgcctaaggaaaacgggggcggcggggttcgcgcgcgcccacgggggttttgcccgcatgtggcggccagggcggggtggtgcgcgacagggacgaggggcctcagaagaaacccggtgctccgccgggggccccgccgtggcggggtgcggcaagagcgggggtgccgcagcggggcgcaatggcggaggggccgcctgtcccctccgtggggggggn

SEQ ID NO: 53591 - DNA, 551 bp, Zea mays
  misc_feature: Ceres CLONE 1475366-F
  misc_feature: Encodes the peptide sequence at SEQ ID NO. 53592
ggcggccgctctagaactagtggatcccccgggctgcaggaattcgtctcacccctagaaaaaagaggagaaaagcgggggcggcaagcaaccacgggcggagctcggagcgtcctcctcctcccgtctataaattcccctccttttcttcctccatatataggggccatcagatccaagaagagggaagagcaccaaggaccttcggcgcccgttcaggatccacatcttcccgagcgagttcttggttgacctcttcctcttcggaccacctcccaaggctcttggtgtagcttgccactctcacaaatcaagttttcatgtctgatctcgacattcagatcccaactgcctttcgatcccttcgctgaggccaatgctggggactctggtgccgcaccagggtcaaaggacttacctacacgtgcgcatccagcagcgtaatggtcgcaagaccctgactaccgtccaggggattgaaaaaggagttcacctcccgcaagatcctcaaaaatccccagaaaaaattctgctgcaatggaacagggggc

SEQ ID NO: 53592 - protein, 58 aa, Zea mays
  misc_feature: Ceres CLONE 1475366-F
MLGTLVPHQGQRTYLHVRIQQRNGRKTLTTVQGIEKGVHLPQDPQKSPEKILLQWNRG

SEQ ID NO: 53593 - DNA, 678 bp, Zea mays
  misc_feature: Ceres CLONE 1475369-F
  misc_feature: Encodes the peptide sequence at SEQ ID NO. 53594
  misc_feature (678)..(678): n is a, c, t, g, unknown, or other
ggagctccccgcggtggcggccgctctagaactagtggatcccccgggctgcaggaattcgtctcacccctagaaaaaacacacccaacatcacgaaaccacgcgcagatccaaacgaacccgagcccttccaaaccctaagctcgcctcccctcccccccaaacaccaccgcgcacctatggcgaagtacggcgagggcgacaagcggtggatcgtggaggagcgcgccaacggcaccaacgtccacaactggcactgggcggagcgcgactgcctggagtggtcccgcgcgcggctctcttccctgctcgcgggcctcaccatcctcgacggcgagggcgggctcagtctccgcaccgtcgcgctcgacaagcttgatggcaaggcctacgtcaacatcccgaaggggcaagtccatcccggggtacgagctctcccctcaccctctcctgggagggcgaggcccgcttcggagtccgggagctgcaaagggcaccggcaccgctaaggttccctacctcccccaaagaaaaccgccgacaaggacccccgacctccggggtcaccggggcgggggggacaaaacgcccctttggggttcgggggaaagggaccccttccttctccccgggggaaaccccatgggtgcctccaaaaaaaacccgggaagttccccn

SEQ ID NO: 53594 - protein, 109 aa, Zea mays
  misc_feature: Ceres CLONE 1475369-F
MAKYGEGDKRWIVEERANGTNVHNWHWAERDCLEWSRARLSSLLAGLTILDGEGGLSLRTVALDKLDGKAYVNIPKGQVHPGVRALPSPSPGRARPASESGSCKGHRHR

SEQ ID NO: 53595 - DNA, 662 bp, Zea mays
  misc_feature: Ceres CLONE 1475370-F
  misc_feature: Encodes the peptide sequence at SEQ ID NO. 53596
  misc_feature (216)..(216): n is a, c, t, g, unknown, or other
  misc_feature (283)..(283): n is a, c, t, g, unknown, or other
  misc_feature (383)..(383): n is a, c, t, g, unknown, or other
gctccccgcggtggcggccgctctagaactagtggatcccccgggctgcaggaattcgtctcacccctagaaaaaaaacagtaggcaactaagacaaagtggcatactcttctctgtactagctttcttcttcctctcctcttcctcacaaacagactggatttcaacaagataatcctgaaactggagccaacaagcacacagagaaagaagagncagaagaccggctccccagccgatacaaggtaggagtgagcagcgttagtttcatcatatcgcatangcgatatggtgacagtgagagaagagactcgcagggggccatggacagagcaggaagacctgcaactggtatgcactgtccgtccgttcggtgaacgtcnttgggatttcatggccaaagtatcaggactcaaccggacaggcaaaagctgccggctgcggtgggtcaactaccctcaccctggcctcaagcgtgggcgcatgtctccccatgaagacgcctcatcctttacctgccgcctcgggggggaaacaggtggcccaagataccacggccctttgccaggcccccctgacaatgagatcaagaacttcctggaggaaccccctgaagaaaaaaaccccgggaaagaagaaggaacttgtctccctcctcctcc

SEQ ID NO: 53596 - protein, 124 aa, Zea mays
  misc_feature: Ceres CLONE 1475370-F
  misc_feature (10)..(57): Pfam Name: Myb_DNA-binding Pfam Description: Myb-like DNA-binding domain
  misc_feature: The sequence is a functional homolog of SEQ ID NO 176 in the 10/412,699 US patent application
  misc_feature: The sequence is a functional homolog of SEQ ID NO 385 in the 11/479,226 US patent application
  misc_feature (32)..(32): Xaa is any aa, unknown, or other
MVTVREETRRGPWTEQEDLQLVCTVRPFGERXWDFMAKVSGLNRTGKSCRLRWVNYPHPGLKRGRMSPHEDASSFTCRLGGETGGPRYHGPLPGPPDNEIKNFLEEPPEEKNPGKEEGTCLPPP

SEQ ID NO: 53597 - DNA, 672 bp, Zea mays
  misc_feature: Ceres CLONE 1475371-F
  misc_feature: Translation starting site: 198
acccgcggtggcggccgctctagaactagtggatcccccgggctgcaggaattcgtctcacccctagaaaaaacactgagaaccgcagagacaggcgtcttcgtactcgcctatctccgcgacccagagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaaacaccttcttcagtgagactgggcgctggaaaacacctccccccgtgctggtttttgttgacctttaaccccactgtcatcgaatgaggtgagggactggcaccttatcgccaggttctttccatcctgaggagacttcatcggggggaagggagggattgcacccaaacaacttccctccgggggccacttacaccattggcaaaggagatattgtttaacttggtcctttaacccccataaggaaagctttgcaaataaattgcgctggggcccccaaggggctttccctcctttttcaaaggtttgttggggggaagaaaccg

SEQ ID NO: 53598 - DNA, 671 bp, Zea mays
  misc_feature: Ceres CLONE 1475373-F
  misc_feature: Encodes the peptide sequence at SEQ ID NO. 53599
  misc_feature (410)..(410): n is a, c, t, g, unknown, or other
  misc_feature (411)..(411): n is a, c, t, g, unknown, or other
  misc_feature (420)..(420): n is a, c, t, g, unknown, or other
  misc_feature (423)..(423): n is a, c, t, g, unknown, or other
  misc_feature (446)..(446): n is a, c, t, g, unknown, or other
  misc_feature (452)..(452): n is a, c, t, g, unknown, or other
  misc_feature (472)..(472): n is a, c, t, g, unknown, or other
  misc_feature (526)..(526): n is a, c, t, g, unknown, or other
  misc_feature (533)..(533): n is a, c, t, g, unknown, or other
aagctggagctccccgcggtggcggccgctctagaactagtggatcccccgggctgcaggaattcgtctcacccctagaaaaaggagcctgccgaggccaggatatagaggcgttgccgggccgggccactgcacggtcggcggatatggctgtcgaagcgcacagcctcctcttagcaggagggcacaagcaattcaccagcgcgggatggccttggacgaccggcgacgaagctagatgcgcgacggcgcgaccgagccagcagcaggcgttccagctccagcaggcctcgtgtgtgggcgtgggcctgccgctggcggctccgatctcgtcggccgcggcggcgccaccagcgccgatgatagcgcagcagtacgctgctggcggacggctgttcgtgggagacgcnngcgagagcngcntcacgttcggaggaagaagtgcngtgcancaggaggcgccccggaagcngaagcgcgccgagcaggggcagacgccgcccgcggttcttggggacgggcgcgnccgacgntggcggcgcaagtttcaacagcagctcgtcgacgtcgaaccgtctcgtcctccaaacacaccgccaagatgtggggcggggctcaccgagcaggcggcggcggcacgcccccggaagtccgtgcccaaccgtggaggg

SEQ ID NO: 53599 - protein, 175 aa, Zea mays
  misc_feature: Ceres CLONE 1475373-F
  misc_feature (89)..(89): Xaa is any aa, unknown, or other
  misc_feature (92)..(92): Xaa is any aa, unknown, or other
  misc_feature (93)..(93): Xaa is any aa, unknown, or other
  misc_feature (102)..(102): Xaa is any aa, unknown, or other
  misc_feature (109)..(109): Xaa is any aa, unknown, or other
  misc_feature (127)..(127): Xaa is any aa, unknown, or other
MAVEAHSLLLAGGHKQFTSAGWPWTTGDEARCATARPSQQQAFQLQQASCVGVGLPLAAPISSAAAAPPAPMIAQQYAAGGRLFVGDAXESXXTFGGRSAVXQEAPRKXKRAEQGQTPPAVLGDGRXRRWRRKFQQQLVDVEPSRPPNTPPRCGAGLTEQAAAARPRKSVPNRGG

SEQ ID NO: 53600 - DNA, 648 bp, Zea mays
  misc_feature: Ceres CLONE 1475375-F
  misc_feature: Encodes the peptide sequence at SEQ ID NO. 53601
  misc_feature (412)..(412): n is a, c, t, g, unknown, or other
  misc_feature (436)..(436): n is a, c, t, g, unknown, or other
ccccgcggtggcggccgctctagaactagtggatcccccgggctgcaggaattcgtctcacccctagaaaaaaccacctccgccagccactccaaacacttgcgccgccactgcctcacaggtaaggccgccatggtctccggttcgggcgtgtgcgcgaagcgcatcgtggtggacgcgcgccacacatgctgggccgtctctcctcgatcatagccaaggagctgctcaatgggcagaaagtggtcgtcgtccgctgcgaggagatctgcatgtcgggcggcctcgtccgtcagaagatgaagtacctccgcttcctccgcaagcggatgaacaccaagccgtcccacgggcccatccacttccgcgccccccgcaagatcctgtggcgcaccatccgcgggatgatccngcacaagaccaagaggggggagcngctctggcgaggctcaagacgtacgagggcgtcccgccgccgtacgacaagacaagcgtatggtcatccctgacgctcttaagggtctgaagctacagcctggacacaagtactgcctcctcggcgagctctctaaggagtcgggtgggaactaccatgaccccttcagggaccttgaggagaagaggaaggagagggcctaggtttcccta

SEQ ID NO: 53601 - protein, 106 aa, Zea mays
  misc_feature: Ceres CLONE 1475375-F
  misc_feature (1)..(95): Pfam Name: Ribosomal_L13 Pfam Description: Ribosomal protein L13
  misc_feature (75)..(75): Xaa is any aa, unknown, or other
  misc_feature (83)..(83): Xaa is any aa, unknown, or other
MLGRLSSIIAKELLNGQKVVVVRCEEICMSGGLVRQKMKYLRFLRKRMNTKPSHGPIHFRAPRKILWRTIRGMIXHKTKRGEXLWRGSRRTRASRRRTTRQAYGHP

SEQ ID NO: 53602 - DNA, 1561 bp, Zea mays
  misc_feature: Ceres CLONE 1475381
  misc_feature: Encodes the peptide sequence at SEQ ID NO. 53603
aatctggccatctccccttcccctgctcccccgaagcagcaagccagcctgcccacccgcagccatcacctccgccgctctccaccatgaatcccatccaccagcacggcatcgtacccaatccttcgtgactgttgcctccgcgcatctccgggagcaatggaaggaggccgagatgtgttcttaggtgcggcggcaagggcgccgccgccgccgccgtcttgcccgtttcacggatccgctaccgccacccgctccggtggagcgcagatgctcagcttctcctccaatggcgtagcagggttgggtctgtgctcaggtgccagcaagatgcagggtgtgttgtcgagggtgaggaggcccttcactccgacgcagtggatggagctggagcaccaggccctgatctacaagcacttcgctgtgaatgcccctgtgccgtccagcttgctcctccctatcaaaagaagcctcaatccatggagcagccttggctccagctcattgggatgggcaccatttcgttccggctctgctgatgcagaaccaggaagatgccgccgcacagatggcaagaagtggcggtgctctagagatgctgtcggggaccaaaaatactgtgagcgacacataaaacgtggttgccaccgttcaagaaagcatgtggaaggccgaaaggcaacaccgaccactgcagatccaaccatggctgtttctggtggttcattgttgcacagccatgctgttgcttggcagcagcagggcaaaagctcagctgctaatgtgactgatccattctcactagggtccaacaggaatttgctggataagcagaatctaggtgaccagttctctgtatccacttccatggactcctttgacttctcatcatcacattcttccccaaaccaagccaaagttgcattttcaccggtggccatgcagcacgaacatgatcagctgtatcttgtgcatggagccggcagctcagcagaaaacgttaacaagtctcaggatggtcagctgctagtctcgagggaaacaattgacgacggacctctgggcgaggtgttcaagggcaagagttgccagtcagcatccgcagacatcttaactgaccattggacttcgactcgtgacttgcgtcctccaaccggagtcctacaaatgtctagcagcaacacagtgccagcagagaatcacacgagtaacagtagctatctcatggcgaggatggcgaattctcagaccgtcccaacactccactgagtgttcatcaggctggtctttgttgggaccacaaaataactgaagccatgttgatgtcctgagtttgctgatactaggttttcagtcgagtcttgtaactcctgttttagagctgttatatgttcacgtcatgtcgcctttcattttcggttcattcagatgggtgttctaataatttctttccttcttacctgtgaaggatttgagttccaatctgagacgtgggtttgttctaacttggaggtatttatgaatattaggcacttctgatttccaaaaaaaaaaaaaaaaa

SEQ ID NO: 53603 - protein, 369 aa, Zea mays
  misc_feature: Ceres CLONE 1475381
  misc_feature (127)..(172): Pfam Name: WRC Pfam Description: WRC
  misc_feature (67)..(103): Pfam Name: QLQ Pfam Description: QLQ
MEGGRDVFLGAAARAPPPPPSCPFHGSATATRSGGAQMLSFSSNGVAGLGLCSGASKMQGVLSRVRRPFTPTQWMELEHQALIYKHFAVNAPVPSSLLLPIKRSLNPWSSLGSSSLGWAPFRSGSADAEPGRCRRTDGKKWRCSRDAVGDQKYCERHIKRGCHRSRKHVEGRKATPTTADPTMAVSGGSLLHSHAVAWQQQGKSSAANVTDPFSLGSNRNLLDKQNLGDQFSVSTSMDSFDFSSSHSSPNQAKVAFSPVAMQHEHDQLYLVHGAGSSAENVNKSQDGQLLVSRETIDDGPLGEVFKGKSCQSASADILTDHWTSTRDLRPPTGVLQMSSSNTVPAENHTSNSSYLMARMANSQTVPTLH

SEQ ID NO: 53604 - DNA, 648 bp, Zea mays
  misc_feature: Ceres CLONE 1475383-F
  misc_feature: Translation starting site: 435
  misc_feature (499)..(499): n is a, c, t, g, unknown, or other
ctccccgcggtggcggccgctctagaactagtggatcccccgggctgcaggaattcgtctcacccctagaaaaaaccaccggcgagccacatcgagaacacgatcgagcacacacaagcacgaagactcgtttaggagaaaccacaaaccaccaatcggtgcaagcatcatggagtacggtcagcaggggcagcgcggccacggcgccactggccatgtcgaccagtacggcaacccagtcggcggcgtcgagcacggcaccggcggcatgaggcacggcacgggaaccgccggcggcatgggccagctgggtgagcacggcggcgctggcatgggtggcgggcagttccagcctgcgagggaggagcacaagaccggcggcatcctgcatcgctccggcagctccagctccagctcgtcggaggacgaacggcatgggcggaaggaggaagaagggaatcaaggagaagatcaaggagaagctgcccggaggccacanggacgaccagcacgccacggcgacgaccggcggcgcctacgggcagcagggacacaccggcagcgcctacgggcagcagggacacaccggcggctcctacgccaccggcaccgagggcaccggcgagaagaaaagcattatggacagat

SEQ ID NO: 53605 - DNA, 690 bp, Zea mays
  misc_feature: Ceres CLONE 1475385-F
  misc_feature: SWISSPROT Homolog: EC 3.2.1.21 Beta-glucosidase
  misc_feature (387)..(387): n is a, c, t, g, unknown, or other
ccccgcggtggcggccgctctagaactagtggatcccccgggctgcaggaattcgtctcacccctagaaaaatgtgcacttcggcgacgtcgtgaagaactggtttaccttcaacgagccacaaacattctcatctttttcctacggaaccgggatctgtgccccaggacgatgctccccaggacagaaatgtgctaacccagttgggaactcactcaccgagccgtacattgttggccacaacctcctccgagctcatgctgagactgtccatcagtacaacaagtactacggaggtaacaaggaaggccacatagggatgggggtttgacttgatgggtcgtggtgctctatggaacacgaggtggtgggggggagggggcccangaaaaggtcccttcaaactaaaaacccccccccggtttcgggggagcccggggggccgcggggggaacaaccccctttctcctatgaagatcgggggggcaagggaatggggtggcccctccttcccccgcacaaaaaagaaggaaaaagctgaggggggtcactaatgaccgtgaaggggggaaaaatcggagggcggcgtcgggggtccgcggagcacgcgggaaatggcgggcggggcttacccgccggccctcacggcaggaggggggtcgttggggccgcggggagacgccagggggc

SEQ ID NO: 53606 - DNA, 644 bp, Zea mays
  misc_feature: Ceres CLONE 1475389-F
  misc_feature: Translation starting site: 290
  misc_feature: SWISSPROT Homolog: EC 3.6.3.14 H(+)-transporting two-sector ATPase
  misc_feature (470)..(470): n is a, c, t, g, unknown, or other
  misc_feature (593)..(593): n is a, c, t, g, unknown, or other
ccccgcggtggcggccgctctagaactagtggatcccccgggctgcaggaattcgtctcacccctagaaaaagagggggaataaaatcccagcggcttcccccaaacaaaacctcttctccgccagagtccgcgtcggccagatcaaacgaatcggcacgacgcatcggcatcgcctccgacgatcttgagacaaacaaaacccaccgctgcggcaactccgcctcccgctgacacggggatcgcctgacaacaggcagagaaaagaggcgcagggtttgcccgcgaagatggaggacgtggacgtctcgcggcagctgaagcagatgacgaacttcatccgccaggaggccgtcgagaaggccgccgagatcgaggccgccgccgccgaggagtccaaatagaaaagttgcagctggtggaagctgaaaagagaagatcaggcagggatatgaccggaaagagaagcangttggcatcaagaagaaaattgattactcgatgcagctcaatgcttccagaattaaagtccttcaaggtcaggatgatttgggtacagatatgtgggagtcagcaagcaaagaactactgtgncatagtagagatcaccccacttacaagaagctcctcaagacacttagggtt

SEQ ID NO: 53607 - DNA, 671 bp, Zea mays
  misc_feature: Ceres CLONE 1475390-F
  misc_feature: Translation starting site: 383
  misc_feature: SWISSPROT Homolog: EC 6.1.1.16 Cysteine--tRNA ligase
  misc_feature (512)..(512): n is a, c, t, g, unknown, or other
aactggagctccccgcggtggcggccgctctagaactagtggatcccccgggctgcaggaattcgtctcacccctagaaaaaaccccctcacactcccatccagccgccaccaggtgcagagtctttcgtcatctcttctccggcgaagaacccccagtcgcccaccagatcacttgttaaactttgttgaggggtgatgggcggtttctttcgcaaacctcaactccgaggcagggctttaaaagcttgatgagtaccttctcactcgcagctacatcactggctaccaagcttccgaggatgacttggctgtctacacttcgttttcggctgctccctcgtccaagtatatcaacgtaggcaagtggtttaaccacattgatgccctcgggaggcttacccgaattactgcagaggggcaagggggggaaggtgaaatcctcagcagttccttcagccccaactccagatggtgctgaagcacaggccccagttgctgaggaggaccacnacgatgatggttgcccttttttggggaggaaaccaaaaatgagaaaaaagggtgcttaaagaacgttgcttcaatctgccaagggtttcttgcaaaaaaaaaagaatctggggaaaccctccattttttactttgaggggaaaccccttgggaacgatt

SEQ ID NO: 53608 - DNA, 1162 bp, Zea mays
  misc_feature: Ceres CLONE 1475393
  misc_feature: Encodes the peptide sequence at SEQ ID NO. 53609
agcgcccccaattcccgctccccacgcacccagagacacgccgagcgggagaggaagcgacagccagcagccgaggcggccagcgccagcgcaggcatgaccactcccactcccagtggcgacggctcgcccccgggctcctccgacctcgtgcccccttcctaccccgagatgatcgtcgccgcgatcaccgccctcgccgaggagaacggctccagccaggccgccatcgcgcgccgcatcgaggcgcaggcccgcggcgacctgccggcctcgcacccggcgctcgtcgccgcccacctctcgcgcatgtccgccgcaggggagctcgtcgccgtcgcgggggggaagtacgcgctgcccccgccgccggcgcagccggcgccggagtcaccggctgacgacggcgaagacgacgacgacgacgacgactgcgccgacgaggtggacgagggagaggaggcgccggagcctctgcccgtgcctgtgccgcagccgcccgccaagcgcgggcgtgggaggcccccgaagccgcggcccgcgggcttccccatcggcgtccccggagccgccgcgtcccccgccgccgcgccgcggcggcgcggccgccctcccaagccgcgtgacccgcacgcgccgcccaagatcccgcgcccgcgcggccggccgcgcaagaacccgctcccggaggggatggccccgcgcccgcgccccggcgtgccggcgtcggccaaggcagcgcgcccgcagttcgccgaggtcggattcgtgtgacgcgaggggctctcacccgccggccggccagggggccgcggcgagctggcgcaagctaacattctgcccctgtttcagctcttgtctgtctgatgtgggtctcgtctcagttcgtgtgttgctgtctaatccggggagggtaggggggcaggaatatgaatggaggcaacttaggcggtgctggtcgccggtgtgttgttgtctgtgtagtctctacgttagtattggtgggtggtggccggagtggtgtggctccggcggtgtatcccgtgtctcctcgccgcgctcgcgcaatccaatgcagttgtctgatcgtttcaaaaaaaaaaaaaaaaaaaaaaaaaaaaaaaaaaaaaaaaaaaaaaaaaaataaaaaaaaaaaaaaaaa

SEQ ID NO: 53609 - protein, 225 aa, Zea mays
  misc_feature: Ceres CLONE 1475393
  misc_feature (21)..(90): Pfam Name: Linker_histone Pfam Description: linker histone H1 and H5 family
MTTPTPSGDGSPPGSSDLVPPSYPEMIVAAITALAEENGSSQAAIARRIEAQARGDLPASHPALVAAHLSRMSAAGELVAVAGGKYALPPPPAQPAPESPADDGEDDDDDDDCADEVDEGEEAPEPLPVPVPQPPAKRGRGRPPKPRPAGFPIGVPGAAASPAAAPRRRGRPPKPRDPHAPPKIPRPRGRPRKNPLPEGMAPRPRPGVPASAKAARPQFAEVGFV

SEQ ID NO: 53610 - DNA, 665 bp, Zea mays
  misc_feature: Ceres CLONE 1475396-F
gctctagaactagtggatcccccgggctgcaggaattcgtctcacccctagaaaaaacaatggccggttccggtgccaacgacgatgatgtcatcttcgagatggttcagttcatcctcgtctacaacagcgggcgagaggagtgctacttctgctccgaccccatctcggcctcacacagacacctccacgggctgctcctctaaggacagcgccgtctccccagacgtcgccgtctgcctctacctcccgccgcgcccctagggatacggaagactacctgcggaaccagtaataagcttccaattcctcgtgtacttccacgggggggggggtttctgcctccaaacggggttgaaccagggccttccacgcctaccttgaattccttggggggcccccccccgcccccatggtgggctcccttcaaataaccgccttccgggcccaaagctaccccgttccccgcccacggtaagaaatactccttggggggggcgcttccctctgggggcgggaatccccctcctatgtggatcccggggggagaaactcctgggtttcccccaaccaggggggaacttcctcccccgtttgggagcgctcggggggcggaaagccccgaggggcccaaaatactcccgcatccgaaaaggggggggtgc

SEQ ID NO: 53611 - DNA, 661 bp, Zea mays
  misc_feature: Ceres CLONE 1475397-F
  misc_feature: Encodes the peptide sequence at SEQ ID NO. 53612
tccccgcggtggcggccgctctagaactagtggatcccccgggctgcaggaattcgtctcacccctagaaaagatccgttcgggccgtccaccacagcgagagagagcggcagaggcgcagagcgcaaccgagcgagagagagaggacggcgacggcggagatgatggggtggggagaggaggtggtggctctgtccctgcgaggctacggctatggcatcgaggaggacgaccggccggagaagccgcggcggtacggggtgacggagatgcggagccccttctactccttccgccccgcaaaccaggcgctccaggaaatattggattctcttagtccattcgttgatggtttgaagttctctggcggatgccatagtttgatgggaaaagagttggttagagagatcactgatctagcacaccggcatgacatttatgtgagcacaggtgattgggcagagcatttgctgccccaaggaccctcttctttaagctatatgtagaggaatgggagggctttagggtttgacacatttgagctgattgctggggtctctcaacctccctgaaaaggttctgttgagacctcccccccctccttaagggtggtggtttttagggccaagccaatgtttttcggggaagttttgcctttttt

SEQ ID NO: 53612 - protein, 114 aa, Zea mays
  misc_feature: Ceres CLONE 1475397-F
MMGWGEEVVALSLRGYGYGIEEDDRPEKPRRYGVTEMRSPFYSFRPANQALQEILDSLSPFVDGLKFSGGCHSLMGKELVREITDLAHRHDIYVSTGDWAEHLLPQGPSSLSYM

SEQ ID NO: 53613 - DNA, 660 bp, Zea mays
  misc_feature: Ceres CLONE 1475402-F
  misc_feature: Translation starting site: 239
aaagctggagctccccgcggtggcggccgctctagaactagtggatcccccgggctgcaggaattcgtctcacccctagaaaaaagggagttttcttctcccgtccaccttgcgtgctcgcgcgcgagctctcgtggcgcagccacaactaggcgaccgccgccgcccctacgccacgtgctcgagtctagcctcgtcgattgcttccccagtttaattgatctacaagcttcagaacatgttcaagaatacatttcagtctgggttcctgtccattctttatagcctcgggaccaagccattgcagatatgggataaggaagttgtgaatgggcacattaaacgaccccaagatgaagatatccaatctaatgtacttgaaatttgtggaacaatgtacagtcaacttacatcacatgcccagctgatccttctgctactctggggattaagcttccatttctggctattattgtgaaaaatcttaagaaatacttcacgtttgagatccaagttctggatgacaagaatgtccgacgtcaatttcgagcatcaaattttcaatctgtcacaagggtgaagccatatatctgcacaatgcccgtgaaactcgacgatggctgggaacacatccagttgaactttggtgatctgacaaaa

SEQ ID NO: 53614 - DNA, 657 bp, Zea mays
  misc_feature: Ceres CLONE 1475407-F
  misc_feature: Encodes the peptide sequence at SEQ ID NO. 53615
  misc_feature (566)..(566): n is a, c, t, g, unknown, or other
  misc_feature (641)..(641): n is a, c, t, g, unknown, or other
  misc_feature (642)..(642): n is a, c, t, g, unknown, or other
  misc_feature (652)..(652): n is a, c, t, g, unknown, or other
ctccccgcggtggcggccgctctagaactagtggatcccccgggctgcaggaattcgtctcacccctagaaaaatctaaggaactggccacataggaacattcaagttatctgtgttactgatggtgagcgaatcttgggacttggagacttgggttgtcagggaatgggaattcctgtaggcaaacttgctctatacactgctcttggaggagttgacccatcagtttgcttgcctatcacaattgatgttggtacaaataacgagaaactgcttaatgatgagttctacattggactccggcaaaaacgtgcgactggcgaggagtatgatgagcttattgaagagttcatgtctgctgttaagcaattctatggtgagaaagtcctcattcagtttgaggactttgccaatcataatgcctttgatttgcttgaaaatatagcaagagccatcttgttttcaatgatgatatccagggcacagcatcagtggtcctttgcaggttgttagcagcactcaagatgggtgggtggacccctgcagagcagacttatttgtccttnggtgctggggaagctggaactggtattgcagaacttattgctcttgagatttcgaaacagacgaatgctccattnngagagtgccngcaga

SEQ ID NO: 53615 - protein, 115 aa, Zea mays
  misc_feature: Ceres CLONE 1475407-F
  misc_feature (1)..(95): Pfam Name: malic Pfam Description: Malic enzyme, N-terminal domain
  misc_feature: SWISSPROT Homolog: EC 1.1.1.40 Malate dehydrogenase (oxaloacetate-decarboxylating) (NADP(+))
MGIPVGKLALYTALGGVDPSVCLPITIDVGTNNEKLLNDEFYIGLRQKRATGEEYDELIEEFMSAVKQFYGEKVLIQFEDFANHNAFDLLENIARAILFSMMISRAQHQWSFAGC

SEQ ID NO: 53616 - DNA, 630 bp, Zea mays
  misc_feature: Ceres CLONE 1475408-F
  misc_feature: Encodes the peptide sequence at SEQ ID NO. 53617
  misc_feature (350)..(350): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (480)..(480): n is a, c, t, g, unknown, or other
  misc_feature (481)..(481): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (630)..(630): n is a, c, t, g, unknown, or other
aagctggagctccccgcggtggcggccgctctagaactagtggatcccccgggctgcaggaattcgtctcacccctagaaaaaagcgcccgcgcaggctcgctgcaagcgcaaagcagccacagcaccccctgcacctgcagactgcaaccgcaatgtcggctctcgggacgctctccggcggcgctgccggtgtctccggcctcctccgcctccgccgccgggccgccccagcccccgcgatcgcggcgccgtcgcacctccccgctgggaccgtcaagtgcgcggccgccgtgcccgatgccgccccgatcgtctggggccgtcagctccgcccggcgctcctcctanccgcggcgctgctccccttcgttgcagcccgccaggaggcacacgctgcagccgcccgccgcagccgccgagtccgcaggggaggccaagtctgtgggtttcctggagaaagtaccggccnnntgtcacnngctctnnnctctcatgtggtacttccctcacgtcatattcaacatcctcaaacagaagatctacaactacttcccatatccatactttgtgtccttgatccatctaggagtgggtgtcgtatactgcctcatcagctggagtgtcggcn

SEQ ID NO: 53617 - protein, 110 aa, Zea mays
  misc_feature: Ceres CLONE 1475408-F
  misc_feature (17)..(17): Xaa is any aa, unknown, or other
  misc_feature (58)..(58): Xaa is any aa, unknown, or other
  misc_feature (61)..(61): Xaa is any aa, unknown, or other
  misc_feature (63)..(63): Xaa is any aa, unknown, or other
  misc_feature (64)..(64): Xaa is any aa, unknown, or other
MPPRSSGAVSSARRSSXPRRCSPSLQPARRHTLQPPAAAAESAGEAKSVGFLEKVPAXCHXLXXLMWYFPHVIFNILKQKIYNYFPYPYFVSLIHLGVGVVYCLISWSVG

SEQ ID NO: 53618 - DNA, 658 bp, Zea mays
  misc_feature: Ceres CLONE 1475410-F
  misc_feature: Encodes the peptide sequence at SEQ ID NO. 53619
  misc_feature (408)..(408): n is a, c, t, g, unknown, or other
ctccccgcggtggcggccgctctagaactagtggatcccccgggctgcaggaattcgtctcacccctagaaaaacctctagcccgacaggtgaagccgccgccgctgcagtgtccatagccaccgcaggagactgagatggggggttttgtcaagacccacaagagcaatgcatacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatatctgctagtatagcaggtgatatggttcttgcttctgcttactcgcatgagttgccacgatatggtctcgaangtggtctgaccaactatgcagctgcctactgcactgggcttctgtgggctcggcgtgtgctcaagacccgtggttaaattaggaaatttagggcaatgttgaggcccctggtaaggacttccctgtttaccccctaaagaaaggagcccttcccggcccccttggaggtggccttataagaccacaacgggaaacctggtttttgggccccaaagggaactttgaggggggcctgaaatttccccccgga

SEQ ID NO: 53619 - protein, 115 aa, Zea mays
  misc_feature: Ceres CLONE 1475410-F
  misc_feature (27)..(112): Pfam Name: Ribosomal_L18p Pfam Description: Ribosomal L18p/L5e family
  misc_feature (91)..(91): Xaa is any aa, unknown, or other
MGGFVKTHKSNAYFKRFQVKFKRRRAGKTDYRARIRLINQDKNKYNTPKYRFVVRFTNKDITAQIISASIAGDMVLASAYSHELPRYGLEXGLTNYAAAYCTGLLWARRVLKTRG

SEQ ID NO: 53620 - DNA, 657 bp, Zea mays
  misc_feature: Ceres CLONE 1475411-F
  misc_feature: Encodes the peptide sequence at SEQ ID NO. 53621
  misc_feature (451)..(451): n is a, c, t, g, unknown, or other
ggagctccccgcggtggcggccgctctagaactagtggatcccccgggctgcaggaattcgtctcacccctagaaaaacacacactccacagcgcccgcgcaggctcgctgcaagcgcaaagcagccacagcaccccctgcacctgcagactgcaaccgcaatgtcggctctcgggacgctctccggcggcgctgccggtgtctccggcctcctccgcctccgccgccgggccgccccagcccccgcgatcgcggcgccgtcgcacctccccgctgggaccgtcaagtgcgcggccgccgtgcccgatgccgccccgatcgtctggggccgtcagctccgcccggcgctcctccctaccgcggcgctgctccccttcgtgcagcccgcccagaggcacacgctgcagccgcccgccgcagccgccgagtccgcaggggaggccaagtctgntggtttcctggagaagtacccggccctggtcacgggcttcttctttctcatgtggtacttcctcaacgtcatattcaacatcctcaacaagaagatctacaactacttcccatatccatactttgtgtccttgatccatctagaagtggggtgtcgtatactggctcatcagctggagtgtcggtctccccaagcaagcgcctata

SEQ ID NO: 53621 - protein, 165 aa, Zea mays
  misc_feature: Ceres CLONE 1475411-F
  misc_feature (97)..(97): Xaa is any aa, unknown, or other
MSALGTLSGGAAGVSGLLRLRRRAAPAPAIAAPSHLPAGTVKCAAAVPDAAPIVWGRQLRPALLPTAALLPFVQPAQRHTLQPPAAAAESAGEAKSXGFLEKYPALVTGFFFLMWYFLNVIFNILNKKIYNYFPYPYFVSLIHLEVGCRILAHQLECRSPQASAY

SEQ ID NO: 53622 - DNA, 647 bp, Zea mays
  misc_feature: Ceres CLONE 1475412-F
  misc_feature (320)..(320): n is a, c, t, g, unknown, or other
acccgcggtggcggccgctctagaactagtggatcccccgggctgcaggaattcgtctcacccctagaaaaagcgttcggtggtgactccgggctccgggcgccctgcgcccctggatttcgaaccgagaaagaaagctgctgcccaccgtttcccaagtcccatcgccgcccaagaaccggagccacgccgcagatccgccaaatcacacctcctagcccgtcctccgtcccatctcttctcgggccagggaggcggcgggacttggtgcctgcatccgagccctagacatggatcaacctgagggaaacccctgattncccaagctgtgatggctactttgaagctatccagtccaagaagaagttgccactgactttgcaagaatcactaactggtgcctttgctcaaatccagtctcatccttccctgaggttccagcttggcgagtaatggaaatccctggggatacttctgtgtattgaggctgaagggctctctctgaacaaaacataggggcagccccagttctgagatccgaacctggggctccttatggatgggggggggagggccctttggggtcatccatttcctcgggaatcctccttttggggtacttagaaaaatgggggggcttggttgct

SEQ ID NO: 53623 - DNA, 630 bp, Zea mays
  misc_feature: Ceres CLONE 1475413-F
  misc_feature (356)..(356): n is a, c, t, g, unknown, or other
  misc_feature (396)..(396): n is a, c, t, g, unknown, or other
  misc_feature (425)..(425): n is a, c, t, g, unknown, or other
  misc_feature (550)..(550): n is a, c, t, g, unknown, or other
ctccccgcggtggcggccgctctagaactagtggatcccccgggctgcaggaattcgtctcacccctagaaaacccccttccctctcttccgcctccgattgagtggctcaccttctttcccagccagcacgagcttgcaagcaagcgagctcctgagatttcagctcgcttctcctccagaggtcgagcagaccagactcctccgaccgaagctctaccacttcccagttagcctgtccaggaactgcttggccggagatccaaacaaacctctgtgttggggttctccggggttccttgcgctggagggagggttcgttctcgctggccatggtttggctgagaagcagcagcngcagcatcttgatgccaaatctctgagctttatgaagatncgcactcacctgcgccgctcctgcttccntcactccttctcgggtgtcttcctctactggttttatgtgatctcataacttgccctcccccggatccgccattccccggtgccctctctccgtcccctcaaccttctccctcctttcttgcttnccctcacatcggcaaatacagcactagcggcagcggtagaggatcttttcgaggtagctagggcggctgttccctgcgga

SEQ ID NO: 53624 - DNA, 648 bp, Zea mays
  misc_feature: Ceres CLONE 1475414-F
  misc_feature: Encodes the peptide sequence at SEQ ID NO. 53625
  misc_feature (385)..(385): n is a, c, t, g, unknown, or other
  misc_feature (415)..(415): n is a, c, t, g, unknown, or other
  misc_feature (504)..(504): n is a, c, t, g, unknown, or other
  misc_feature (546)..(546): n is a, c, t, g, unknown, or other
ctccccgcggtggcggccgctctagaactagtggatcccccgggctgcaggaattcgtctcacccctagaaaaagcttgggctttcccgaaccctaaccccgaccgccgcgccagctactcccgtttcgtcctcgcggtattcgcggcgttttctcccactgctcgaaccgcgccgacgagcgacgacaagagctgctctattcttcaaaacaaatggcgaccgttccagttaacccaaaaccttttctgaacaacctgacaggaaagcctgttattgtcaaactcaagtggggtatggagtacaagggttatcttgcttctgtggactcatatatgaatctccagcttagccacactgaggagtacattgatggtcaattctcntggaaccctggagagattctgatcaggtgncacaacgtcatgtatctccgagggcgtcccagagatgcagagatagaggatgcagagtgagaaagatgcgatcatgttagattgataantgtaatatgggtctgacatctatgttcgaatatgccggtgancagtagatctatcggatcgcttttgtctcttgagtgatgaaacatgatggcggtcgggctaagggtgaagctgcttttcagtagactatgctgtcattctgc

SEQ ID NO: 53625 - protein, 86 aa, Zea mays
  misc_feature: Ceres CLONE 1475414-F
  misc_feature (10)..(75): Pfam Name: LSM Pfam Description: LSM domain
  misc_feature (67)..(67): Xaa is any aa, unknown, or other
MATVPVNPKPFLNNLTGKPVIVKLKWGMEYKGYLASVDSYMNLQLSHTEEYIDGQFSWNPGEILIRXHNVMYLRGRPRDAEIEDAE

SEQ ID NO: 53626 - DNA, 638 bp, Zea mays
  misc_feature: Ceres CLONE 1475416-F
  misc_feature: Translation starting site: 125
  misc_feature (254)..(254): n is a, c, t, g, unknown, or other
  misc_feature (315)..(315): n is a, c, t, g, unknown, or other
  misc_feature (399)..(399): n is a, c, t, g, unknown, or other
  misc_feature (465)..(465): n is a, c, t, g, unknown, or other
  misc_feature (496)..(496): n is a, c, t, g, unknown, or other
ggccgctctagaactagtggatcccccgggctgcaggaattcgtctcacccctagaaaaaatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgcccttcggcgagcccgcgtgacgatgcgcaagacggcgggggaaggccaagccggcngcggcgtccgggagccccgtgtacggccccgaccgcgtgctgtacctgggcccactgtccnggcgagccgccgagctacctgacgggcgagttcccgggcgactacggctgggacaccgcggggctgtcggcggacccggaaacnttcgcaagaaacgggagctggaggtgatccactcccgctggggcatgctgggcgccctcggttgcntcttcccggagctgctcccccccaacgggcntcaagttcggggagggccttgtggtttcaaggcccgctcccaaatcttcagcggggggggaactggactacttcgggaaacccaacctcatcccaccccaaaacatcctcccccatctgggccctgccagggccttgcttat

SEQ ID NO: 53627 - DNA, 745 bp, Zea mays
  misc_feature: Ceres CLONE 1475418-F
  misc_feature: Encodes the peptide sequence at SEQ ID NO. 53628
  misc_feature (360)..(360): n is a, c, t, g, unknown, or other
  misc_feature (367)..(367): n is a, c, t, g, unknown, or other
  misc_feature (368)..(368): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
aagctggagctccccgcggtggcggccgctctagaactagtggatcccccgggctgcaggaattcgtctcacccctagaaaaaacattttgtgggagatggttgcgagctcggataccagcctgaaaataaatgctgcggctctactgagagcacttgtaccctacacggatgtgaaaatagcatcaactcatattttgccagcacttgttacccttggctctgatcaaaacttgaaagtaaaatatgccagtatagatgcatttggagctgttgctcagcatttcaaaaatgacatggttgttgacaaaatacgcattcaaatggatgcttttcttgaagatggatcacatgaagcttnctgttcnntgtatcgtgcacttgcagtagctgtacctcattcaacagataggctacgtgaatatctttttatccagaatattaagatgacatgcatcacacttgttcgcaatgatattgaacggcttcttgaaaaccaaatgcactctgggaagcctcccgggtttggaagctacaaatcctctggctaaggggaaaccggatttgctttgcccaaaacaaaacttttaaaaattggatcccaaccccggccaaggggttttaaacttacccgaaaggcgggggcctcaaaatttaaagaaagggggccttgggttcccctgccttttggaaaccccaaaaagggaaaccgcttcaccccaagtaagccnnnnnnnnnnnnnnnn

SEQ ID NO: 53628 - protein, 150 aa, Zea mays
  misc_feature: Ceres CLONE 1475418-F
  misc_feature (27)..(63): Pfam Name: HEAT Pfam Description: HEAT repeat
  misc_feature (88)..(88): Xaa is any aa, unknown, or other
  misc_feature (91)..(91): Xaa is any aa, unknown, or other
MVASSDTSLKINAAALLRALVPYTDVKIASTHILPALVTLGSDQNLKVKYASIDAFGAVAQHFKNDMVVDKIRIQMDAFLEDGSHEAXCSXYRALAVAVPHSTDRLREYLFIQNIKMTCITLVRNDIERLLENQMHSGKPPGFGSYKSSG

SEQ ID NO: 53629 - DNA, 682 bp, Zea mays
  misc_feature: Ceres CLONE 1475427-F
  misc_feature: Encodes the peptide sequence at SEQ ID NO. 53630
  misc_feature (198)..(198): n is a, c, t, g, unknown, or other
  misc_feature (199)..(199): n is a, c, t, g, unknown, or other
  misc_feature (210)..(210): n is a, c, t, g, unknown, or other
aaagctggagctccccgcggtggcggccgctctagaactagtggatcccccgggctgcaggaattcgtctcacccctagaaaaaacaaacagcgccgcgctccgcattgcgctagggttttagaactcttcctccggtcctccccgttatccctccaaaaggcagcgcccgctagggttttagcccgcgcctcttccnntctcctctcangtctcctcacagccgctgccacccggagccttcccgcagcgacgccatgtgggctcttcgccgagctggcaacccctcaggttccgtgcccaaaaagttgcaagtgcccatgtctgtgcgagtcttgaggtgctgctagctgctgatgcaaagaatgtagaagagcaccatgaggcagactgccaaaaaatgtgctgctgtcataaaccaggtcacccagcctttcattgtcattttcatctgggcagtttgctttcagtaaggggtttctcctctcacgccaggtggcaaattctgggtgacaaagttgatgagtttagaaggacggatttttctgatttccgaggttccccccagcaggttggtcaaaaacgaatgacgggggtggcgcttcctaaaaataattttctaaagaagggatgcccccctgaccaaattttggcttttcccccgaatgtgggaatgccaaaat

SEQ ID NO: 53630 - protein, 30 aa, Zea mays
  misc_feature: Ceres CLONE 1475427-F
MWALRRAGNPSGSVPKKLQVPMSVRVLRCC

SEQ ID NO: 53631 - DNA, 704 bp, Zea mays
  misc_feature: Ceres CLONE 1475443-F
  misc_feature: Encodes the peptide sequence at SEQ ID NO. 53632
  misc_feature (418)..(418): n is a, c, t, g, unknown, or other
  misc_feature (449)..(449): n is a, c, t, g, unknown, or other
aagctggagctccccgcggtggcggccgctctagaactagtggatcccccgggctgcaggaattcgtctcacccctagaaaaaacacgcgaatcctcaaatctgcccttgccgccgccactgcccgatccaggtgtgcagactgctccctcctcctctccgctccgaatggcccgcacgaagcagacggcgcgcaagtcgaccggcggcaaggcgccgcggaagcagctggccaccaaggcggcgcgcaagtcggccccggccacgggcggcgtgaagaagccgcaccgcttccgccccggcaccgtcgcgctccgcgagatccgcaagtaccagaagagcacggagctgctcatcccgcagctccccttccagcgcctcgtccgcgagatcgcgcaggactttcagacggacctgcngttccagtcctcggccgtggcggcgctgcangaagccgcggaagcgtacctggtggggctcttcgaggacaccaactcttggccatccacggcaaagagggtcacatcatgcccaaggacatccagctccccccgccgaatcagggggcaagagggcttgaacttgccccgctcctcctttccccctttgaaagctcaaagaaaaggggggggggggcttttcaaggccggcccatttgggctttttcggaccggttggttcccttaagggaaaatggaaaccctt

SEQ ID NO: 53632 - protein, 172 aa, Zea mays
  misc_feature: Ceres CLONE 1475443-F
  misc_feature (58)..(132): Pfam Name: Histone Pfam Description: Core histone H2A/H2B/H3/H4
  misc_feature (84)..(84): Xaa is any aa, unknown, or other
  misc_feature (94)..(94): Xaa is any aa, unknown, or other
MARTKQTARKSTGGKAPRKQLATKAARKSAPATGGVKKPHRFRPGTVALREIRKYQKSTELLIPQLPFQRLVREIAQDFQTDLXFQSSAVAALXEAAEAYLVGLFEDTNSWPSTAKRVTSCPRTSSSPRRIRGQEGLNLPRSSFPPLKAQRKGGGGLFKAGPFGLFRTGWFP

SEQ ID NO: 53633 - DNA, 659 bp, Zea mays
  misc_feature: Ceres CLONE 1475448-F
  misc_feature: Translation starting site: 193
  misc_feature: SWISSPROT Homolog: EC 2.7.11.24 Mitogen-activated protein kinase
  misc_feature (659)..(659): n is a, c, t, g, unknown, or other
tggagctccccgcggtggcggccgctctagaactagtggatcccccgggctgcaggaattcgtctcacccctagaaaaagcgtccgctcctctcctctcccctacccgtctccttgtcgtccttgcctgcggattggggcggcacagcctctcgcttctcccgcgcgcgagccctttctccgcggccgcggcatgacgatgccggaggcgaatgcctctgcgacggcgcagaggaagaagaactcaccagagatggagttcttcagcgagtacggcgatgccaacaggtacaagatccaggagatcattggcaaagggagctacggggttgtctgttcggctatcgaccaacatacgggcgagaaggtagccatcaagaagatacagaacatcttcgagcacctgtccgatgctgctaggatcctccgcgagatcaaagcttctccggctgctgaggcaccccgatatcgtcgagatcaaacacgttatgctgcctccgtcgaggagggactacagagatatttacgttgtgtttgagctgatggataccgatctttccaccagttattagggctaacgatgacttgacgaaggaacaccaccagttctttctctatcagatgctgcgtgcattgaaatatatcatactgctaacggtn

SEQ ID NO: 53634 - DNA, 647 bp, Zea mays
  misc_feature: Ceres CLONE 1475458-F
  misc_feature: Encodes the peptide sequence at SEQ ID NO. 53635
  misc_feature (204)..(204): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (518)..(518): n is a, c, t, g, unknown, or other
  misc_feature (520)..(520): n is a, c, t, g, unknown, or other
  misc_feature (607)..(607): n is a, c, t, g, unknown, or other
agagctggagctccccgcggtggcggccgctctagaactagtggatcccccgggctgcaggaattcgtctcacccctagaaaactccaaaccctagcccagagcagccgcatcgaactctacctgcctttctctcgtccctggcggcggcggcaggatggcggcttctactgcgaggacggtgaaggatgtgaaccccacgagnttgtcaaggctactccgcccatctcaaacgctccggcaagatggagcttcctgagtgggtgacattgtgaagactgcgagggtcaaggagctccctccttatgaccctgactggtactacatcagggctgcatctgtagcaaggaagatctacttgagacaagccattggtgttggtggctccaaaaaatttatggttgcccccaaggaatccctcacccccacctcacttctgcaagagcaggggttgcatttcaacgaaaatcttcaacaactggaggagatgggcatcatttgatgtccccatnnnnnngngnggcaggggggaaaagaaaaaaaagcggtgcggggggggggtggtgggtctgccacggagaccgcgaagaaaccactaggcaaaggtngtgcgcggtgaggtatggtgggccggccgggggggggggc

SEQ ID NO: 53635 - protein, 33 aa, Zea mays
  misc_feature: Ceres CLONE 1475458-F
  misc_feature (16)..(16): Xaa is any aa, unknown, or other
MAASTARTVKDVNPTXLSRLLRPSQTLRQDGAS

SEQ ID NO: 53636 - DNA, 682 bp, Zea mays
  misc_feature: Ceres CLONE 1475460-F
  misc_feature (1)..(1): n is a, c, t, g, unknown, or other
  misc_feature (77)..(77): n is a, c, t, g, unknown, or other
  misc_feature (385)..(385): n is a, c, t, g, unknown, or other
  misc_feature (386)..(386): n is a, c, t, g, unknown, or other
ncaggctgggactcacgcggtggcggccgctctagactagtggatccccgggctgcaggaattctctcacccctagnaaaagctctccaccaagagcttgtacccacaccactaggcactagtccactacctaacgctacctgccttttcaccgcgtcgtgcgtaccgcacgttgagctcgcgtccgtccagatccgcctgctcctcatcgctcgcgaaaatgaaatcacggtgcgggggtcggaaatgtgtacccggcggcgaaactcctcgccgccgctctggaactcgggccccaccttgtggtggccgcgttccccagcgcccaggggtatttttttttttttcccccccccccgggggggggggggggggggccccaccnnaactttctccccccccccggggggggggggggcgtgggccgaagcccttggggccccttccccccaaggggcgggcccggttggcccccaacaggggtggggccgccccaaagccaactggcccgccgggtggggggggctctcccggggggggcgccgcgccccggaggcgcgcgggggggcgcgtcgggggccggccgcgccccgcccgggtggcgcccacagggggcgcctgccgcgccggggatatgggggcgggggcggggcgggggggtcgcgcggagccccgcccggcg

SEQ ID NO: 53637 - DNA, 623 bp, Zea mays
  misc_feature: Ceres CLONE 1475461-F
  misc_feature (311)..(311): n is a, c, t, g, unknown, or other
  misc_feature (312)..(312): n is a, c, t, g, unknown, or other
  misc_feature (356)..(356): n is a, c, t, g, unknown, or other
ctccccgcggtggcggccgctctagaatagtggatcccccgggctgcaggaattcgtctcacccctagaaaaatactaatggagtctaagggtggcaaaagtctagcagtagtcgttccatgatgtatgaagctccccttgctacagcattgaggacgttcgacctgccggaggcgtgagaagtccagtctgctgcttactccactgcgcgaagaagcatcctgatatcccttttggcttcctcattctagtagtttaggatttcttttctgacactttgatttctgaccatctctctgggctgctgcttnnctgatatcgaccagtccccagtctttgctcttgcactcctcccntctcatcgtcagcattggtgtctgattcactgctccatgggctgtcttctgctgctgatgcttcccggtctcagctatcgggtttgagggctatgagaagcgcttgagtcacattctctgaggcacctgtctttgtgaccctcatgggtgtgttttcgtgccctctcaggggccagattgactctgtcctgatctggcacgggacaatccgtgtccacttctccaacaggattccactcatatgtcctttctgaatcaagcttggtt

SEQ ID NO: 53638 - DNA, 705 bp, Zea mays
  misc_feature: Ceres CLONE 1475463-F
aaagctggagctccccgcggtggcggccgctctagaactagtggatcccccgggctgcaggaattcgtctcacccctagaaaaaatcaccaaacaagcaagctagctggtcaccagttgttaacatatacatcagcaagctccacgaaagcaagaagaagaagaaacatgacgaccactgctgcggtcgtcaagctcctgacagccgtactcctcttcttcgccgtctctcttcggggtacgtaaggcctgcaaatcgacctgctcgttgtgcaaactttgtcagtagggcatgtttgcgtagtgcacgaaatttcgacaaattctgagacgatttagttcgcttaaatttgaattaagcgccgtaaacacatgcatccaagaacatattgtacatataatctgtagacattattctttgcattggtacccagtacccctaattattgatcatatattcttgaaaggttccagcatttgttaattacgtactgagcaacaggtaccaagggcgagccatgcggcacgtccagcatccacgtgcagaccgtcaacacgggcgcgacggcggctgccggcgacacgctgttcgaggtccaggtgaaaaacctgtgcttatgcagcgtcaggaacgtgcgcgtggacggtggcggctttctcgacgacggtggaagtcgaccccggccttgtttcgcccagtggacgg

SEQ ID NO: 53639 - DNA, 643 bp, Zea mays
  misc_feature: Ceres CLONE 1475466-F
  misc_feature: Encodes the peptide sequence at SEQ ID NO. 53640
  misc_feature (278)..(278): n is a, c, t, g, unknown, or other
  misc_feature (281)..(281): n is a, c, t, g, unknown, or other
ctccccgcggtggcggccgctctagaactagtggatcccccgggctgcaggaattcgtctcacccctagaaaaagccgctcgtcctcggcatcggcacacggtgccatcactctcccactcactcacactgtctcgctcgcttgctcacccaccaatggcgagtcctcctcgctacccgttccccgtcctcctcctcggcctcgcgctggtggcgttgacggcgccggcgctactgcgagcagatggcggcgccggcgaggaggaggaggcgcggaanacntacatcttccgcgtggacacagcgccaagccgtccgtgttccccaccacgcgcactggtacgcctccgccgcgttcgcctcggcggcaccgggggccaccccgctgcggccgctccacgtctacggcaccgtcttccacggcttctccgcgtccgtgccggcgtcccgcgccgaggagctgcggcgccacccggccgtgctcgccgcgttcgaggaacgcggccgcccgcttcacaccacccgggcgcgcaagtcatgggcctcggcgcgcgcctcgggctctgggccctcgcggactacggctcccaagtcatcgtcggggtgcttcacattggcgtctgggccaaggcgccccaccttgc

SEQ ID NO: 53640 - protein, 133 aa, Zea mays
  misc_feature: Ceres CLONE 1475466-F
  misc_feature (26)..(91): Pfam Name: Subtilisin_N Pfam Description: Subtilisin N-terminal Region
  misc_feature (12)..(12): Xaa is any aa, unknown, or other
  misc_feature (13)..(13): Xaa is any aa, unknown, or other
MAAPARRRRRGXXTSSAWTQRQAVRVPHHAHWYASAAFASAAPGATPLRPLHVYGTVFHGFSASVPASRAEELRRHPAVLAAFEERGRPLHTTRARKSWASARASGSGPSRTTAPKSSSGCFTLASGPRRPTL

SEQ ID NO: 53641 - DNA, 665 bp, Zea mays
  misc_feature: Ceres CLONE 1475467-F
  misc_feature: Encodes the peptide sequence at SEQ ID NO. 53642
  misc_feature (229)..(229): n is a, c, t, g, unknown, or other
  misc_feature (231)..(231): n is a, c, t, g, unknown, or other
tggagctccccgcggtggcggccgctctagaactagtggatcccccgggctgcaggaattcgtctcacccctagaaaaaaatggcgtactcctcgcggccttgtggtcggtgcaacaaccacgagaggagatccggtttcatgaagtggctctgcaatttcctcaaggggccgaaagccggggagccgaaccgccggcggcccaggtgacggccggagaggaggagacncnctttggcacaacgaccagttcgaccgaagatgatccccctgaaatgacaacgaagaagtggaccgtgcaattgcagagtctctcacagaggacgtcagaacccccaaagaaaaaacccgcagggggagacaaggacgaacaaaatcttgctagggccatacagggacgcctcaacataaccccttacacgccttacaccccctatgctccctctcacgcccaacctaagagggacagggtgggccacaggctccaaccataaaaaagggcatggccctttacttgggcctggtggggattttactggcacccttagggggttccgctggaaactcctgggggcccccttttccgggagaacccgagggtttgaatcctccccccccccccccccccctttattttcaaggttacgggggttaaaaataaaaaaa

SEQ ID NO: 53642 - protein, 42 aa, Zea mays
  misc_feature: Ceres CLONE 1475467-F
MAYSSRPCGRCNNHERRSGFMKWLCNFLKGPKAGEPNRRRPR

SEQ ID NO: 53643 - DNA, 733 bp, Zea mays
  misc_feature: Ceres CLONE 1475482-F
tccccgcggtggcggccgctctagaactagtggatcccccgggctgcaggaattcgtctcacccctagaaaaaacaaagacgtagctaccccctcccgcgtccgtcgaattcgcctccgccgcctgctcgatccgggggggaattcgccgctgccgggttgttttcgctggggtgattaaggctcggattcaagatctaccgagtcccgggcaaccgccctgagcgaggtttcgagggttacaagcgcaatactgggaggcctccccttcttctcccgaaaggcacccgctccctccccctccatggggagaaagaggaagaaaaacctgtcccaaatcccttccggggtttaaggaaacttaaattccttaattcgaaaaaagggcccttgaaggcaaagaaaacctacccccccccccgttaagggggtggtttttctttccaaaagcttaaaggggatttataaatttttaaccctccaaaaaacgggggaaggaggtgagctttaaagaaagaatccctccccccccccaattggcttagcggcagggctcccccggggagaggaaccctcccggagggtttgggaaaagtgttttaaattcccccccgcggggtgtcctcacctagatcggagggggggggtaattttatataatccaacccctgtgaaagaactgggatctcggtccaacttgaaaaaaaattataaagaaaagccccaaaatattt

SEQ ID NO: 53644 - DNA, 664 bp, Zea mays
  misc_feature: Ceres CLONE 1475485-F
  misc_feature: Encodes the peptide sequence at SEQ ID NO. 53645
  misc_feature (664)..(664): n is a, c, t, g, unknown, or other
aaagctggagctccccgcggtggcggccgctctagaactagtggatcccccgggctgcaggaattcgtctcacccctagaaaaaaccgagagtggcagtggagtagtggtaggaaaagctcgtcgccgagtcgccgtacgggggctcggctcgggtgagcgagcggcggccggcgggtactgaggcctgagggcgaggcgatgggccgcctccgtgacgggcgagccttcctccaccgcgcgcttgtcctctcgtcgctgctccttctcgcctccggcgaaatcttcttcgaggaacggttcgatgattcagaatttcagtttgttgtttgagtgagctgttcactattcacgtggtttagcttctcaaagaagtgaattattccagagatattgctactgctagttgtgccttctgaaatgctccaagcctccaatggtcctgccctcaggagtcgaagaacttatttgtagttggcttacagtccgatgtcctatcgatctgatgtcttgtgctgtccatgaagttatcagtagctgatgtctgctcaagtttcttgtttcctaggtggattggtttattttgggttcatggaattacccaactggtaaccttccgatgggtgggatacccgctgggtgaaatctgatgggaagaaaacccn

SEQ ID NO: 53645 - protein, 43 aa, Zea mays
  misc_feature: Ceres CLONE 1475485-F
MGRLRDGRAFLHRALVLSSLLLLASGEIFFEERFDDSEFQFVV

SEQ ID NO: 53646 - DNA, 784 bp, Zea mays
  misc_feature: Ceres CLONE 1475486-F
  misc_feature: Encodes the peptide sequence at SEQ ID NO. 53647
tggagctccccgcggtggcggccgctctagaactagtggatcccccgggctgcaggaattcgtctcacccctagaaaaaatccgcgcagagggacagggcacacgcactccgagggagcgcagccgaggagaaataatggccacggcgacgaccctctctttcagcggcggcggcggcggcactaccctgctccgcgggcacgtggccttgacgtcggggcggtgctgcacgttcccgagctcgcggtggaggccgccgcgcttgtcggcctcccgcgcggatgactcctcgccggctccgttcgagatgacggtggaggacgcgctgaagctgctcggctgtcgcaaatggcgcgttgttttgagaaaaccctgcgcgccaagaaacgcctttcctcgccctccctgccccccccacctttaaagcccttcgccccgggttcaaagccagccttttgaaatgtttcgcttagggccaaagttttatcaccaccccaaagggcttggaaaggtgtgcctaataaccccctaatccgatttgggccgaagggttaacccctgtaaaaaagtttacgggaattggggaaaaatcccctaataggtgggcatcgcggggccccccatgcaacaaatgtcccccccccgttccctttcgtggaaccccccctcttcttcgacaaaacctttgggtggccccctgccgcttggcgagtatagtcgggggtccccatggggggagtttctcccacctctgcctctcttggggcaagtcggtactatattg

SEQ ID NO: 53647 - protein, 95 aa, Zea mays
  misc_feature: Ceres CLONE 1475486-F
MATATTLSFSGGGGGTTLLRGHVALTSGRCCTFPSSRWRPPRLSASRADDSSPAPFEMTVEDALKLLGCRKWRVVLRKPCAPRNAFPRPPCPPHL

SEQ ID NO: 53648 - DNA, 690 bp, Zea mays
  misc_feature: Ceres CLONE 1475496-F
agagctggagctccccgcggtggcggccgctctagaactagtggatcccccgggctgcaggaattcgtctcacccctagaaaaaaaactgaaaactagtggcggccggagaaagagagctgcgttgcgccactggtctccatccatcgatttgttttgtgtggcttcttcgcatgtgattccgccactctgagtgttgcttatctacccctcctcctcggctcctccacaacgtccacatcatacatagccagagggtgaaaacggaatagtctatctcccagtagtgatgaacaaaaccaacaatcttctctgtcttcctgcggcgggcctgcaatttccaagcccaactgttcattctcaaggctccttctcttgtagctcgtcctccttgctcaccacatccacacgatagacgggagagggatgccatggagctggcaaagcccctttccgcgcacatatgtgatctataccgctacctacacccactgttcaatagacttctcacgctgctggtcgtccgtaccagctggatacgcgctgccgatgaggacgaagacagcgatgcagaccatccacagacaggtgccagcttcgacaccgatgggcccatggtcaacgaggtctccgctgccccggtggctactagcagaggcaccaccagatcacccagaagcaacgcgttacg

SEQ ID NO: 53649 - DNA, 706 bp, Zea mays
  misc_feature: Ceres CLONE 1475511-F
  misc_feature: Encodes the peptide sequence at SEQ ID NO. 53650
aagctggagctccccgcggtggcggccgctctagaactagtggatcccccgggctgcaggaattcgtctcacccctagaaaaaaagcagtaacattaatcacccactctactactcgaagttactaccagcagcttgcttcaacagtagaagagagcgagaggatggcgtcaccgaagccctcgtcggcggccctgctcctcctggcggcggcggccgtgctggcgctggcgcgcgcggacctgacgcacgacaactgcgtgaagaacaagaaggtgacggtgcagaacctgtgcagccacgacgtgacgctgacgctggagccgctggccaacagcccgccgctgttcgcgggcacctacacgctgcacccgcgcagccacgccgagttccccgtgtgctggtggacggggcgcctgcgcgcgcccgacgccgccaggtggagtttcacgtcggcgtcgacggcggctccttctacctgggcccaacgcgcagccggggccgcgcggtccggtctccgtcaaccccgaagggttcccccttcaggcccgcttcccccccgtcgggttggccttccagggccgttgctccgggcaccagggccccagggacgattgccgaaagccccgaaaaaaagatacttcttggccccccccccgtggtaaccaagccgaaaaggggtccccccccccctccccgcgccctgg

SEQ ID NO: 53650 - protein, 166 aa, Zea mays
  misc_feature: Ceres CLONE 1475511-F
MASPKPSSAALLLLAAAAVLALARADLTHDNCVKNKKVTVQNLCSHDVTLTLEPLANSPPLFAGTYTLHPRSHAEFPVCWWTGRLRAPDAARWSFTSASTAAPSTWAQRAAGAARSGLRQPRRVPPSGPLPPRRVGLPGPLLRAPGPQGRLPKAPKKRYFLAPPPW

SEQ ID NO: 53651 - DNA, 678 bp, Zea mays
  misc_feature: Ceres CLONE 1475512-F
  misc_feature: Translation starting site: 356
tggagctccccgcggtggcggccgctctagaactagtggatcccccgggctgcaggaattcgtctcacccctagaaaaaactagtatctattaatcgactgatagactggtagcagtcgctatcgtgctacatcgtatacagcaagtcaaacacattcacatgctgtgctagtgctcaacggctctttcgggggccagggacgtccgcctctgctgctgcctgttgcttttgctggcctccacctcatccgccagcactgagcgaagaatgcgaacagtgacaaggcagactattcttcctcgctatctccggccccatcactggagccgcagggcagcgtgcgggcactgcgccatggcacccaagatcaatgggggttcacctccccgccagtcggcccgtgcagcacggagggggcctctgctgcggccgcagtttccacatgaggagtccacactcaaggctgaccaccgcccgttgagtgtgggtggtgctgaccgacttccacaggaggaaccggactgacttactgctcaccggtccggcgttcgcgggcctagccaagcccgggatggcccaatacatgaacactgcacacggcctcaccggacagtacaaaacgattcccatgcgactacaggagaagaacctgtctatccggctggaataagatgcca

SEQ ID NO: 53652 - DNA, 627 bp, Zea mays
  misc_feature: Ceres CLONE 1475519-F
  misc_feature: Encodes the peptide sequence at SEQ ID NO. 53653
  misc_feature (407)..(407): n is a, c, t, g, unknown, or other
  misc_feature (443)..(443): n is a, c, t, g, unknown, or other
  misc_feature (448)..(448): n is a, c, t, g, unknown, or other
  misc_feature (449)..(449): n is a, c, t, g, unknown, or other
  misc_feature (548)..(548): n is a, c, t, g, unknown, or other
  misc_feature (627)..(627): n is a, c, t, g, unknown, or other
ccccgcggtggcggccgctctagaactagtggatcccccgggctgcaggaattcgtctcacccctagaaaaaacaagtaaagcagcagcagcagaccttcttgacctagcaagcaatggggccgccgttcctcgccgtcgccgtcatcgtcgccttcctggccgccgccgcgcaggccgccgaccccttcgccttcttcgactgggacgtctcctacatcaccgcctcccctctcggcgtcccgcagcaggtcattgcagtcaacaagcagttcccaggccctatcatgaacgtcactaccaactacaatgtggtcgtcaatgtgctcaacagcttagacgagcccctgctcatcacttgggatgggatccagcagcgcaagaattgctggcaggatggggttctcngcaccacctgccccataccgccagggtggaactggnactanncacttcaggtcaaggaccagattggcagcttcttctacttcccaccccttggtatgcagcgtgccgcgggggggttccgaggtatcactgtcaacaccngcgcggtcatctcggtcccattcgatacgcccgatggggacatcacgctcttcatcggggactggtacaagatgaaccn

SEQ ID NO: 53653 - protein, 170 aa, Zea mays
  misc_feature: Ceres CLONE 1475519-F
  misc_feature (31)..(147): Pfam Name: Cu-oxidase_3 Pfam Description: Multicopper oxidase
  misc_feature: SWISSPROT Homolog: EC 1.10.3.3 L-ascorbate oxidase
  misc_feature (98)..(98): Xaa is any aa, unknown, or other
  misc_feature (110)..(110): Xaa is any aa, unknown, or other
  misc_feature (111)..(111): Xaa is any aa, unknown, or other
  misc_feature (112)..(112): Xaa is any aa, unknown, or other
  misc_feature (145)..(145): Xaa is any aa, unknown, or other
MGPPFLAVAVIVAFLAAAAQAADPFAFFDWDVSYITASPLGVPQQVIAVNKQFPGPIMNVTTNYNVVVNVLNSLDEPLLITWDGIQQRKNCWQDGVLXTTCPIPPGWNWXXXLQVKDQIGSFFYFPPLGMQRAAGGFRGITVNTXAVISVPFDTPDGDITLFIGDWYKMN

SEQ ID NO: 53654 - DNA, 711 bp, Zea mays
  misc_feature: Ceres CLONE 1475522-F
  misc_feature: Encodes the peptide sequence at SEQ ID NO. 53655
  misc_feature (369)..(369): n is a, c, t, g, unknown, or other
  misc_feature (688)..(688): n is a, c, t, g, unknown, or other
aagctggagctccccgcggtggcggccgctctagaactagtggatcccccgggctgcaggaattcgtctcacccctagaaaaagtagcccaacgagaagagcggcggcgcgggcggacaaggagcaggcggaggaggagctgtgccaagccacaatgggtatctcacgcgactcgatgcacaagcgccgtgccaccggtggaaagcagaaggcctggaggaagaagcgaaagtatgagcttggtcgccagccggccaacaccaagttgtcaagcaataagacagtgaggagggtccgtgttcgtggaggtaacgtgaagtggagggctcttcgccttgatactggtaactactcatggggaagtgaagntgttacccgcaagacccgtatcctcgacgtggtctacaatgcatcatacaatgagcttgtgaggacacaaacccttgtgaagagtgccactgtgcaagttgatgctgtcccattcaagcagtggtacctcactcactatggagttgactttggtaggaagaagaaaacccctgctggcaagaaggataatgctgagggacaagaggttgaagcatcagctgaaggaaacgaacaaaagcaaccctgtccaccaggaaactttgaaaatcgcaagggagggacgtaccccttggaccccaacattggagaaggcaatttnggcagtgggaccggcttgctggc

SEQ ID NO: 53655 - protein, 185 aa, Zea mays
  misc_feature: Ceres CLONE 1475522-F
  misc_feature (1)..(185): Pfam Name: Ribosomal_S8e Pfam Description: Ribosomal protein S8e
  misc_feature (72)..(72): Xaa is any aa, unknown, or other
  misc_feature (178)..(178): Xaa is any aa, unknown, or other
MGISRDSMHKRRATGGKQKAWRKKRKYELGRQPANTKLSSNKTVRRVRVRGGNVKWRALRLDTGNYSWGSEXVTRKTRILDVVYNASYNELVRTQTLVKSATVQVDAVPFKQWYLTHYGVDFGRKKKTPAGKKDNAEGQEVEASAEGNEQKQPCPPGNFENRKGGTYPLDPNIGEGNXGSGTGLL

SEQ ID NO: 53656 - DNA, 651 bp, Zea mays
  misc_feature: Ceres CLONE 1475528-F
  misc_feature: Translation starting site: 139
  misc_feature (438)..(438): n is a, c, t, g, unknown, or other
ggagctccccgcggtggcggccgctctagaactagtggatcccccgggctgcaggaattcgtctcacccctagaaaacgcctcccgagccacacacgttgccgccgtgagccgccgcccacaaggctaagcaccaaccatggccttcggagctctcgtcacgtcgaggctggccaggtccggccgcacccttgcatctgccgttgcccagggtcccgtttgcccagcgatagcacctcctctgctctccagcttggagcagtagctcgtcttctcagcacaaagccagccgcaacagatgtcatcggtatcgatctaggcactacgaattcctgcgtctccgtcatggaaggaaagacccacgggtgattgaaaatgcaaaaggcccgagacaacaccttccattgttgcaagaatcagaatggtgacctgttgattngtatcacagcgagccggcaggaataacaaatgcccaaacacaatccggggggcaaagcgtcttatccgggagacttttgataacccccacaccccaaaagagatgaagatggtgccctaaaaaattggcaaggcccccaatggggaatcctgggtcaaaaatgggtgccaaccatacctcccctagcaaaatgggggcatttgtccccaaaag

SEQ ID NO: 53657 - DNA, 699 bp, Zea mays
  misc_feature: Ceres CLONE 1475530-F
  misc_feature: Encodes the peptide sequence at SEQ ID NO. 53658
  misc_feature (402)..(402): n is a, c, t, g, unknown, or other
aaagctggagctccccgcggtggcggccgctctagaactagtggatcccccgggctgcaggaattcgtctcacccctagaaaaaacgcgcattgtggctcctcacttctgcgccgccacccactacaggtaaggaagaggaggagggcaggatgtcgcaccgtaagttcgagcacccgaggcacggctccctcggcttccttcccaggaagcgctcctcccgccaccgcggcaaggtgaagtcatttcccagggatgaccccaagaagccttgccatctcactgccttccttggctacaaggctggcatgactcacattgtccgtgaggttgagaagccaggatccaaactccataagaaagaaacttgtgaggctgttaccatcattgaaacccctcctcnttgtcatgttgggctcgtggcatatgtgaagactcctcgtggcctccgcacactccactctgttttgggcccacatctttaccaagaagtgaagaaaaggttctaccagaactggtgccagagccagagaaggctttcccaaggaatgcttcccaaaattaaaaatgaggctgaaaaaaagaaaattcaccttcccctggaaaaaataaaaaaaaaggcttctgtttccccgggcattggcccaccccccaatttagaaaaataaagggttttaaaccaaaaaaagggccccctttg

SEQ ID NO: 53658 - protein, 171 aa, Zea mays
  misc_feature: Ceres CLONE 1475530-F
  misc_feature (50)..(170): Pfam Name: Ribosomal_L3 Pfam Description: Ribosomal protein L3
  misc_feature (84)..(84): Xaa is any aa, unknown, or other
MSHRKFEHPRHGSLGFLPRKRSSRHRGKVKSFPRDDPKKPCHLTAFLGYKAGMTHIVREVEKPGSKLHKKETCEAVTIIETPPXCHVGLVAYVKTPRGLRTLHSVLGPHLYQEVKKRFYQNWCQSQRRLSQGMLPKIKNEAEKKKIHLPLEKIKKKASVSPGIGPPPNLEK

SEQ ID NO: 53659 - DNA, 737 bp, Zea mays
  misc_feature: Ceres CLONE 1475532-F
  misc_feature: Encodes the peptide sequence at SEQ ID NO. 53660
agagctggagctccccgcggtggcggccgctctagaactagtggatcccccgggctgcaggaattcgtctcacccctagaagagccagccaccccccccccccccccaagagaagtggggaaaaagatcccgtcccaatggctctcctccccgaaatcctccactctcctcaccccgcgctcgccgccgccgcctcctcctctcgcgcattctgccgagcaccacgccacctccatgtctcagcgtcccggggccggggccgcggccgcctcgccacggcggcgggggcgtccgggcccggaccatcatcggcggagccatctccccctgagtccgacgacgggctggtggagctcccgctgttccctctcccgctcgtgctcttcccggacgccacgcacgcgctggacatccccccctctccctaccgcaacatgatgcacacggtgctgcagaccgacctccgcttcgggatcgtcttcgttcggcaatctggggtcccccccggaggtgggctgctttcgggaatgtcgtcaaaaaacgaccgccccgccgaacaacccgttctttcctcctccggaaaggggccaccagcggtttccgccatcacccggaatctggggaacccaaggccctaacttcgttcgccaccctggtcaagggctttaaggaaattttcctcccccaaaaagccccacggggcccgggggggagaagcccaaaagaccctctcctct

SEQ ID NO: 53660 - protein, 166 aa, Zea mays
  misc_feature: Ceres CLONE 1475532-F
MALLPEILHSPHPALAAAASSSRAFCRAPRHLHVSASRGRGRGRLATAAGASGPGPSSAEPSPPESDDGLVELPLFPLPLVLFPDATHALDIPPSPYRNMMHTVLQTDLRFGIVFVRQSGVPPGGGLLSGMSSKNDRPAEQPVLSSSGKGPPAVSAITRNLGNPRP

SEQ ID NO: 53661 - DNA, 828 bp, Zea mays
  misc_feature: Ceres CLONE 1475537-R
  misc_feature: Pfam Name: Rgp1 Pfam Description: Rgp1
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (53)..(53): n is a, c, t, g, unknown, or other
  misc_feature (657)..(657): n is a, c, t, g, unknown, or other
  misc_feature (684)..(684): n is a, c, t, g, unknown, or other
nnnccaattgggtactcgagcgtctcgtttttttttttttttttcggatcgtnccacgtagttttttttatcaaaattgtgcctcttgtgtcacagttactatattctgtggtgcatcttaaacaccaaatgataatgcctgctctcatgggatacaaatcgatgaaacaaatggtccaataaatccatttggtgcaagtcaagtatctcactccatttgttctctattaaaaaaataggcatcacattgcaaatcctataacaatttacagcgagaaaatcgttttgatgcaattgtaccagtcagaatagtctgtaaatcctttccagctgaaagtaactatacttcggcaacagtgcacttcaagagttgaagatatttccaggtgagacagatctaccattcctctcatgagtagctcgtctgcgcaatggaggtgtgtaaacagttaccgggagcacccattcacccttctctcttttatcaacaaggagtgggtgctcgtacctagctgggtctgttccttccggagttgtgaagaactcaaatcgaagagaccactgtacagtgacctttgaggtacaaaaagacatagggccatcaatgggaatggaaaatagaaagcttgtctggtgaagatccgcaacaacctcatngatgtcactgtgtagcttggttattgntggtgagccccttcttgaaggatgtaatgcgcgagggataattgtttcggaatgttcccagggctatagataacctcaagggcaccttccgtttttccatgtcccggaaaaaaaaaggtaagggccccccccaaacttatttac

SEQ ID NO: 53662 - DNA, 704 bp, Zea mays
  misc_feature: Ceres CLONE 1475543-F
  misc_feature: Encodes the peptide sequence at SEQ ID NO. 53663
  misc_feature (590)..(590): n is a, c, t, g, unknown, or other
  misc_feature (591)..(591): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (607)..(607): n is a, c, t, g, unknown, or other
  misc_feature (614)..(614): n is a, c, t, g, unknown, or other
  misc_feature (615)..(615): n is a, c, t, g, unknown, or other
  misc_feature (619)..(619): n is a, c, t, g, unknown, or other
tggagctccccgcggtggcggccgctctagaactagtggatcccccgggctgcaggaattcgtctcacccctagaaaaaattttcctccgcgtgggttctgtcacttctgtgacttctgtctgcgtctcgctctccggcgactggtgggccgccgccaccctaagccagttgcggaggtttacattggtctcttcgccggcgacgagcacccaccaggagtcttgacaagtttttccaatggaccaagtaccgaatggaaggcataaggtttcttttgcgaagccaagagtagttgtgctttcagattctgactctgactctgaaggttttgtagaagagctaactcctgttcactcaaagtcaaacgggaaggcttcatctgcgagcctaaaaactggtggaaaccccccagccccctttctaaaggtgatgcaagccaaggaaaagcatacagtagtgacaaaggtggaaagggttcttcatcacatgcagtgcctaccagtctgatgcaactaaagtagagttggttcctccattctaaaggcatgatgggaccctgactttaatcacgcctagcgatgtgtctatnntnnnnnnnnnnntgtnttttccnncagngccccccaaaaaaaaacccttgcggcccgctaagataggtctttccttataaaaaaaaaagaaaattctccccccccggcggtgg

SEQ ID NO: 53663 - protein, 89 aa, Zea mays
  misc_feature: Ceres CLONE 1475543-F
MDQVPNGRHKVSFAKPRVVVLSDSDSDSEGFVEELTPVHSKSNGKASSASLKTGGNPPAPFLKVMQAKEKHTVVTKVERVLHHMQCLPV

SEQ ID NO: 53664 - DNA, 694 bp, Zea mays
  misc_feature: Ceres CLONE 1475554-F
  misc_feature: Encodes the peptide sequence at SEQ ID NO. 53665
  misc_feature (556)..(556): n is a, c, t, g, unknown, or other
aagctggagctccccgcggtggcggccgctctagaactagtggatcccccgggctgcaggaattcgtctcacccctagaaaaacaactcccctacaagccgccgggccgaacgaccgaagcatccacttccaaagtgtactgtttgctgcccgcctggcgcctgcccccataactactctgccaccaatccggggaggaatcaacctagcggtaagcggacatggcggcggcgaagatagcgccgtcgatgctctcgtcggactttgccaacctcgcttcggaggctgagcgcatggtccgcctaggcgccgactggctacatatggacatcatggatgggcacttcgttcctaacctgactattggggctccggtgatccagagcttgaggaaacataccaaagcatatttggactgccatcttatggtcacaaagccttcagattacgtagaaccatttggaaaagctggcgcttctggattcacattccatatagaaagtgctagagacaactggcaagatctcaatccaagcattaaatcaaaaggtatgcngccctgttgtatcattgaagccagggtactccagtggaaggaagtttttccccttgtggaaggcagaaaaatcggtaaaaattggttccctgtaatgacagtccaacctgggttttgggggtcagaaatttatgcaaa

SEQ ID NO: 53665 - protein, 157 aa, Zea mays
  misc_feature: Ceres CLONE 1475554-F
  misc_feature (5)..(154): Pfam Name: Ribul_P_3_epim Pfam Description: Ribulose-phosphate 3 epimerase family
  misc_feature: SWISSPROT Homolog: EC 5.1.3.1 Ribulose-phosphate 3-epimerase
  misc_feature (112)..(112): Xaa is any aa, unknown, or other
MAAAKIAPSMLSSDFANLASEAERMVRLGADWLHMDIMDGHFVPNLTIGAPVIQSLRKHTKAYLDCHLMVTKPSDYVEPFGKAGASGFTFHIESARDNWQDLNPSIKSKGMXPCCIIEARVLQWKEVFPLVEGRKIGKNWFPVMTVQPGFWGSEIYA

SEQ ID NO: 53666 - DNA, 711 bp, Zea mays
  misc_feature: Ceres CLONE 1475574-F
  misc_feature: Encodes the peptide sequence at SEQ ID NO. 53667
  misc_feature (384)..(384): n is a, c, t, g, unknown, or other
  misc_feature (415)..(415): n is a, c, t, g, unknown, or other
  misc_feature (417)..(417): n is a, c, t, g, unknown, or other
  misc_feature (443)..(443): n is a, c, t, g, unknown, or other
aaagctggagctccccgcggtggcggccgctctagaactagtggatcccccgggctgcaggaattcgtctcacccctagaaaaacccaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcagacgccgtcgtacctgaccggcgagttccccggcgactacggntgggacaccgcgggcctctcggccgaccccnanacattcgcgcgcaaccgggagctggnagtgatccactccccggtggcgatgctgggcgcgctgggctgcctgttcccggagatcctggcaagaccgggtcaagttcgccaagcggggtggttcagggcggcccccaaattttccggagggcggttggattacctggggaccccaacctggggcccccaaagagatctggcctttgggggtcccaggggggccttgggttcccaaaagttacccggttggggggcccccttgggaaagggctccaaaaggtccccccggcgcccc

SEQ ID NO: 53667 - protein, 182 aa, Zea mays
  misc_feature: Ceres CLONE 1475574-F
  misc_feature (59)..(175): Pfam Name: Chloroa_b-bind Pfam Description: Chlorophyll A-B binding protein
  misc_feature (84)..(84): Xaa is any aa, unknown, or other
  misc_feature (93)..(93): Xaa is any aa, unknown, or other
MAASALHQTTSFLGQALVSRAAGVDAGGRITMRRTVKSVPQSIWYGPDRPKYLGPFSEQTPSYLTGEFPGDYGWDTAGLSADPXTFARNRELXVIHSPVAMLGALGCLFPEILARPGQVRQAGWFRAAPKFSGGRLDYLGTPTWGPQRDLAFGGPRGALGSQKLPGWGAPLGKGSKRSPRRP

SEQ ID NO: 53668 - DNA, 593 bp, Zea mays
  misc_feature: Ceres CLONE 1475578-F
  misc_feature (146)..(146): n is a, c, t, g, unknown, or other
  misc_feature (197)..(197): n is a, c, t, g, unknown, or other
  misc_feature (207)..(207): n is a, c, t, g, unknown, or other
  misc_feature (259)..(259): n is a, c, t, g, unknown, or other
  misc_feature (272)..(272): n is a, c, t, g, unknown, or other
  misc_feature (330)..(330): n is a, c, t, g, unknown, or other
  misc_feature (349)..(349): n is a, c, t, g, unknown, or other
  misc_feature (382)..(382): n is a, c, t, g, unknown, or other
aagctggagctccccgcggtggcggccgctctagaactagtggatcccccgggctgcaggaattcgtctcacccctagaaaaagctcactcgtgccgtgcactcgtcccgtccccctccaccctccaagacctcgcattgccaccngccgccgccgagccaggggagaggagagaggccagccgctcgcggcgggcnaggaggaganagcggagagcgagcgagccgcgggcagatgtcgggcgggatcctgggcgggncgctgagatctcnacgccgactcgcgacggacgacgcccgcagcgcgacctggacggggcgcgctgatgcngcaactgggacagacgcancagagctggggtcctgcccgggccccgggaacnaggcccggaaagaaaaaaaaaggcgggacgttcaaccctcggggtggccctcgtcgccaaaccgcaaggggctttcatggtggaaccggtggggacccgtccctggggccccggggggttttcaaagggggttcggaaaaaaagaaacggaaaaggctcgccccccgaaaaaggggccccccggggggggggggggaacaaacacaaaaac

SEQ ID NO: 53669 - DNA, 674 bp, Zea mays
  misc_feature: Ceres CLONE 1475579-F
  misc_feature: Encodes the peptide sequence at SEQ ID NO. 53670
  misc_feature (621)..(621): n is a, c, t, g, unknown, or other
aagctggagctccccgcggtggcggccgctctagaactagtggatcccccgggctgcaggaattcgtctcacccctagaaaaaactcactcactcactcgctcacacagcaaatacccacagtccacagcaagaaccgaagatgttcggaaacatcggaaagatcccgatcatcggcgacctgacgggcagcaacaagaatgcgcacctcaagggcaacctggtgctcatgcgcaagaccgtgctcggcttcgacgtcaccagcatcgccggctccctcatggacggcctcggcgagttcctcggccgcggcgtcacctgccaactcgtcagctccaccgtcgtcgaccccaacaacgggaaccgcgggaaggtgggtcaggaggcgagcctggagcagtggctgctgcacccgccgccgctgctggccggcgaggaccagttccgcgtcaccttcgactgggaggtggagaagcacgggcgtccgggcgccatcatcgtgaagaaacaccacgcctccgagttcttccctcaagacatcaccatcgacgacgtccccggccacggccccatcgtcttcgtcgccaactcatgggtgtacccgcagtacaagtaccgctancaccgcgtcttcttctcccacgacacgtacctccccagccagatgccggcggg

SEQ ID NO: 53670 - protein, 177 aa, Zea mays
  misc_feature: Ceres CLONE 1475579-F
  misc_feature (58)..(164): Pfam Name: PLAT Pfam Description: PLAT/LH2 domain
  misc_feature: SWISSPROT Homolog: EC 1.13.11.12 Lipoxygenase
  misc_feature (160)..(160): Xaa is any aa, unknown, or other
MFGNIGKIPIIGDLTGSNKNAHLKGNLVLMRKTVLGFDVTSIAGSLMDGLGEFLGRGVTCQLVSSTVVDPNNGNRGKVGQEASLEQWLLHPPPLLAGEDQFRVTFDWEVEKHGRPGAIIVKKHHASEFFPQDITIDDVPGHGPIVFVANSWVYPQYKYRXHRVFFSHDTYLPSQMPA

SEQ ID NO: 53671 - DNA, 660 bp, Zea mays
  misc_feature: Ceres CLONE 1475580-F
  misc_feature: Encodes the peptide sequence at SEQ ID NO. 53672
ggagctccccgcggtggcggccgctctagaactagtggatcccccgggctgcaggaattcgtctcacccctagaaaaactcgtcgagagagtcgtccccccgcgtgctctccgcctgcggcctctgtatcccgcaaccaaaaactacccccaaaaaaagaagaaaaccccaaatcctcgagatctatcagtatcgagcgacttaccaatccgattgctagggtttagtttcgaaaaaatctgaaaaaaattctggtcgaggggaggaggcgatgtcggcgcaagtggcggtggtgcctaatgggggcccgggcgctgtccccgcggtggtgtcgccgggagctgtcggcgtggctcagcctctcccgaccacgtcgctctacgtgggcgacctggagggggccgtctcggactcgcagctgtacgaactcttcagccaggcggggcaggtggtgtcggtgcgcgtctgcagggatgtcacctcgcgccgctcgctcggatacgcctacgtcaactacagcaatcccttggatgctgcgagagcattggaagtgctgaactttgctgctcttaaacacagcctatccgggtgatgtattcaaaccgtgatcaagcagccgcaggagtggatctgctaacattttcataaaaaatcttgaca

SEQ ID NO: 53672 - protein, 106 aa, Zea mays
  misc_feature: Ceres CLONE 1475580-F
  misc_feature (36)..(107): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSAQVAVVPNGGPGAVPAVVSPGAVGVAQPLPTTSLYVGDLEGAVSDSQLYELFSQAGQVVSVRVCRDVTSRRSLGYAYVNYSNPLDAARALEVLNFAALKHSLSG

SEQ ID NO: 53673 - DNA, 639 bp, Zea mays
  misc_feature: Ceres CLONE 1475589-F
  misc_feature: Encodes the peptide sequence at SEQ ID NO. 53674
  misc_feature (639)..(639): n is a, c, t, g, unknown, or other
ctccccgcggtggcggccgctctagaactagtggatcccccgggctgcaggaattcgtctcacccctagaaaactctccgactcatccctctgtcctcacaagccgccgccggccaagtcctgtccttctcccttgtctggttcggatcgtcgttgctagccaggtgctggatccgtagcggcggcggcgggcatggacaagagcatgctcggcgacctggacgggctccccgaggaagacaagatgcggatggccgccatgatcgaccagctccagatccgcgacaggctgagaatgtacaattcgctggtggagaggtgcttcacggactgcgtggacacgttccggcgcaggaacctggacaagacagaagagtcgtgcgtcccgccgtgcgcggagaagttcctgaacactccatgagggtcgcatgaagtccccgagcttaacagggcgtggcacgccggactaaaaacacgctgccgctgggtggctgctcacgttgggcgcggccgccgccccgccgccagggttctggcttttgctggcacaaattttgtacccaaaaaaaggatttcgccccttccgttggctaaaataaacgcctcttaaaaccaaacgcgggggggcaaaataaaaan

SEQ ID NO: 53674 - protein, 75 aa, Zea mays
  misc_feature: Ceres CLONE 1475589-F
  misc_feature (20)..(74): Pfam Name: zf-Tim10_DDP Pfam Description: Tim10/DDP family zinc finger
MDKSMLGDLDGLPEEDKMRMAAMIDQLQIRDRLRMYNSLVERCFTDCVDTFRRRNLDKTEESCVPPCAEKFLNTP

SEQ ID NO: 53675 - DNA, 671 bp, Zea mays
  misc_feature: Ceres CLONE 1475594-F
  misc_feature: Translation starting site: 155
  misc_feature (293)..(293): n is a, c, t, g, unknown, or other
  misc_feature (313)..(313): n is a, c, t, g, unknown, or other
aagctggagctccccgcggtggcggccgctctagaactagtggatcccccgggctgcaggaattcgtctcacccctagaaaaaggaggcctcgctctggttggaaggtttggagaaactccccggctcgaggagatcgtgacattgagaggacgatgggagggcgcgcgctcctcctcctcctcctggtctcggcgttggtctttcagatccacgcctccgacccgctgctgtacgagccgttcgatgaggactttgaggggagatgggtcgtctccagaaggatgaataccnaggtgtggtgaggcatgccnagagtgatggtcatgaggactatggcctcctttgtagtgagagggcaggaaatacgccataatcaaggagcttgatgagccagttaccttgaaggatgggacagtgttcctgcagtttgaggtgagacttcagaatgggccttgaatgcggaggtgcctacattaaagacatccgccctcaggatgctggatgggatgcccaagaatttgaataatgaaactccctcccctattttggtttgggccaaatagtgggggatccacccaacagggttctttttcttccttaaacccaaaaattcctaaaacctggaaaagtttgttgaccatccttctcaaatttccccaccttctggtc

SEQ ID NO: 53676 - DNA, 628 bp, Zea mays
  misc_feature: Ceres CLONE 1475603-F
  misc_feature (137)..(137): n is a, c, t, g, unknown, or other
  misc_feature (171)..(171): n is a, c, t, g, unknown, or other
  misc_feature (176)..(176): n is a, c, t, g, unknown, or other
  misc_feature (203)..(203): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (237)..(237): n is a, c, t, g, unknown, or other
  misc_feature (238)..(238): n is a, c, t, g, unknown, or other
ctccccgcggtggcggccgctctagactagtggatcccccgggctgcaggattcgtctcacccctagaaaaatccagatcaggattagccgaccacccgccgaaggcagagagaatatctcatcttctctcaccggnatcgttcaatcgagagcgagggagaaagggagtngtgcntcaaggggggccaaattttgccggttnggagcagataggggtatgagctgtttnnnggacnngcgcggttcgaggtcgcccgccgccaggacggcctcctcgtcttcgtcttcttcctctcgattcccatacgtaccagtagttttattttaagtagagttattggagtagcaatctctgggaactggcctcgcctttgcgggtcctgggcccttttcccttccccggcccctttctccaaaccctccttatcttccccctccccgggaaacccggggggtggtatgatcccaatggccccaaaagtgggggctttttctccccaacattggggaggggggggcccccccccccctccctaattgcctcggggggggggtttccgggggtttttaaatccccccccccccctcccattttttttttgaggggggactttttttaaaaaaaaa

SEQ ID NO: 53677 - DNA, 688 bp, Zea mays
  misc_feature: Ceres CLONE 1475605-F
  misc_feature: SWISSPROT Homolog: EC 2.7.11.24 Mitogen-activated protein kinase
  misc_feature (420)..(420): n is a, c, t, g, unknown, or other
aagctggagctccccgcggtggcggccgctctagaactagtggatcccccgggctgcaggaattcgtctcacccctagaaaaagtgggcggcctcgagctctgcttaaatcacagctgtgttcgtttgtggggtgatccgcccccctgtcggattctttcacctccgagctctgggacaggggagatctgtggtgtcgcagcctcgcctttcttgtacgcgcgcgtgtgggcactcagcagtgagctcccgtcttcccagcctcattttcccccctttcttgctggatctggctcgcaagatccgacctttcgtgcctaccttggctaaagtttctcgcttggttggctcgcgttgactgctgagaggatgcagcacgaccagaagaagaaggcaccttcagaaatggacttttttacanagtatgggcgaggggagcaggtacaagatagaagaggtcataggggaaaggcagttacgggggtggtttgctctgcctttgaacactcatactgggtgaaaaggtcgccataaaagaagataaatgacatcctttgagcatgtgtcttgatgccaccaaggataccttagggaaaatcaagtttgctttagacctcctggcgggatccgggatattcggggaaaataaaagcaatattctccctcccctccattcaagggaggggaag

SEQ ID NO: 53678 - DNA, 660 bp, Zea mays
  misc_feature: Ceres CLONE 1475607-F
  misc_feature: Translation starting site: 165
  misc_feature (567)..(567): n is a, c, t, g, unknown, or other
  misc_feature (570)..(570): n is a, c, t, g, unknown, or other
  misc_feature (660)..(660): n is a, c, t, g, unknown, or other
aagctggagctccccgcggtggcggccgctctagaactagtggatcccccgggctgcaggaattcgtctcacccctagaaaactccagttctcctgcactctgctccccatattttatcccttcggagctcggatcagacgcttgtgaatcctggtcatcattcatggagaagaaggcagctactacagaggaaccccttctcgcgccgcggtccgagcacacggtcgcggcggaggccaagcggctgctgagcctggcggggccgctggtggccagctgcatcctgcagaacgtggtccagctggtttccgtgatgttcgtgggccactcggcgagctgcccctcgccggcgcgtccctggccagctcgctcgccaacgtcaccggcttcagcctcctcgtgggcatggcgagcgcgctggacacgctgtgcgggcaggccttcggagcgaggcagtacggcctgctcggcctctacaagcagcgggccatggctgtgctggcgctcgcctgcgtcccgatcgccgcggtctgggccaacgccggggcggatcctcatcctcctcnggnccagacgcgacatcgccgcgggaggcggcgcctactcccggttgctcatactgtccctgggtccctacgtcccgctcgcgtggcacgtcn

SEQ ID NO: 53679 - DNA, 685 bp, Zea mays
  misc_feature: Ceres CLONE 1475619-F
  misc_feature: Encodes the peptide sequence at SEQ ID NO. 53680
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
aaagctggagctccccgcggtggcggccgctctagaactagtggatcccccgggctgcaggaattcgtctcacccctagaaaaaagtgcttccagagagcctgaccgaccatccacaagcagctagcgtaacgagcgatggccaccgaactccagtcgccgctgctccctccgccaccgctgccgccgcagcgacgactaagcccgcgggcagccgtatgggcggtgctcgccgtctcggcgacggtcctgctcctccccttcctgatcggcagcaccaccaggaccaccagcagcagcagcacgagacacccccggcctcgatcctccccaccatccaaccgcgtggagctcacgctcctgaccgccgcccacgacaagggcgcggtgtgcctggacaggagccccccgggctaccacctgcatgcggagtctggagccgggcccagcatctggctcatccatctcatggtgggcagctggtgcgacaacgtccgcagctggctcgaccgatgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 53680 - protein, 126 aa, Zea mays
  misc_feature: Ceres CLONE 1475619-F
MATELQSPLLPPPPLPPQRRLSPRAAVWAVLAVSATVLLLPFLIGSTTRTTSSSSTRHPRPRSSPPSNRVELTLLTAAHDKGAVCLDRSPPGYHLHAESGAGPSIWLIHLMVGSWCDNVRSWLDRC

SEQ ID NO: 53681 - DNA, 706 bp, Zea mays
  misc_feature: Ceres CLONE 1475653-F
  misc_feature: Encodes the peptide sequence at SEQ ID NO. 53682
  misc_feature (449)..(449): n is a, c, t, g, unknown, or other
  misc_feature (451)..(451): n is a, c, t, g, unknown, or other
aagctggagctccccgcggtggcggccgctctagaactagtggatcccccgggctgcaggaattcgtctcacccctagaaaaactcatcgtcacaacgcgtcctcgaataaaaatccagacgaaacccaaaatccccaccgaacgcaacctaaaatctccccatccctcctcgatccagccccgcggagaagagccatggccgattccgcaaccaacgacgcccccctggtcgccagcaaccagcccacggaggaggaggtgacggtggagagggccgcggcgacggaggagcaggaggaggagaggctgcggtacctcgagttcgtgcagcaggcggcggcgcaggcgctggtgctggcggccgcggcgtacgcgtacgccaagcagggcgccggcccgctccgccccggggtcgatcaggtcgagggcaccgtgaaggtcgtcgtcngncccgtctacgaacgttttcacgccgtcccgctcgacctcctcaagtcatcgaccgcaggttggtgatccgttgaggaaatagaccgccccgtccctcccgtggggaagaaaccccaaccttggcccgttcggttgcaaggaagttccccagcccggctggggggaagggccatgggcttggccaattaactttcccccgccccaaaccaagggcccgggagttttacccccttaaaaactggggaaaaagcggtg

SEQ ID NO: 53682 - protein, 106 aa, Zea mays
  misc_feature: Ceres CLONE 1475653-F
  misc_feature (29)..(105): Pfam Name: REF Pfam Description: Rubber elongation factor protein (REF)
  misc_feature (85)..(85): Xaa is any aa, unknown, or other
MADSATNDAPLVASNQPTEEEVTVERAAATEEQEEERLRYLEFVQQAAAQALVLAAAAYAYAKQGAGPLRPGVDQVEGTVKVVVXPVYERFHAVPLDLLKSSTAGW

SEQ ID NO: 53683 - DNA, 795 bp, Zea mays
  misc_feature: Ceres CLONE 1475655-F
  misc_feature (795)..(795): n is a, c, t, g, unknown, or other
ctctagaactagtggatcccccgggctgcaggaattcgtctcacccctagaaaaaacgaccaggcggacgttgcggccaagtcaacaggttgcgctcagcctttctccctcttatgcccaagcagaggagttgagggggggcccttctgcggctgcactgagctacccgcttctccacgatggcatacccgacggaggacgacccgatgcatctcatgaactcgatcatcagtgaaccacaccttggacctgggttaccccggaatttaagaaattcttagttcacatcccttgggtctgtcagaactatgaaaccccttcctccttagacgttggtttttaaattggtttttgtggagcgcccgtattaaatataatatattttcttaaaattttcttcacaacctgttttgggagagaaaaggttgaatccaccgcaaaatctgtcgaattcttccacgctttatcccgctcgctcgcccattctctgtccgtaaagaagcctgcattccttgggaatcggtcgccttgaatatgtccgatccacgcctattttaatctctgttaagtcacaccgtgacaatccccccatacaaccttcctttatgaccaatttataatcccgcgatttccccctccgcctccaaaaatataggccctatcatcggatatttaaaacactcccttctctttactacagccctcttaggtaaaaaacccccttatgttgcgattcccgctatacccatgttccgtcttatgttgcctcccggtatttttaagcgactcctcctn

SEQ ID NO: 53684 - DNA, 440 bp, Zea mays
  misc_feature: Ceres CLONE 1475660-F
  misc_feature: Encodes the peptide sequence at SEQ ID NO. 53685
  misc_feature (269)..(269): n is a, c, t, g, unknown, or other
aaagctggactccccgcggtggcggccgctctagaactagtggatcccccgggctgcaggattcgtctcacccctagaaaaaattaatcacccactctactactcgaagttactaccagcagcttgcttcaacagtagaagagagcgagaggatggcgtcaccgaagccctcgtcggcggccctgctcctccctggcgcgggcgccgtgcttggcgctggcgcgcgcggacctgacgcacgactactgcgtgaagacaagaaagtgacngtgcaaaaccttgtcagcccccaacttgaccctgaccctgaaaccccttgggccaaaaatcccgccccttttttccggggacctttaaaggtttgaacccccggaaaacccccccaaaatttcccccttttgtttttggaaaaagggccccccttttgccgggccccccca

SEQ ID NO: 53685 - protein, 70 aa, Zea mays
  misc_feature: Ceres CLONE 1475660-F
MASPKPSSAALLLPGAGAVLGAGARGPDARLLREDKKVTVQNLVSPQLDPDPETPWAKNPAPFFRGPLKV

SEQ ID NO: 53686 - DNA, 643 bp, Zea mays
  misc_feature: Ceres CLONE 1475664-F
  misc_feature: Encodes the peptide sequence at SEQ ID NO. 53687
  misc_feature (477)..(477): n is a, c, t, g, unknown, or other
  misc_feature (484)..(484): n is a, c, t, g, unknown, or other
ctggagctccccgcggtggcggccgctctagaactagtggatcccccgggctgcaggaattcgtctcacccctagaaaaagaccgatagaacacgaccttaggggttcagatcggatcggaagcttccataagtttccatcgggcgtcgccggtatggcgatccgcaaggggtcttcgtacgccgtcgcggcacttctcgcgctcgcctctgtcgccgccgtcgcaggggaggtcttcttccaggagaagttcgaagatggctgggaaagtaggtgggtcaagtctgagtggaagaaggatgagaacatggctggtgaatggaaccacacctcgcgaaaatggaatggagatgccgaagacaaaagtattcaaacctccgaggattacaggttctatgccatttcagccgaataccctgagttcaggtgcctgcaaagatctgctccggttcttgagaagcgtcgtgaatgcagaangagatgncataccttttcaatccttgcatggtatctggtaggattttgcatgctgaatgaaaatgcacgcaggcgattccatgagcctttcatgcatgttttgagacacctgaaccaatttatatattcctaataattggcacaagcttccatgcaaaaaaaaaaa

SEQ ID NO: 53687 - protein, 151 aa, Zea mays
  misc_feature: Ceres CLONE 1475664-F
  misc_feature (108)..(108): Xaa is any aa, unknown, or other
  misc_feature (110)..(110): Xaa is any aa, unknown, or other
MAIRKGSSYAVAALLALASVAAVAGEVFFQEKFEDGWESRWVKSEWKKDENMAGEWNHTSRKWNGDAEDKSIQTSEDYRFYAISAEYPEFRCLQRSAPVLEKRRECRXRXHTFSILAWYLVGFCMLNENARRRFHEPFMHVLRHLNQFIYS

SEQ ID NO: 53688 - DNA, 646 bp, Zea mays
  misc_feature: Ceres CLONE 1475670-F
  misc_feature: Encodes the peptide sequence at SEQ ID NO. 53689
  misc_feature (398)..(398): n is a, c, t, g, unknown, or other
aaagctggagctccccgcggtggcggccgctctagaactagtggatcccccgggctgcaggaattcgtctcacccctagaaaaaaatatccattccaccttggtccatcagcagcgagcgaacaggcaaaaaggaaaggccgagaagcgctttatccggccgtacgtagcgataagagtggtgcacccgtagcggcacggcatggcggccacggcgtactccgtggcgctcctcggcggcgcacgcctgccggccgccttcctccctcgacgcagcagcgtgtgccaccaccagcttcgcctccaagacgcaccgaggctgatctccctgcaccgtgccagggccgcttccgaggacacgtcggcctccggcggcgacgagctcatcgaagacctcanggcaaagtgggacgccgttgaggacaagcccaccgtcctcctgtacggcggcggcgccgtcgtcgcgctatggttgacgtccgttgtcgtcggcgccattcacgccggtgccgctgctccccaagatcctggagctcggtggcctcggctacacgggctggttcgtctaccggtactccctcttcaagcaaaccagggaagaactggccaaccaaatttgaacccctcaaaaaaaaattgctgggaag

SEQ ID NO: 53689 - protein, 148 aa, Zea mays
  misc_feature: Ceres CLONE 1475670-F
  misc_feature (66)..(66): Xaa is any aa, unknown, or other
MAATAYSVALLGGARLPAAFLPRRSSVCHHQLRLQDAPRLISLHRARAASEDTSASGGDELIEDLXAKWDAVEDKPTVLLYGGGAVVALWLTSVVVGAIHAGAAAPQDPGARWPRLHGLVRLPVLPLQANQGRTGQPNLNPSKKNCWE

SEQ ID NO: 53690 - DNA, 651 bp, Zea mays
  misc_feature: Ceres CLONE 1475679-F
  misc_feature: Encodes the peptide sequence at SEQ ID NO. 53691
  misc_feature (632)..(632): n is a, c, t, g, unknown, or other
aagctggagctccccgcggtggcggccgctctagaactagtggatcccccgggctgcaggaattcgtctcacccctagaaaaaaccactcatcaccagctagtagctctagcaaagcacttgccatctaccgaccgccgcattccaaacagcccgacgagctagcagagcggcaggcacctcctccaggaacatggcccgcacgcagcagttggcagtagtggcgacagccgtggtggccttggtgctgctggcggcggcgacgtctgaggcggccatcagctgcgggcaggtggcgtcggccatcgcgccctgcatctcctacgcgcgcggccagagctcagggccctccgccggctgctgcagcggcgtcaggagcctcaacaacgccgcccgcaccaccgccgaccgccgcgccgcctgtaactgcctcaagaacgccgccgccggcgtcagcggcctcaacgccggtaacgccgccagcatcccctcgcagtgcggcgtcagcatcccctacaccatcagcacctccaccgactgctccagagtgaactgatccctaaacgacgacgacagcgccggccgccgcctgaatacaatcatatctatcccgccgtcatcggcgcatgcggntcggaccgtcatgaccatt

SEQ ID NO: 53691 - protein, 120 aa, Zea mays
  misc_feature: Ceres CLONE 1475679-F
  misc_feature (31)..(116): Pfam Name: Tryp_alpha_amyl Pfam Description: Protease inhibitor/seed storage/LTP family
MARTQQLAVVATAVVALVLLAAATSEAAISCGQVASAIAPCISYARGQSSGPSAGCCSGVRSLNNAARTTADRRAACNCLKNAAAGVSGLNAGNAASIPSQCGVSIPYTISTSTDCSRVN

SEQ ID NO: 53692 - DNA, 653 bp, Zea mays
  misc_feature: Ceres CLONE 1475697-F
  misc_feature: Encodes the peptide sequence at SEQ ID NO. 53693
aagctggagctccccgcggtggcggccgctctagaactagtggatcccccgggctgcaggaattcgtctcacccctagaaaaaagccaagcatataagacgacttgtttcattgatacttgaagagatcgagcttcttttgcacctcaatggcgaggatgtcttgcaactgcggagcaagctgcggctgcagctcaggctgcaagtgcggcatgaagtaccctgacctggaggacaccagcaccgcagcgcaggccagcgtcgtcctcggcgtggccccggacaacaacgtcgcgccctacttcctcgaggacgcgatcagagatccagctaggccgcccacgcctgcgactgcaccagcaactgcaactgcgaccactgcaactgctgatcacatcgatcaacgaccatggatatgatcatgatctatctagctcgcgccggtgcttgaactatatggacgacggcgagctgactgccaggacacacatatgacgagacgctcgaggtaccaattcaccctatagagagtagaagtacacgcgctcactgacgatgattttaagcgtcattactggaagaacctagctctagctgattaataactggcaacacatccccctatcacaggtggcgtttagagaacaggcccga

SEQ ID NO: 53693 - protein, 89 aa, Zea mays
  misc_feature: Ceres CLONE 1475697-F
  misc_feature (4)..(63): Pfam Name: Metallothio_2 Pfam Description: Metallothionein
MARMSCNCGASCGCSSGCKCGMKYPDLEDTSTAAQASVVLGVAPDNNVAPYFLEDAIRDPARPPTPATAPATATATTATADHIDQRPWI

SEQ ID NO: 53694 - DNA, 688 bp, Zea mays
  misc_feature: Ceres CLONE 1475706-F
  misc_feature (389)..(389): n is a, c, t, g, unknown, or other
  misc_feature (575)..(575): n is a, c, t, g, unknown, or other
ggatcccccgggctgcaggaattcgtctcacccctagaaaaaaggggaccactactagacgacgaggaggaggagggaaactgaaactgaaaactagcggcggccggagaaagagagctgcgtagcggcgctggtctccatccatcgatttgttttggtggcttcttcgcatgtgattccgccagtaggagtgttgcttatatatacctcctcctcggttcctccacaacgtctagatcatcagatccagagggtaaaacggaatagtctattcccagcagtgataaacaaaataaagaatcttctctgtcttcgtgcggtgtgcctgccattttcaggcccaactgatcattctcgaggctccttatattgtagagcccccccccacncatcatatcgagaggctgaggggagacggatccatggacctgggaaagcccctttcggcgcacagatgtagctacaccgctacctacatccactgttcaataggcttctcccctctggtcgtccgtaccaacttggatcctccgcggccggttgagggcgtctaatgacggggctattaccggganaccggagaaggcgttcaactttcccccccccattgggtcccaatggtaccatcgaaggactcgccggcttgccccccgggtgggtttctcatcccggagggttccccgcccgg

SEQ ID NO: 53695 - DNA, 674 bp, Zea mays
  misc_feature: Ceres CLONE 1475716-F
  misc_feature: Encodes the peptide sequence at SEQ ID NO. 53696
  misc_feature (625)..(625): n is a, c, t, g, unknown, or other
  misc_feature (674)..(674): n is a, c, t, g, unknown, or other
aagctggagctccccgcggtggcggccgctctagaactagtggatcccccgggctgcaggaattcgtctcacccctagaaaaagtgctctctcagaggtgggctggcttctcctccccctcttaccaagtcctcctcgggttacggttccttatggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcagcttcgttaccttctcctccgagaactccatgctcgacgctatcgagaacatgaacgggaaggagctcgacggccgtaacatcaccgttaaccatgcccagtcccttggcagtggcggtggcggcggtggctactgctgcggtcgcggcggcagcggctatggtggctggcgccgtgacggcggttatgacggcggtggcgtctacggctgtcggcacgagggtgttggcagcagctacggatgctgtggcggctaccgcggtcggctccagggtgatggtggctgctacagctgcagcngacgtcgctggaaggactgatgtgttggcccatcctgtcctcggccgan

SEQ ID NO: 53696 - protein, 157 aa, Zea mays
  misc_feature: Ceres CLONE 1475716-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (152)..(152): Xaa is any aa, unknown, or other
MAAADVEYRCFVGGLAWATSNESLENAFASYGEILDSKVITDRETGRSRGFSFVTFSSENSMLDAIENMNGKELDGRNITVNHAQSLGSGGGGGGYCCGRGGSGYGGWRRDGGYDGGGVYGCRHEGVGSSYGCCGGYRGRLQGDGGCYSCSXRRWKD

SEQ ID NO: 53697 - DNA, 694 bp, Zea mays
  misc_feature: Ceres CLONE 1475718-F
  misc_feature (561)..(561): n is a, c, t, g, unknown, or other
aaagctggagctccccgcggtggcggccgctctagaactagtggatcccccgggctgcaggaattcgtctcacccctagaaaaaacccatctccgcgccgcacccgcaacgcgtctctcttcctctcctggtcctcctgccactccgcctcaacttgctcggctattcccggattgcggctcggggttggtcattggccgtgagggcctttcaagaacgggcggcggcgctttacctgacgcaaattgcgccggtctcctgccttgctgcgcgcttgggggttgggctcaggaatgggggtagagcaggggctgcgtcgcctggctcgattcccatctctctgaacttagatggatgcatctgtaaacaccaagaagaaggttagtttttgtgggaacactggccacagccgctgcggcgaagttcatttagctgctgtgtgctcaggtcgtatgcgaagcaaccccttctcgcttcaggtttggtttgcatttccgttcaagtataaaggaagtagtatttgccattttggcatagcatttgaatagcacaggaacctangaaacagtgttccagcagtactacgttatactggtgttatactattatagaaaacatggtggatgtggaactgttttataaggacactagtgatcacagcattagctctgaggaagagatatgcttgtcagga

SEQ ID NO: 53698 - DNA, 828 bp, Zea mays
  misc_feature: Ceres CLONE 1475731-F
  misc_feature: Encodes the peptide sequence at SEQ ID NO. 53699
  misc_feature (35)..(35): n is a, c, t, g, unknown, or other
  misc_feature (46)..(46): n is a, c, t, g, unknown, or other
  misc_feature (49)..(49): n is a, c, t, g, unknown, or other
aattcattaatcagaacgaaactgtttcataaatncctctccgggnggntctgagctggagctccccgcggtggcggccgctctagaactagtggatcccccgggctgcaggaattcgtctcacccctagaaaaaacccggagccccgcctccgcctcggtctccgcatcccgctcctccactccacccccacccatggccaacatcccggacgccgacgccgcggggttcaagctcttcggcaaggtcatccagccccccgacgcgcagcgcgccgcgggccatggcgcccctccgccgtcgccgccggtgcttcctcctcctcctcctcctccgcccccgccgcagcctctgcccctgcagcaggcggcccggggccagggggcaccggagtgctacccgctggcgtgaccctcggggccgacagacgggggagaacacatttctggctactttcccaaacatacaagggggccgccaatccaacgccaccttctgaaaatggcctagcttctcgtctgcaggaactcggtcctggcggttgcagcttcccctccacgtgggcccttccggctgtaccccggggcccccccctcaatgctcggccgccggcaaatgtgcgctgatattctgccctaccttcccgcctgacctactcctattcaatggcctaccactttcctctccataggaatgtcttgcttccgtgcgcaacctgtattgaactcttctctcatcgtatacctctttctccacctgcacacattcctcccatcgaggtggacacccccttaaagcctctctgtctacatgtatagagtgttgctt

SEQ ID NO: 53699 - protein, 71 aa, Zea mays
  misc_feature: Ceres CLONE 1475731-F
MANIPDADAAGFKLFGKVIQPPDAQRAAGHGAPPPSPPVLPPPPPPPPPPQPLPLQQAARGQGAPECYPLA

SEQ ID NO: 53700 - DNA, 700 bp, Zea mays
  misc_feature: Ceres CLONE 1475738-F
  misc_feature (575)..(575): n is a, c, t, g, unknown, or other
  misc_feature (700)..(700): n is a, c, t, g, unknown, or other
aaagctggagctccccgcggtggcggccgctctagaactagtggatcccccgggctgcaggaattcgtctcacccctagaaaaagttcgtgggcaacgcgctgggcggcctccgcgggtggagcaacctcgcctcctggaccgtcgccggaaccctcgcctactacctctgggtgaagcccgcgcgccagctccagaaggagcaggaggagcgagccgctttggctgctgcaacggatccttatcgttacgtcgagaagcggaaaccgattcctgatccacaggacactggccttatctatgggaagaagagggagcctaccaaatctcaagattagctagcgccctgggcacatcttgtaccaaatgtgccgccagtttatgtgcaacaataccaggaatggtttctgcgtatctgctggatacatggtaaacgttttttttcatgaaactgttcctgctttgtgcgagcaaaaagcagctgtagatggattttcagtctgggtacttgagcggttgtgcccaggaagtgttgttcatcttcactatcgtccaggagagatgaagaggctttcngaatggaccaaaagagagagagaggatgatttctgtactttttttatagccagttaatcattgttgggcggtttaagtgtccccctaaccaatggaccccaagggccacggggcttttttgtttn

SEQ ID NO: 53701 - DNA, 723 bp, Zea mays
  misc_feature: Ceres CLONE 1475741-F
aaagctggagctccccgcggtggcggccgctctagaactagtggatcccccgggctgcaggaattcgtctcacccctagaaaaagttggacaaggtctagttcggtgttgtgtatggaacggtcgtcactgagtcatgcacgatttggtatccgtgtgtttatgttcgccggtttgaggaaaaagcggcggcaggccaggccagcagagcgcagaggaccgccgctcggaaagtgcggagccgtttcccctctagctgctcatgctctctgcttgcctccgtccactcacagcccacgtccacgcctcgcgctcttctccaggctcccaggtgctccccgatcaatcgcttccgctgctagcgcgcgcgcgatccccgaagtcgcgcgcttgatcgcgctcaacgccatgtcccccccccccggcgggtatggcggccggcgcggcccgggaagcgccccaaagcccacggccccccgaacttctgctgcacccccatgcaaaacaagtccccccgcaacaacttttccacgggccccaaaaaaaccgccccagagaaactgggtttccccccagaagaaagggcccccaaaaggccttccttttccttcccccaaaaaaaaagggggaggggggggggcctggccccccccctccccccccccacggggtttttattctcaaagggttctttttctaccaggggttcatatttctcgcgaaa

SEQ ID NO: 53702 - DNA, 688 bp, Zea mays
  misc_feature: Ceres CLONE 1475745-F
  misc_feature: Encodes the peptide sequence at SEQ ID NO. 53703
aaagctggagctccccgcggtggcggccgctctagaactagtggatcccccgggctgcaggaattcgtctcacccctagaaaaactcgtcgagagagtcgtccccccgcgtgctctccgcctgcggcctctgtatcccgcaaccaaaaactacccccaaaaaaagaagaaaaccccaaatcctcgagatctatcagtatcgagcgacttaccaatccgattgctagggtttagtttcgaaaaaatctgaaaaaaattctggtcgaggggaggaggcgatgtcggcgcaagtggcggtggtgcctaatgggggcccgggcgctgtccccgcggtggtgtcgccgggagctgtcggcgtggctcagcctctcccgaccacgtcgctctacgtgggcgacctggagggggccgtctcggactcgcagctgtacgaactcttcagccaggcggggcaggtggtgtcggtgcgcgtctgcagggatgtcacctcgcgccgctcgctcggatacgcctacgtcaactacagcaatcccttggatgctgcgagagcattggaagtgctgaactttgctgctcttaacacaagcctatccgggtgatgtattcaaaccgtgatccaagcagccgcaggagtggatctgctaacattttcataaaagatcttgatcagacaatagacaatagaaccc

SEQ ID NO: 53703 - protein, 106 aa, Zea mays
  misc_feature: Ceres CLONE 1475745-F
  misc_feature (36)..(107): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSAQVAVVPNGGPGAVPAVVSPGAVGVAQPLPTTSLYVGDLEGAVSDSQLYELFSQAGQVVSVRVCRDVTSRRSLGYAYVNYSNPLDAARALEVLNFAALNTSLSG

SEQ ID NO: 53704 - DNA, 684 bp, Zea mays
  misc_feature: Ceres CLONE 1475748-F
  misc_feature: Encodes the peptide sequence at SEQ ID NO. 53705
  misc_feature (620)..(620): n is a, c, t, g, unknown, or other
  misc_feature (634)..(634): n is a, c, t, g, unknown, or other
aaagctggagctccccgcggtggcggccgctctagaactagtggatcccccgggctgcaggaattcgtctcacccctagaaaaaacccatcccttcccctcccacacgacacacccacccacagcacccaattccctcgcgccccccttctcccgcatcacacatccaccgccgccgccaccaccaccacccgccctatacccgtatataattactcgtacccggacgccaccgccgcctgcgccatgggcgactcctcggtggccggcgcgctcgtgccgtccgtgcccaagccggagcccgcgccgtccggtgacacctccgcggcggccgcggcgactacagcggcgctggcgatgccagaggaggcgggtatgcgcgcggcgtcggcgtcgcctcatgggcctgcggaggagggggagggccccgccgatagggaccttctctgcccgatctgcatggccgtcatcaaggacgccttcctcaccgcatgcggccacagcttctgctacatgtgcatcgtcacgcatctcagcaacaagagcgactgccccgtgctgcgccactaccttaccaagacccagctctaccccaactttctccttgacaaggttctgaangaaatatcagcccnacaaatagcaaagacagcatcgccaatcgatcaatttcgatgtgcattgc

SEQ ID NO: 53705 - protein, 146 aa, Zea mays
  misc_feature: Ceres CLONE 1475748-F
  misc_feature (68)..(105): Pfam Name: zf-C3HC4 Pfam Description: Zinc finger, C3HC4 type (RING finger)
  misc_feature: The sequence is a functional homolog of SEQ ID NO 13 in US patent 7208652
  misc_feature (125)..(125): Xaa is any aa, unknown, or other
  misc_feature (130)..(130): Xaa is any aa, unknown, or other
MGDSSVAGALVPSVPKPEPAPSGDTSAAAAATTAALAMPEEAGMRAASASPHGPAEEGEGPADRDLLCPICMAVIKDAFLTACGHSFCYMCIVTHLSNKSDCPVLRHYLTKTQLYPNFLLDKVLXEISAXQIAKTASPIDQFRCAL

SEQ ID NO: 53706 - DNA, 807 bp, Zea mays
  misc_feature: Ceres CLONE 1475750-F
  misc_feature: Translation starting site: 149
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (459)..(459): n is a, c, t, g, unknown, or other
  misc_feature (461)..(461): n is a, c, t, g, unknown, or other
  misc_feature (462)..(462): n is a, c, t, g, unknown, or other
  misc_feature (807)..(807): n is a, c, t, g, unknown, or other
tagcccccacccccccccacccccnnnncnnnnnnttgttnnnnnnccaaagctggactccccgcggtggcggccgctctagaatagtggatcccccgggctgcaggaattcgtctcacccctagaaaaatcccttctcccgatcacaatggcactccaggcagcctacgagtacctgcagcaggccgtcggccatggtgcgtggtcgtccacgcagacgctgacgctgctgctcatcgccgtacccaaccgtactactgctgctagcgtccctcgccaagagcacgtcgtcgtccggaaagggcaagccgccgctccctccctcgccgccgggcaccctccccatcgtggggcacctacaccacatcgggtcccagacccacatctcgctccatgagctggtggccaagtacgggaacaacggaacccctattcccccacgccagctctgtgcctaancnnccaccccccccaccacccaaaggcagccaaaggcccttaatgtcgcacccaccaaccacatcccttcagattcccggaccgggggcccatgggccctccccacttttcctcccgctacaataaactggggcacgtggagcctttcttctcccgcttcggaaaaatacctggtccacattaccccctgaagacggaatgtacactcccccctggcctctggacccacgtaaagttccggcttattgcccgcccagggcccgaaaaagacacaagttgtgctcccctcctctggaacaactttctgcggcgggaatttcctcaattcgccccgccccccgccccagn

SEQ ID NO: 53707 - DNA, 655 bp, Zea mays
  misc_feature: Ceres CLONE 1475751-F
  misc_feature: Encodes the peptide sequence at SEQ ID NO. 53708
ggagctccccgcggtggcggccgctctagaactagtggatcccccgggctgcaggaattcgtctcacccctagaaaaactcgtcgcagcccccgaggccccaactacccccagtctcggaagagaactatccagaagcgcatgactccaaagccgtcgccttcctatccatcccttcctcgcacacgggggtcgcctgagatcacataaacaatggtgaaggctgttgctgtgcttggtagcagcgatggtgtcaagggcaccatctttttcacccaagtgggagatggccctaccactgtcaccggaagtgtctctggcctcaagcctggcctccatgggtttcatgtgcatgcgcttggtgacaccaccaatggctgcatgtcaactggaccactctacaatcctgcgagcaaggaacatggagcaccagaagatgagaaccgccatgccggtgatcttggaaatgtgacagctggagcacatggcgttgctaacattaatgttaccgacagcctgatcccactgactgggccaaactcaatcatcggcagagctgctgttgttcacgctgaccccgatgatcttggtacaggtgtacactagctcagcaagagcaccggatacgctggcgggcgtgttgcttgtgggatcat

SEQ ID NO: 53708 - protein, 130 aa, Zea mays
  misc_feature: Ceres CLONE 1475751-F
  misc_feature (1)..(129): Pfam Name: Sod_Cu Pfam Description: Copper/zinc superoxide dismutase (SODC)
  misc_feature: SWISSPROT Homolog: EC 1.15.1.1 Superoxide dismutase
MVKAVAVLGSSDGVKGTIFFTQVGDGPTTVTGSVSGLKPGLHGFHVHALGDTTNGCMSTGPLYNPASKEHGAPEDENRHAGDLGNVTAGAHGVANINVTDSLIPLTGPNSIIGRAAVVHADPDDLGTGVH

SEQ ID NO: 53709 - DNA, 700 bp, Zea mays
  misc_feature: Ceres CLONE 1475754-F
  misc_feature: Encodes the peptide sequence at SEQ ID NO. 53710
aagctggagctccccgcggtggcggccgctctagaactagtggatcccccgggctgcaggaattcgtctcacccctagaaaaaattccttgcattagtctcagctgacggacgactgaaccaccgacagacaacatgggcgcctccgactccaccgtctccggcctcgccggcgcctccctggccagccgcccggcgttctccaccagcttcacgcggggcagccgggtgtcggcgaggcaaccccctgatgagcaggaacctgcagaggaatggcaggatcacctgcatgacgtttccccgggactggctgcggagggacctgatcgtcatcggattcgggctcatcggctggatggggccgtccagcgtcccggccatcaacggcaacagcctcacggggctcttcttctccagcaccggacaggagctggcccacttccccacgcccccgcccgtcacctcccagttctggctgtggctagtgacgtggcacctgtggcctgttcatcgtggttcaccttccggcaagatcccgatttcaagggccggaaccgaggcactacttcggagaaaatgaaagcgggctaaagagtcctatcccatcaatcccctgtggtcttgcgcctggctattgccgtttgcaaggcccttcctccccccgcaaacccgaaacccttttggcctggaataaagggctc

SEQ ID NO: 53710 - protein, 109 aa, Zea mays
  misc_feature: Ceres CLONE 1475754-F
MSRNLQRNGRITCMTFPRDWLRRDLIVIGFGLIGWMGPSSVPAINGNSLTGLFFSSTGQELAHFPTPPPVTSQFWLWLVTWHLWPVHRGSPSGKIPISRAGTEALLRRK

SEQ ID NO: 53711 - DNA, 660 bp, Zea mays
  misc_feature: Ceres CLONE 1475757-F
  misc_feature: Encodes the peptide sequence at SEQ ID NO. 53712
  misc_feature (407)..(407): n is a, c, t, g, unknown, or other
  misc_feature (495)..(495): n is a, c, t, g, unknown, or other
aagctggagctccccgcggtggcggccgctctagaactagtggatcccccgggctgcaggaattcgtctcacccctagaaaaaagatccaccctgccgcctcaccgcctctctcaatctgataccgcatatccgtcgtccggtgagtggaagccgcacgaacccatggcctccggcgagcttgcctgcacctacgccgctctcatcctcagcgacgatggcatcgccatcaccgccgagaagatcgccacgatcgtgaaggcggccaacatcaaggtcgagtcctactggccggccctcttcgccaagctcctggagaagcgcaacgtctaggacctcatcctctccgttggatctggtggcggagctgctccagttgctgctgccgcacctgctggtggtgctgcngctgctgctgcccacggctgtcgaggagaagaagcatgagccaaggaggagtctgatgacgacatgtgcttcagcctgttcgactgangagaccccctcacccagccattagcatatttcacttgtgctgtcaaagaccatcttgccttaaggtaagccgcaacgcttttgataccactacccaagttttgagtttttgaaatgatgctatggaatgaactcaaccatctatggaggtgaaactgtttctaat

SEQ ID NO: 53712 - protein, 55 aa, Zea mays
  misc_feature: Ceres CLONE 1475757-F
MASGELACTYAALILSDDGIAITAEKIATIVKAANIKVESYWPALFAKLLEKRNV

SEQ ID NO: 53713 - DNA, 635 bp, Zea mays
  misc_feature: Ceres CLONE 1475758-F
  misc_feature: Encodes the peptide sequence at SEQ ID NO. 53714
aagctggagctccccgcggtggcggccgctctagaactagtggatcccccgggctgcaggaattcgtctcacccctagaaaaaacctcggcctctgctcccggctcccccacggtactccagccgctagcctgcgattccgccagtacgccaccaccaccgagcctggactaccgccgccgcccttcgccgatatcttcagcggcgaacagcgcccaccagatcccgcccctgcgatggagtccgtggtgaacccgaaggcatacccgctggctgatgcgcagctgacgatgggtatcctcgatatcatccagcaggccgccaactacaaacagcttaagaagggagcgaatgaagcgacgaagaccctgaataggggcatatcggagtttgtagtgatggcggcggacacagagcctctcgagatcctgctccacctcccctttgtagctgaggataagaacgtgccatatgtgtttgttcatcgaagcaagctcttggccgtgcttgtggtggacaagacggttattgcttgctcagtgaccagtaatgaaggtagccagctgaaactacgatacagggtcccaggactccattgagaagctcccatctgatctgccgaagcctttcagtggg

SEQ ID NO: 53714 - protein, 120 aa, Zea mays
  misc_feature: Ceres CLONE 1475758-F
  misc_feature (19)..(112): Pfam Name: Ribosomal_L7Ae Pfam Description: Ribosomal protein L7Ae/L30e/S12e/Gadd45 family
MESVVNPKAYPLADAQLTMGILDIIQQAANYKQLKKGANEATKTLNRGISEFVVMAADTEPLEILLHLPFVAEDKNVPYVFVHRSKLLAVLVVDKTVIACSVTSNEGSQLKLRYRVPGLH

SEQ ID NO: 53715 - DNA, 693 bp, Zea mays
  misc_feature: Ceres CLONE 1475763-F
  misc_feature: Encodes the peptide sequence at SEQ ID NO. 53716
  misc_feature (671)..(671): n is a, c, t, g, unknown, or other
agagctggagctccccgcggtggcggccgctctagaactagtggatcccccgggctgcaggaattcgtctcacccctagaaaaaacctcacccgctgatccattcattgatcaggggcacacacgccacggcagccgacaccacacgacactccccgagcacacacgccgcaatagcaccacccccagacccaagtcctgtcaaggcctcaacacacacacacactctctcgcttgacctacccccctccgccccccgccgggcctgcagggtgttcgacgcttcgcccgcccgcccgagcgccgccacggcatggcttcctccatctccgccgccgctaaggcctccgcggcctttgcccaaaagaaggagctggccgcgccggcgccgcaccgcgcgggctcgagccgtcagaccaagccgtgccgcgtgcgcgccgtcgcgtcgcccgcgcgcaccccccgcgccccgtcgtccaccggctcggtgaagaccgcgatgacgatgacggagaagatcctggcgagagcgtcagagcgcgcggcgctggagcccgaggagaacgtgtgggtggacatcgacgtgctcatgacgcacgacgtctgctggcccggcaccattcgcatcttcaagaagggagtcggggaggatgccaaggtctgggaccgcgnagaggtcgtcatcatccccgac

SEQ ID NO: 53716 - protein, 127 aa, Zea mays
  misc_feature: Ceres CLONE 1475763-F
  misc_feature: SWISSPROT Homolog: EC 4.2.1.33 3-isopropylmalate dehydratase
  misc_feature (120)..(120): Xaa is any aa, unknown, or other
MASSISAAAKASAAFAQKKELAAPAPHRAGSSRQTKPCRVRAVASPARTPRAPSSTGSVKTAMTMTEKILARASERAALEPEENVWVDIDVLMTHDVCWPGTIRIFKKGVGEDAKVWDRXEVVIIPD

SEQ ID NO: 53717 - DNA, 728 bp, Zea mays
  misc_feature: Ceres CLONE 1475768-F
  misc_feature: Pfam Name: Auxin_resp Pfam Description: Auxin response factor
  misc_feature (603)..(603): n is a, c, t, g, unknown, or other
aaagctggagctccccgcggtggcggccgctctagaactagtggatcccccgggctgcaggaattcgtctcacccctagaaaaatgtcataccactcgtaaagtatgttaaggctgtgtatcatacccgcatatctgtggggatgcgattcaggatgctttttgagacagaagagtctagcgttaggagatacatggggacaattaccggaatctgtgatcttgattctgttcggtggccaaattcacactggcgttctgttaaggttggctgggatgagtcaactgctggtgagcgacaaccaagggtgtcactatgggagattgaacccctgacaactttcccaatgtatccatctccttttccgctcaggctcaagcgtccatggccaacaggcttgccttctctgcatggcgccaaggatgatgacctggctaactctctcatgtggcttcgagataccgccaatcctggttttcagtcgttaaattttggtggacttggtatgaagcccttgaatgcaacccagggctggatgctaccttacttggtcctgcaacctggacatggatccagggggagggccaccgcctgctttttaanggggcaaccaaggcagggattcccccccaaatgtttgcagtttccagcaccccccagaaacaagcttgggccggggctttccccggtttctttttaaggccagaatttttgcccccagccccccc

SEQ ID NO: 53718 - DNA, 852 bp, Zea mays
  misc_feature: Ceres CLONE 1475770-F
  misc_feature: Encodes the peptide sequence at SEQ ID NO. 53719
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
gggctccccgcccctaaccccccaccccccnnnnnnggggcnnnnnncacaacggaactccccgcggtggcggccgctctagaatagtggatcccccgggctgcaggaattcgtctcacccctagaaaaactccttcctttcagtcagccagccagccatggagacggcctccttcctttcagtggcgctggccctggcggccctcgtccccgtctcgctgctccttgtgaaccggctcctctacggcaagctgcccccggggccgcggcggcggcccgtggtgggcaacctgttccacgtgcaacccgtgcggtgccggtgctaccagcagtgggcccgccggtacgggcccattatgaccgtgtggctgggaacggttacctagagtggtgggaatctatgttgggagatggggcaagggaggggcctcacaaaccccctaacgtaagggttgtggcggaccggttttttcccccacgcggcgccccaccaaaacgctttcaactctccgagccaccccaccggaacccccaagccggggcccgaacaccaccgttccccccccctatagacctgagggggggcggggcagaatgttctgggtcaaccctcaccaagagttcttccgtcccgtagaagctctgtacttcagaaggggccccccccgcgccgcgcttcggctagggcaaagaagaataaccgcccgccggaggcagaaaacgccccccttcaccaaggaccccccgacccgtcccccgcttatgcccattcattgacaatctattttgtgtgtgttaaaatgatagcgcttgcccccaatagtccttgttgctctctacccccaccgccgc

SEQ ID NO: 53719 - protein, 75 aa, Zea mays
  misc_feature: Ceres CLONE 1475770-F
METASFLSVALALAALVPVSLLLVNRLLYGKLPPGPRRRPVVGNLFHVQPVRCRCYQQWARRYGPIMTVWLGTVT

SEQ ID NO: 53720 - DNA, 739 bp, Zea mays
  misc_feature: Ceres CLONE 1475778-F2
  misc_feature: Pfam Name: DUF390 Pfam Description: Protein of unknown function (DUF390)
aaagctggagctccccgcggtggcggccgctctagaactagtggatcccccgggctgcaggaattcgtctcacccctagaaaaaaacgcagtaccgcaccaccaccaagcaccgcaaccggagccggagccagaggagggcgagaggccgaggggagaggagcgaaggaggccgccgaccgaccgtgcgtccggccccgcggcggcgtcggcaggtcgtagacggcagacgaggagcagcagcagcacgaggcggccgggcccgggccacgccttgccggagaaggaggcgcaggccgccgcgttctgcggctaggcggtgatcgccgagttccagtccctcacgcggggacgccgcctgccgtgccgcgtgaggggctgcacctggattcttgttataaaacgtcctgaggctgtgcccccccccctgcccggggcctttcggggccggcatctgacttctgtctatcttcccccgccctgccttggccgctcgcccccgcagcggccggactttgtagcccctaactttgcgcgaattccttcatttgggggcgcttgttcccccggggccccccgcggaatgtttctgcccccctgcgatttctcctcctgggtttgtgccccgacccttggggggtatggtcacggtccccgctccctttcttctttgggggtttttcctccggctccccccgactgtttggtttttttccggcactttctctccacgccctccg

SEQ ID NO: 53721 - DNA, 739 bp, Zea mays; identical to SEQ ID NO: 53720
  misc_feature: Ceres CLONE 1475778-F
  misc_feature: Encodes the peptide sequence at SEQ ID NO. 53722

SEQ ID NO: 53722 - protein, 104 aa, Zea mays
  misc_feature: Ceres CLONE 1475778-F
KAGAPRGGGRSRTSGSPGLQEFVSPLEKNAVPHHHQAPQPEPEPEEGERPRGEERRRPPTDRASGPAAASAGRRRQTRSSSSTRRPGPGHALPEKEAQAAAFCG

SEQ ID NO: 53723 - DNA, 727 bp, Zea mays
  misc_feature: Ceres CLONE 1475780-F
  misc_feature (727)..(727): n is a, c, t, g, unknown, or other
agagctggagctccccgcggtggcggccgctctagaactagtggatcccccgggctgcaggaattcgtctcacccctagaaaaagcgcggcgagagcgggccgccgcgtgccggccgggggacggaccgggaacggccccctcgggggccttccccgggcgtcgaacaaccgactcagaactggtacggacaaggggaatccgactgtttaattaaaacaaagcattgcgacggtcctcgaggatgctgacgcaatgtgatttctgcccagtgctctgaatgtcaaagtgaagagattcaaccaagcgcgggtaaacggcgggagtaactatgactctcttaagtagccaaatgcctcgtcatctatttagtgacgcccatgaatggattaacgagatttccactgtccctgtctactatccagcgaaaccacagccaagggaacgggctttggcggaatccgcgggggaaagaaaacccctgttgaaccttgacttctatcccgactttttgaaaatgaccttggaagggggagaaaaaatggggagcctcccgggcccaagtgaaaaaaccccacctttaaacgtttttttatatttttccccggggtccgaaaagggggcccccccccctcttttttgggtcctagggggccgtggtttttcgggagccattctctgggggaaaaaaaattttcaggggggggagttttggccgggcgcccccn

SEQ ID NO: 53724 - DNA, 683 bp, Zea mays
  misc_feature: Ceres CLONE 1475782-F
  misc_feature: Encodes the peptide sequence at SEQ ID NO. 53725
aaagctggagctccccgcggtggcggccgctctagaactagtggatcccccgggctgcaggaattcgtctcacccctagaaaaagatcccatacattgccacttgtcggggaggagagtccggagctgagacggcgagctgcctagctccgttcctgctctatatctcagctcctccgttctgtcctgtggccccgagctgagctgccaaggatacgtacgtacgtacgtcttgagggaggctgccggtcgccctcttctctcgtcgacctcgtcggggttatgcggaggagcaggtcgtgcttgtcctgcgtgcccatggggacggcggcgctgcccattgagaaccacttcgtcgctccggctgcgctaccgtcggtgcccgcctcagattcagaggacggaggatttggcaaggccaccatacaccttggaggcctagaggtgcgccaggtcaccacgtttgccaaggtctggtccaccacacagggcggccaagacggcctcggcgccaccttcttcaagccctcgccggtgcccgccggcttctccgtgctcggccactacgcgcagcccaacaaccggcctctcttcggccacgtcctcgtcggccgggacacgtctggcgccggcggtgcgctcctcgccgcgccagtggactacgccctcgtctggtccagcccg

SEQ ID NO: 53725 - protein, 134 aa, Zea mays
  misc_feature: Ceres CLONE 1475782-F
  misc_feature: SWISSPROT Homolog: EC 3.4.23.21 Rhizopuspepsin
MRRSRSCLSCVPMGTAALPIENHFVAPAALPSVPASDSEDGGFGKATIHLGGLEVRQVTTFAKVWSTTQGGQDGLGATFFKPSPVPAGFSVLGHYAQPNNRPLFGHVLVGRDTSGAGGALLAAPVDYALVWSSP

SEQ ID NO: 53726 - DNA, 873 bp, Zea mays
  misc_feature: Ceres CLONE 1475789-F
  misc_feature (27)..(27): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (67)..(67): n is a, c, t, g, unknown, or other
  misc_feature (492)..(492): n is a, c, t, g, unknown, or other
  misc_feature (503)..(503): n is a, c, t, g, unknown, or other
  misc_feature (504)..(504): n is a, c, t, g, unknown, or other
  misc_feature (678)..(678): n is a, c, t, g, unknown, or other
tgttcccccacaccccccccccccccncccnnnngggggccccnnnncactcttccatccctccccnttggggtcgttctacactagtggatccccccggctgcaggaattcgtctcacccctagaaaaaaaaaaacattccattctcaacgcaacggtttcgccccgctttataggccgtcgcccgcgccacatcgccactgtttcgcatcgtcgcggccacccattctctctcgtccatcgcaccgctccggctctcagcgcaatcgatccattcgttccttagggtgtttcacctatgccgctaagctgcgtccttcccctaccagtttataccctgtatgtagccctctcaggataggccttttttctgttccggttgcccttagcataaggagcactttgtgttttttttctcccccggagggggacgagggggggggaggtcctcccccctcctattttattttttggtgtgtgcccacccccccnaccaacaaaanntaataatatcctgttttttcacgagccccggcctcgcgaccataaaccggaattggcggcgtcgcgcttaccttcggattctcgcgatgggatgtgattttccccaacgaggagttgcgtcggtccccgatttaacccccccgaggtgccacctggccgacctcacaatcgggntgccacccgtgagcgaccacgaccccccaagcaccccccccggtggttcttttagtaccgtcgcccccgccccagcgccgcgttttccgccgcccccgccgtttggctggtgtgtaacacgttggtccctgtcgttacaccggcgccccccattctaatctttcgttacttttacgtaactgtgggtcggtcgcg

SEQ ID NO: 53727 - DNA, 658 bp, Zea mays
  misc_feature: Ceres CLONE 1475791-F
  misc_feature: Encodes the peptide sequence at SEQ ID NO. 53728
  misc_feature (547)..(547): n is a, c, t, g, unknown, or other
ctggagctccccgcggtggcggccgctctagaactagtggatcccccgggctgcaggaattcgtctcacccctagaaaaattcgttgcagtagtcgcagctgacggacgactgaaccaccgacagacaacatggccgcctccgcctccaccgtctccggcctcgccggcgcctccctggccagccgcccggcgttctccaccagcttcacgcggggcagccgggtgtcggcgaggaaccccctgatgagcaggaacctggagaggaatggcaggatcacctgcatgacgtttccccgggactggctgcggagggacctgagcgtcatcggcttcgggctcatcggctggatggggccgtccagcgtcccggccatcaacggcaacagcctcacggggctcttcttctccagcatcggccaggagctggcccacttccccacgcccccgcccgtcacctcccagttctggctgtggctagtgacatggcacctgggcctgttcatcgtgctcaccttcggccagatcggatttcagggcaggaccgangactatttcgagaagtgaaagcggtatgatcggatccatcatcgctggtgctgcgttgcgtgcgtgcctgccgcaatcgaacctttgctgtgtatagggtccgaattcgtg

SEQ ID NO: 53728 - protein, 144 aa, Zea mays
  misc_feature: Ceres CLONE 1475791-F
  misc_feature (139)..(139): Xaa is any aa, unknown, or other
MAASASTVSGLAGASLASRPAFSTSFTRGSRVSARNPLMSRNLERNGRITCMTFPRDWLRRDLSVIGFGLIGWMGPSSVPAINGNSLTGLFFSSIGQELAHFPTPPPVTSQFWLWLVTWHLGLFIVLTFGQIGFQGRTXDYFEK

SEQ ID NO: 53729 - DNA, 689 bp, Zea mays
  misc_feature: Ceres CLONE 1475795-F
  misc_feature: Translation starting site: 188
aaagctggagctccccgcggtggcggccgctctagaactagtggatcccccgggctgcaggaattcgtctcacccctagaaaaagtcttatcccctcgcccctcctcccctccgccgctccccccacctcacctcgtcaaccccctccttggatagggttagagttcccccggcacgagcgcgagccatggcctccttcacctgctcccaggtcggcgctgcggcagcgggcggaacctcgcccttcctcggctaccggcggcggagcggccccgggggcgccatcccgtcgagctccctcttcgtgggccggcggttggcggcggtgcggatgcgcgcgccctctcgcggggtccgcgggggctccgcgctgcgggtcacgtgcgagaaggtggtggggatcgacctagtgcacaccaactccgcggtcgccgccatggagggcggcaagccgaccgtcgtcacaacgccgagggcgcgcgcacaactccctccgtagtggcgaacaccaagaaagggaagcgcctggtggggcagatcgctaagcgccaggcggtcgtgaaccccgaaaaacccttcttttctgtaaagggttttatcgggcccaaaaattcctaagggtcaacaaaaaggcccaagcgggttttcgtaaggggttgttcaaaaaacaaaaacagggaaccgctaaa

SEQ ID NO: 53730 - DNA, 733 bp, Zea mays
  misc_feature: Ceres CLONE 1475797-F
  misc_feature: Encodes the peptide sequence at SEQ ID NO. 53731
aaagctggagctccccgcggtggcggccgctctagaactagtggatcccccgggctgcaggaattcgtctcacccctagaaaaaccaccacccatcctcgcttctctcgagtcctcaatccatcctccggctgctccctcccagcgacaaaaccctagcccgtcacctcgacgcctagcccgccaccttgccgctcgtcgctgcaggtttatggcgcctgagggatcggatcagcagtccgatccgtgaccctcggcccacgcatctgatgttcgtctcccgcatcgtactccgagacctgaattccatcgactctccggcctccatggcgtcctccaacaaggttgtgacccgtgacgagagggagctgaagctccgcgacgtcaagatccgcagggaggacatgaaacgggggcccccccaacctcctctttatcgagggtttcgtcgacttcgccgacaattttcgcatcgagtccggcacccagcagagtacgggcctcactttctctcttccactggtgaacttcctggggaagaccgcccgaattcctgaatttatttcgtgccggggaacattgaccaaaccgaccaaccctggatcaaaaaggaagttaagaagagctatgccagatcgggaaaaaggtccagggaggtggattaaaacaaaaatcaccgacccttttacccccggggatccgatacgggcccttgggttcccaaaattattcaa

SEQ ID NO: 53731 - protein, 95 aa, Zea mays
  misc_feature: Ceres CLONE 1475797-F
MFVSRIVLRDLNSIDSPASMASSNKVVTRDERELKLRDVKIRREDMKRGPPQPPLYRGFRRLRRQFSHRVRHPAEYGPHFLSSTGELPGEDRPNS

SEQ ID NO: 53732 - DNA, 750 bp, Zea mays
  misc_feature: Ceres CLONE 1475799-F
  misc_feature: Translation starting site: 138
  misc_feature: SWISSPROT Homolog: EC 1.4.1.2 Glutamate dehydrogenase
ctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctccgcacgacgtactcttgcgtcggcgtgtggcagcacgaccgcgtccagatcattgccaacgaccagggtaaccgcaccacgccctcgtacgtcgcctttaccgactcccagcgcttcacccgatatgtggccaagaaccaggttcgccttgaatcctatgaagaccgactttgaatgccaagcgccgtcatctgaaggggggttcccccccccccattttttaattactcggtcatcccgtccgcgggccctttccaaggccatccctctccgtctctgggcgacactaccccatcgatttggttgtccctgtcgactaaggccctcagccagcattataacgttcgcccccctggaaagtaaattattccctcctttcgccccgtttattcctagatcccgccttacccagatatgttaaaccgctcaccctgggtcgtccgcgtcttcacgccgacccccgagcgacgagaggtagcccgatcgctttatcttacattgtgtttcaccgggggagccggccccccaatccgcagtttccccttttttgtttcgcctccctcctacgccg

SEQ ID NO: 53733 - DNA, 734 bp, Zea mays
  misc_feature: Ceres CLONE 1475801-F
  misc_feature: Encodes the peptide sequence at SEQ ID NO. 53734
atagctggagctccccgcggtggcggccgctctagaactagtggatcccccgggctgcaggaattcgtctcacccctagaaaaaaacaaagacgtagctaccccctcccgcgtccgtcgaattcgcctccgccgcctgctcgatccggtgggaattcgccgctgccgggttgttttcgctggggtgattaaggctcgggattcgagatctacgcgagtcgcgggcaagcagccatgagcgaggtgttcgagggctacgagcggcagtactgcgaggcctccgcctcgctctcccgcaagtgcaccgctgcctccgccctcgatggggagaagaagaagcagaaactgtccgagatccaatccggcgttgaggaagctgaatcgctgattcgtaaagatggacctggaggcaacccccccaccccctaccattaagggtgggtttgtttggcaagcttgagggagtataaatttgacttcaacaacgtcaagagtgagctttagaagatcccagccccccaatgcttggcaggctacccgggaaggagctccctggagtccgggaaggggtaaaacttctcccggggggcccactggatccagaggggggaaaatttgattaataacccactgaaaaaaaccgaaccccgtccaattggagcgcagttttaaaaaagggccccaaagaaaattttttgtttgaaaaaacccaaaaaaaccttgggggtgtgtgca

SEQ ID NO: 53734 - protein, 66 aa, Zea mays
  misc_feature: Ceres CLONE 1475801-F
MSEVFEGYERQYCEASASLSRKCTAASALDGEKKKQKLSEIQSGVEEAESLIRKDGPGGNPPTPYH

SEQ ID NO: 53735 - DNA, 666 bp, Zea mays
  misc_feature: Ceres CLONE 1475802-F
  misc_feature: Encodes the peptide sequence at SEQ ID NO. 53736
  misc_feature (512)..(512): n is a, c, t, g, unknown, or other
  misc_feature (619)..(619): n is a, c, t, g, unknown, or other
ctggagctccccgcggtggcggccgctctagaactagtggatcccccgggctgcaggaattcgtctcacccctagaaaaatcagaccagcccagagcccagcccaccacaaacgctgctgctgctggagagaggggcgcgcgggcggacgggagcgatgggcaactgccaggcggcggaggcggcggcggtcatcatccagcaccccggcgggaaggtcgaccggctctactggtccaccaccgccgccgaggtcatgcggaacaacccgggacactacgttgccctcgtcatactccgtgttcctgcagataacaagcccgccgccgccggggacgccgcggcgtcctccggccccggcagtggtggtgccaagatcaccaggggtcagctgctgaagcccaaggacacgcttctcccttggcaggtctaccgcctcatcaccgcgcaagaagtgacgaaagcggtgcgggcgaagaagaacgagaagatgcagcggtgcgaggccatcangcagcagcacgagcagctccggcgcggcgacggggctcaccggagctctcccagccagacgggaagcaggacaaggaccggcacccgggaagaggccggcactggcngccggcgctgcaaagcatctccgagtccgcgagcagagcagcagcag

SEQ ID NO: 53736 - protein, 170 aa, Zea mays
  misc_feature: Ceres CLONE 1475802-F
  misc_feature (119)..(119): Xaa is any aa, unknown, or other
  misc_feature (155)..(155): Xaa is any aa, unknown, or other
MGNCQAAEAAAVIIQHPGGKVDRLYWSTTAAEVMRNNPGHYVALVILRVPADNKPAAAGDAAASSGPGSGGAKITRGQLLKPKDTLLPWQVYRLITAQEVTKAVRAKKNEKMQRCEAIXQQHEQLRRGDGAHRSSPSQTGSRTRTGTREEAGTGXRRCKASPSPRAEQQQ

SEQ ID NO: 53737 - DNA, 690 bp, Zea mays
  misc_feature: Ceres CLONE 1475803-F
  misc_feature: Encodes the peptide sequence at SEQ ID NO. 53738
agagctggagctccccgcggtggcggccgctctagaactagtggatcccccgggctgcaggaattcgtctcacccctagaaaaaattgcaagccttcccggttacttgttcactaacaaggtcgggacggcatggcccttggagctgcgtaccatcactacctgcagctcgccggcgaccatggcaccgccacacacgcactgctcctcggcgtacttatcttcctcgtcatccgcctagtatccgcaaggcgaaccggcacaacctcagccaacaaacgtaagcagcaacagcggcttccgctcccgccttcgcccccgggcaagctgcccatcatcggccacctccacctcatcggcgccgagactgagatctcgaaccgggacctggacgccaagaacgggggcaacccccccctgctcctccgcatcagggccgtgcccaccctgttcgtgtcctcgcccagcgccgccgacgccgtcctgcgcacccaggaccacatcttcgcgtcccggccgccgtccagggccgccgagatcatccgctacggcgcctcggaacttaacgtccgtgccctacggcaagtactgggggaagggcaggaaaatcctcacccccgcacttgctctcaccaagaaagggcacccccttcccccaatggccaaaaggaaaaaggggccgcctctctct

SEQ ID NO: 53738 - protein, 186 aa, Zea mays
  misc_feature: Ceres CLONE 1475803-F
  misc_feature: SWISSPROT Homolog: EC 1.14.13.88 Flavonoid 3',5'-hydroxylase
MALGAAYHHYLQLAGDHGTATHALLLGVLIFLVIRLVSARRTGTTSANKRKQQQRLPLPPSPPGKLPIIGHLHLIGAETEISNRDLDAKNGGNPPLLLRIRAVPTLFVSSPSAADAVLRTQDHIFASRPPSRAAEIIRYGASELNVRALRQVLGEGQENPHPRTCSHQERAPPSPNGQKEKGAASL

SEQ ID NO: 53739 - DNA, 670 bp, Zea mays
  misc_feature: Ceres CLONE 1475804-F
  misc_feature: Encodes the peptide sequence at SEQ ID NO. 53740
  misc_feature (618)..(618): n is a, c, t, g, unknown, or other
ggagctccccgcggtggcggccgctctagaactagtggatcccccgggctgcaggaattcgtctcacccctagaaaaaaagggcccaaggcttctccttctagggattcatcttcctctcgtcttccctcttcctctccgaggatacaaggcgccgtcccaggtagaggtagggtcgccaccatgctggaggagctgctcatcttcacccggggcggcctcatcctgtggtcgtcctgccgggcgctcggcgccgcagccctcaagggctcccccatcgacgccctcatccgctcctgtctcctcgaggagcgatccgccgacgccagcttctcccaggacaattacgccctcaagtggaccttccacaacgacctcggccttgtcttcgtcgccgtataccagaagatactccacctcctctacgtcgacgatctcctcgccgccgtccgcaaggagttctcccagatctacgaccccaagcgcacctcctacgatgactttggggacatcttcctgcagctccaccgcgaggccgaggcgcgcgccgaggaaatgaagaggtccaagcaggccctctcgtcccggtcgcagcctgctctcaccagaagaagcctgntcccaagggctgcggctgtgatccccgcgcggcgctgctaacaagggcggct

SEQ ID NO: 53740 - protein, 158 aa, Zea mays
  misc_feature: Ceres CLONE 1475804-F
  misc_feature (27)..(154): Pfam Name: SRP-alpha_N Pfam Description: Signal recognition particle, alpha subunit, N-terminal
  misc_feature (146)..(146): Xaa is any aa, unknown, or other
MLEELLIFTRGGLILWSSCRALGAAALKGSPIDALIRSCLLEERSADASFSQDNYALKWTFHNDLGLVFVAVYQKILHLLYVDDLLAAVRKEFSQIYDPKRTSYDDFGDIFLQLHREAEARAEEMKRSKQALSSRSQPALTRRSLXPRAAAVIPARRC

SEQ ID NO: 53741 - DNA, 671 bp, Zea mays
  misc_feature: Ceres CLONE 1475805-F
  misc_feature: Encodes the peptide sequence at SEQ ID NO. 53742
  misc_feature (274)..(274): n is a, c, t, g, unknown, or other
aagctggagctccccgcggtggcggccgctctagaactagtggatcccccgggctgcaggaattcgtctcacccctagaaaaactgtccgactcccagccgtcgtctgctgcggactccgcctccagtttggtctgtttcttgcaagttgatcttgtggtagttcccccaactgtcaccatgcagaacgaggagggtaagactgtggacctctatgtccccaggaagtgctcggccacaaacaggatcatcactgccgagagacatgcctctgntcagatcaacattggccacttggatgcgaatggcctgtatgatggtcacttcacaacgtttgctctctctgggtttgtccgggctcaggacgacccaaaccgttccctggaacaggcttaggcaaaaaaaaaaggctgaatttcacccttaatttttcatcctttttacaaaaaatggaacacggccttaccctggtttagaatccccgcccctatggcaaaggggggttttccccgggccccctaactggagattttgcccaaaaaaaaaaaaaaaaaaaaacccccagggacccaattgccccaatagggggggttaaacccccccccccggggcctcttttttaaaccgggggagagaaaaaaccgggtggcccacaatatatctgtggagcac

SEQ ID NO: 53742 - protein, 71 aa, Zea mays
  misc_feature: Ceres CLONE 1475805-F
  misc_feature (1)..(72): Pfam Name: Ribosomal_S21e Pfam Description: Ribosomal protein S21e
  misc_feature (32)..(32): Xaa is any aa, unknown, or other
MQNEEGKTVDLYVPRKCSATNRIITAERHASXQINIGHLDANGLYDGHFTTFALSGFVRAQDDPNRSLEQA

SEQ ID NO: 53743 - DNA, 645 bp, Zea mays
  misc_feature: Ceres CLONE 1475807-F
  misc_feature: Encodes the peptide sequence at SEQ ID NO. 53744
atagctggagctccccgcggtggcggccgctctagaactagtggatcccccgggctgcaggaattcgtctcacccctagaaaaagcacaagacgaggaagaggttcccggtaccggcgccgccactatgtcgtcgatgatgaacgcgctgtcaaactggctggtgaacccgcgccgcaacccgctcgcgcgcctccacatgaacgccgtctcctcgcgcctcaggaaatacgggctgaggtacgatgacctgtacgacccctatttcgacctggacatcaaggaggcgctcgggaggctgcctagggaggtggtcgacgcccgcatccagcgcctcaagcgcgccatggacctctccatgaagcatcagtacctccccgaggacctccaggcacagcaggtcccattcagaggatatttgagtgacatgttggctctggtgaaaaacgaaagcgctgagcgtgaagcactgggagccctttcactttaccagagaacgcttccctaattgcttgctaaacatggctgcaagtcttctcttttccccaatcagaatgcatgcaataaaatgcagtgggtatttgtgtccaaccaaagttcccttttacttggcccccaatggtggcttgaaccattgccctcttag

SEQ ID NO: 53744 - protein, 126 aa, Zea mays
  misc_feature: Ceres CLONE 1475807-F
  misc_feature (11)..(114): Pfam Name: UCR_14kD Pfam Description: Ubiquinol-cytochrome C reductase complex 14kD subunit
MSSMMNALSNWLVNPRRNPLARLHMNAVSSRLRKYGLRYDDLYDPYFDLDIKEALGRLPREVVDARIQRLKRAMDLSMKHQYLPEDLQAQQVPFRGYLSDMLALVKNESAEREALGALSLYQRTLP

SEQ ID NO: 53745 - DNA, 955 bp, Zea mays
  misc_feature: Ceres CLONE 1475815-R
  misc_feature: SWISSPROT Homolog: EC 3.4.23.12 Nepenthesin
ccaattgggtacctcgagcgtctcgtttttttttttttttttcttttttttttttttttttttttttttttttttttttttttttttttttttttccaggaaataattctgaacaaattccagcagtcaacaataatataatggaattaattagcgtgttcggttaacaatcccctgtatacaaaaaaatcacgaatcctatatatgcccccatttacatatgtacaactatcgcatcgtcaaaaagtgctgcacttggccggagcgaacaacagcgtctcctcccggacgtcgtaaaggatgtgcatgttctgctgctgggagttcccaaacgtgctcatcgcgccgtccgtctggttccccatggccaggcaccacacgccggaccccgaaatcatgtagctgtccccggggagcaccatgtcggccccctcaaaatggaacgtcttgctcggcaaaacggccgggggcgcccaaatcggggccggcagcccgaaaaacaggtccagccccctggaaatccgaccccccccaccgttgggcagccgtcttgaccaccctggggaatttacccgcgggcgcgggaactttcttggtaaccccccccctttggcccaacaagggtttaagggctctcttccccgaaaataaaaaaaataaaaggcgcgctcccgtgcccccgccggggtttttctggggaaaaaaaaccccccccggaaaaaaaaatgggaaaatgccctctttcctcgcccccaggggaatatttcccccccccagggtttgcaagggtatatcaaaaaaaggggtcttccatgggcgccccccttgggcccgggggtgttttcagaaaaaaaaacagtcttgtgaataagcgaaaacaccccggttgttctttttaaaaacctcccccacaaaacagggcccccaaaaaaaaaaaaaagagcgcctttttttt

SEQ ID NO: 53746 - DNA, 707 bp, Zea mays
  misc_feature: Ceres CLONE 1475815-F
  misc_feature: Encodes the peptide sequence at SEQ ID NO. 53747
  misc_feature (376)..(376): n is a, c, t, g, unknown, or other
aaagctggagctccccgcggtggcggccgctctagaactagtggatcccccgggctgcaggaattcgtctcacccctagaaaaaacccgacgacgccattcacctccccccgtcccccgtatcgccttcgtcaagtacgcccctcccccttccaccccatgacggagtgctcgattccttcatctgatggcgccacccacctccccccgctctcctccgccgccgcggctgtcgaggctcacttccaggcgcactggtccgcgctcgacgctgccgcacgccaggacccggcgcgtgtcatcgccgtgggggactggcggtccccgctcgagctccccttcctgtggcttggggatgtcccctggtgtcgtgtccntcaggctgcaagtccaccaattcggcctcatctgcgacaacctcgacgcattcaacaagttcgagcccaattacaggcttatcagaagatatatatcttcttcaacgatgttattcactacgggtccacttctagaagggcgcgcgttacctactagttcgtcatgtgaggcgtaggttccgctctcgccccctaggaggaggctcattagcgaggtcccagaaattcgtgatggcatttcgcgtcccaacagtgaaagctgtgggggatttggataagagtataacaccctcccctcccgaaaatttgagggcggattggaactccaaat

SEQ ID NO: 53747 - protein, 124 aa, Zea mays
  misc_feature: Ceres CLONE 1475815-F
  misc_feature (73)..(73): Xaa is any aa, unknown, or other
MTECSIPSSDGATHLPPLSSAAAAVEAHFQAHWSALDAAARQDPARVIAVGDWRSPLELPFLWLGDVPWCRVXQAASPPIRPHLRQPRRIQQVRAQLQAYQKIYIFFNDVIHYGSTSRRARVTY

SEQ ID NO: 53748 - DNA, 684 bp, Zea mays
  misc_feature: Ceres CLONE 1475816-F
  misc_feature: Translation starting site: 197
  misc_feature: SWISSPROT Homolog: EC 1.4.1.2 Glutamate dehydrogenase
aaactggagctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatccccaccgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtccacgtccctgcctacttcaacgactcacagagggcagccaccga

SEQ ID NO: 53749 - DNA, 800 bp, Zea mays
  misc_feature: Ceres CLONE 1475817-F
  misc_feature: Encodes the peptide sequence at SEQ ID NO. 53750
  misc_feature (272)..(272): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (768)..(768): n is a, c, t, g, unknown, or other
aaagctggagctccccgcggtggcggccgctctagaactagtggatcccccgggctgcaggaattcgtctcacccctagaaaaaaactagagagttgtcgtctgctgcagggatggccggcgtcctgccgaggtttggccccttcggccctctgccgccatcggatgagttcgggatcagggagacaagacctcgtctcgccggcaggtgggccggcgggtacgacctcttggagcggatggagtacctgtacgtgcgcatcctcaaggcgnaggacctcaagtggtactgccaccttcgagccggttcccggagttaaacttctccagctacttcttgcccccggcgggatattcaagaaaatttataaccccccccctcgtgggggcggcgggcgggtccccccccgaaaaaaaaaaccaannnnnccgccccccccccacccttctaaataaaaggggaaaggggcccttggcgggggggggagcctttccccacggcccgcagggggtatcccagactggggggagaacgctcccttttcccgcccagtggtccccccaagctgcggtcccctcccccccgcgcaatggcgactgccctatcgcctcaccgaacacacaagacttcacccctattcctcatcatcgtttatagacccgccccggggtgcccctttcacccgcccagaccgttccgccacagtcgtggatcccctctctccctttactttccacaacctctccccctcggggggggagcgggtgnacccttacccttacctcacgctcccccccccg

SEQ ID NO: 53750 - protein, 68 aa, Zea mays
  misc_feature: Ceres CLONE 1475817-F
  misc_feature (54)..(54): Xaa is any aa, unknown, or other
MAGVLPRFGPFGPLPPSDEFGIRETRPRLAGRWAGGYDLLERMEYLYVRILKAXDLKWYCHLRAGSRS

SEQ ID NO: 53751 - DNA, 699 bp, Zea mays
  misc_feature: Ceres CLONE 1475822-F
  misc_feature: Translation starting site: 263
aagctggagctccccgcggtggcggccgctctagaactagtggatcccccgggctgcaggaattcgtctcacccctagaaaaagagcctgccgctccccacattcgcgttccgctcacagcggaaaaggaagccggctagggtttcatcttcctttcccctcctctctgtcagcgacgaccgctggccaccccctcgatctcttgacccggaggcgaggacgggggccagtagcggccgtcagcgcctgcccgtcttgttatatggagcgcttctcatgtctgaaatggagtgtgtcgcggctcttatggactcgacaagctccaagatacaacagtcttcaggaggcattcgctgagcttgagagccatatcgctttctgcatgaacttcacagtggaagcagctatgagaccactttcccccccccgaacaatccttcaagagaaagtttgacgagctaaaagaacaggagaaagagttccaggagactgtcacaaaatcagagcagatcctggaccagccggacgcaagttgttgcgccaagggaactgacctcttttggaaaggtgcaggaacaaaagggaaagttgcattaccctatggatttttgccaagtcccgggctttccttagcctggttctttccatcaaccccaatggaacaagggccctggaaaaaatcctgggggagcaagcggg

SEQ ID NO: 53752 - DNA, 668 bp, Zea mays
  misc_feature: Ceres CLONE 1475824-F
  misc_feature: Translation starting site: 338
  misc_feature: SWISSPROT Homolog: EC 3.2.1.21 Beta-glucosidase
  misc_feature (506)..(506): n is a, c, t, g, unknown, or other
  misc_feature (530)..(530): n is a, c, t, g, unknown, or other
  misc_feature (531)..(531): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (666)..(666): n is a, c, t, g, unknown, or other
aaagctggagctccccgcggtggcggccgctctagaactagtggatcccccgggctgcaggaattcgtctcacccctagaaaaaacacacttcacaagcagctcaaagctctagttctagctagctagcaaagggggggaaaatggctccgcttctcgctgctgccatgaaccacgctgcagcccatcctggccttaggagccacctagtaggacccaacaatgagagtttctcacggcaccacctgccgtcttcttctccacagagcagcaagcgaaggtgtaaccttagctttactacacgatctgcaagagtaggcagccaaaatggagtccaaatgttgagcccctcggagatcccacaaagggactggttcccctctgacttcaccttcggtgccgccacttcagccacccaattgaaggtgcttggaatgaagatggaaaaggggaaagccactgggatcacttctgccacaatcatccggaaaggtactggacgggaanaaatggccccccccacccaattcnnacatatgtacaaaaaaaacttaaaattgctcaaggaaatggccatggacccctattagtctcaaaannnnnnnnnnnnnnnnnnnnnnnnnnnnnnnnnnnnnnnnnnnnnnnnnnnnnnntnnnnnnnnngggngg

SEQ ID NO: 53753 - DNA, 687 bp, Zea mays
  misc_feature: Ceres CLONE 1475825-F
  misc_feature: Translation starting site: 189
  misc_feature: SWISSPROT Homolog: EC 2.7.12.1 Dual-specificity kinase
  misc_feature (560)..(560): n is a, c, t, g, unknown, or other
  misc_feature (642)..(642): n is a, c, t, g, unknown, or other
  misc_feature (687)..(687): n is a, c, t, g, unknown, or other
aagctggagctccccgcggtggcggccgctctagaactagtggatcccccgggctgcaggaattcgtctcacccctagaaaaaattgaaatcaatcgtgttcctcgcctgcacgacgagagcccgagaccaatccagccgccgcctccgccttcgcctcgcctagtattccctccgattcagaggccgatggagtgcatcgccgagatgccccgcgcgccgctggacagcaggctgcgcaagcgtcagcgtctcggctgggacgtcggccctgccgagatgtataaggccgtgcggccgcggcacgggtgggacgtcggccccgccgagatgtatcagttagaactttgtggacaagaagttgtgaatgccatcagtgctgcagcgttgggcctttcgtcgggctgtgtttcttctcaagtcaaacaagagcagcttcatgatggttcccctcctctgagagaagatgacagggatgggcattatgtttttgctgttggagataacctcacatctcgctataagatcaatgcaaaaatgggagaaggtacctttggtcangtgttggagtgttgggacaaggaaaggaagaaatggtggctatcaaaatcattaggggcattaaaaagtacagggatgctgncatgatcgaaattggcatgctcgagcagcttggtaaatatgatgn

SEQ ID NO: 53754 - DNA, 656 bp, Zea mays
  misc_feature: Ceres CLONE 1475828-F
  misc_feature: Encodes the peptide sequence at SEQ ID NO. 53755
  misc_feature (656)..(656): n is a, c, t, g, unknown, or other
aagctggagctccccgcggtggcggccgctctagaactagtggatcccccgggctgcaggaattcgtctcacccctagaaaaagagcgtctcagggacgggttgactctttctggccgcatcagcggccggctattcttcttgtccgggtatccgttccaggacttcggattaagaggcgacgagatgttgcggcgatgcgtctcggcgttggcccgccgccgccgtccagatcgcacggttgatactatgaaggcccgatcccaatgttttggttacaggttcctcttcaataagggacactgaccggccagaggggctccaggtacctgtggtaatttcttgtgctaccgcatccagatgttttaattcgagagaaaaattggtcctcaaaaagggcttgtttaatccatttgggagggtccaccaactcacttggggggttttctttgaccggaccccttttaacccggaggggcgcccgttctttattttccttgctggaagggggtttaaaccctacccccaaagtccggaagttttcttttccctgttttgaaaaaaaattcccaaacccccgcaaccttttttttctcccctccccgggggagaaaacaaaaaacccccataacaagtgggggcgaaaaaccccccccn

SEQ ID NO: 53755 - protein, 100 aa, Zea mays
  misc_feature: Ceres CLONE 1475828-F
AGAPRGGGRSRTSGSPGLQEFVSPLEKERLRDGLTLSGRISGRLFFLSGYPFQDFGLRGDEMLRRCVSALARRRRPDRTVDTMKARSQCFGYRFLFNKGH

SEQ ID NO: 53756 - DNA, 656 bp, Zea mays
  misc_feature: Ceres CLONE 1476240-F
  misc_feature: Translation starting site: 258
  misc_feature: SWISSPROT Homolog: EC 2.3.1.74 Naringenin-chalcone synthase
  misc_feature (227)..(227): n is a, c, t, g, unknown, or other
aagctggagctccccgcggtggcggccgctctagaactagtggatcccccgggctgcaggaattcgtctcacccctagaaaattccacctgctcaaggacgtgcccgggctcatctccaagaacatcgagcgcgcgctggaggacgcgttcgagccgctcggcatctccgactggaactcatcttctgggtggcgcaccccggcgggcccgccatcctggaccagtnggaggccagggtcgggctggacagggcaggatgcgcgccaccccgcacgtcctctccgagtacggcaacatgtccagcgcctgcgtgctcttcatcctggacgagatgcgcaagcgctcccgccgaggacggcaggcccacaccggcgaggggctcgactggggcgtcctcttcggcttcggcccgggcctcaccgtcgagaccgtcgtgctccacacgtcccccttacccccggagcgcccacggccgcctggatcctccatctatccctcggatcgctccagacatgaccgacccgacctacgaataatgtatccggcgaaattaattaattttcaatcgggggtggggcccaagaggctggtaaagacccgttttaaaaaccccttaattaatattttttgtgggggcgagcttcctcaaaaaaaa

SEQ ID NO: 53757 - DNA, 630 bp, Zea mays
  misc_feature: Ceres CLONE 1476241-F
  misc_feature: Translation starting site: 183
  misc_feature (217)..(217): n is a, c, t, g, unknown, or other
  misc_feature (232)..(232): n is a, c, t, g, unknown, or other
  misc_feature (234)..(234): n is a, c, t, g, unknown, or other
  misc_feature (239)..(239): n is a, c, t, g, unknown, or other
  misc_feature (345)..(345): n is a, c, t, g, unknown, or other
  misc_feature (363)..(363): n is a, c, t, g, unknown, or other
  misc_feature (365)..(365): n is a, c, t, g, unknown, or other
  misc_feature (366)..(366): n is a, c, t, g, unknown, or other
  misc_feature (384)..(384): n is a, c, t, g, unknown, or other
  misc_feature (387)..(387): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (408)..(408): n is a, c, t, g, unknown, or other
  misc_feature (424)..(424): n is a, c, t, g, unknown, or other
  misc_feature (441)..(441): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (551)..(551): n is a, c, t, g, unknown, or other
  misc_feature (568)..(568): n is a, c, t, g, unknown, or other
aaagctggagctccccgcggtggcggccgctctagaactagtggatcccccgggctgcaggaattcgtctcacccctagaaaaaactggttgctagtgctaccaagaacaggtaaggaaacaccgccgccgccgcgccttccattccagtactcgcggaggaaaggaacaccagccagcgccatggtcacgtcgacgaccgccgccgccgtgcctgngtcccacagacgcgntncccgntgggaccgggggcttacgcctgtgcgcccgatctcccccgggggggaccgcccgcccaaaatgggggggttttttctcccccggcccaagggtgttggtttttttntcccgccccccccccgcncnngggggggggggggggggnagnacgccccccgccnnnctcccnggggggggggggggtntccctcccccccccccnaaaaaaaaagccccccgtcgtggttgtgaccccccccaaaaaaggaggggggggggggnnnntcttctttctttttgggtggggggggggggcggggnnnntcccttttntttcccctttgcgaccnccccccccccgcggaaagaaaaaaaaggttgggggggggaggaaaaaaaaaaaccccccccc

SEQ ID NO: 53758 - DNA, 666 bp, Zea mays
  misc_feature: Ceres CLONE 1476244-F
  misc_feature: Encodes the peptide sequence at SEQ ID NO. 53759
aaagctggagctccccgcggtggcggccgctctagaactagtggatcccccgggctgcaggaattcgtctcacccctagaaaaagatttgacccatctcccaacccctacactcccggcggcggcgcaggagcagcagcacccgaggatggtgaagttcctcaagcccggcaaggccgtgatcctcctgcagggccggttcgccggcaggaaggcggtgatcgtgcgcgtgttcgaggagggcacccgcgaccgcccctacggccactgcctcgtcgccggcctcgccaagtaccccaagaaggtggtccgcagggactcggccaagaagacggcgaagaagtcgcgcgtcaagtgcttcatcaagctcgtcaacttcacccacctcatgcccacccgctacaccctcgacgtcgacttcaaggacgtggccaccggcgggcccgacgcgctctccacccgcgacaagaaggtcgccgcctgcaaggccgccaaggcgcgcctcgaggagaggttcaagaccggcaagaacaggtggttctttaccaagctccgcttctagatggtcggcgtcccgaatggtgcccctcggtttcttgtgtatgggacacactccaagctatgtctcttttcgtattgccatgaagacttcttcgtgtttagtcct

SEQ ID NO: 53759 - protein, 137 aa, Zea mays; identical to SEQ ID NO: 5586
  misc_feature: Ceres CLONE 1476244-F
  misc_feature (52)..(137): Pfam Name: Ribosomal_L27e Pfam Description: Ribosomal L27e protein family
  misc_feature (7)..(40): Pfam Name: KOW Pfam Description: KOW motif

SEQ ID NO: 53760 - DNA, 668 bp, Zea mays
  misc_feature: Ceres CLONE 1476245-F
aaaagctggagctccccgcggtggcggccgctctagaactagtggatcccccgggctgcaggaattcgtctcacccctagaaaaagccatgggatcctggggtgcagaagaccaatgagttcggtgaccaaggcaatttctccatctttgtttgggaccctggtgatcacaatgttcagccgatcaaaggatagcacactggtattatttggataaattgtttgcacttgcaatgggatctcggtggaattgatgccatgtatcggcttgggggcaagccgatttttaagaaggggagaatgttagggaatgtgagcccaaacggcccatgccagcccaggttgctaagagagtgccagcccaggttgctaagagagactacaaaagagcagggcggtcaggaggatagacatcgaatattcagagtgctacagttatcttccttctccagtttcttctcttccatgtatcctctatcttctcctctagattcttctagacccttctagaatggcttcagcattcttctcctatccttaatcctcctgctgttcttcctttctcgacaataatcctctgtaatcgctattgtgagttgaatcaatacacactagtagtgacactagtcagtgtgagtcgttaaaaaaaaaaaaaaaaaaaaaaaaaaa

SEQ ID NO: 53761 - DNA, 690 bp, Zea mays
  misc_feature: Ceres CLONE 1476254-F
  misc_feature (409)..(409): n is a, c, t, g, unknown, or other
  misc_feature (410)..(410): n is a, c, t, g, unknown, or other
  misc_feature (690)..(690): n is a, c, t, g, unknown, or other
aagctggagctccccgcggtggcggccgctctagaactagtggatcccccgggctgcaggaattcgtctcacccctagaaaaacccccttccctctcttccgcctccgattgagtggctcaccttctttcccagccagcacgagcttgcaagcaagcgagctcctgagatttcagctcgcttctcctccagaggtcgagcagaccagactcctccgaccgaagctctaccacttcccagttatcctgtccaggaactgcttggccggagatccaaacaaacctctgtgttggggttctccggggttccttgccctgaagggaggtttcgttcccgcctggccatgggttggctgaaaagcaccccccgccccctggggggggggggggggcttaactttataaaaaatnnccattccccccccccccctcttggtttcttccattcgtttcggggtggcctcccccaacggggtttaagggaacctcaaaacctggcccccccccggaacccgcacttcccccggggcccttttcacggcccctcaacctctgcccccctcttttttgggccccccaaacaaaaccggccaaaaaagcgccccgcggggggaggcggaaagagattctttttccggggggaggccgggcgccgggcgcgggtcccacggcggaaaaaaaaaaaaaaaaan

SEQ ID NO: 53762 - DNA, 696 bp, Zea mays
  misc_feature: Ceres CLONE 1476259-F
  misc_feature: Encodes the peptide sequence at SEQ ID NO. 53763
  misc_feature (257)..(257): n is a, c, t, g, unknown, or other
  misc_feature (303)..(303): n is a, c, t, g, unknown, or other
aaactggagctccccgcggtggcggccgctctagactagtggatcccccgggctgcaggaattcgtctcacccctagaaaaaaaattcgttgcagtagtcgcagctgacggacgactgaaccaccgacagacaacatggccgcctccgcctccaccgtctccggcctcgccggcgcctccctgggcagccgcccggcgttctccaccagcttcacgcggggcagccgggtgtcggcgaggaaccccctgatgagcangaacctggagagaaatgcaggatcacctgcatgacgttccccgggnactggctgcggagggacctgagcgtcatcggcttcgggctcatcggctggatgggggcggtcagcgtcccgggcatcaagcggaacaggctcacggggcttcttcttctcaggatcgggcaaggaggttgcccaatttcccaaggcccccgcccgttacctcccagttcttggttggggctaaggaactggcccctgggccttttcatcgggccccccctcggccaaattggattcaggggcaggccccaagacttcctccaaaaatggaggcggtaaaaacccctccctcccccccggggggcccccctcaattttggtttgggggggtgtcccccccaaaataaaaacttttttgtggtaaagggggccccaatttcccccaaaaatggaa

SEQ ID NO: 53763 - protein, 97 aa, Zea mays
  misc_feature: Ceres CLONE 1476259-F
  misc_feature (6)..(6): Xaa is any aa, unknown, or other
MTFPGXWLRRDLSVIGFGLIGWMGAVSVPGIKRNRLTGLLLLRIGQGGCPISQGPRPLPPSSWLGLRNWPLGLFIGPPLGQIGFRGRPQDFLQKWRR

SEQ ID NO: 53764 - DNA, 637 bp, Zea mays
  misc_feature: Ceres CLONE 1476266-F
  misc_feature: Encodes the peptide sequence at SEQ ID NO. 53765
  misc_feature (294)..(294): n is a, c, t, g, unknown, or other
  misc_feature (324)..(324): n is a, c, t, g, unknown, or other
ccccgcggtggcggccgctctagaactagtggatcccccgggctgcaggaattcgtctcacccctagaaaaacaccgcaatcttcaatctccccagcaatccctagcagaagccttccatcctcactcgctcgatggcccgcacgaagcagacggcgaggaagtccaccggcggcaaggcgccgaggaagcagctggcgactaaggcggcccgcaagtctgcccctgcgaccggcggagtgaagaagccccaccgcttccgccccgggcacgtcgcgctccggtagatccgcangtaccagaagagcacggagctgctgatccngcagctgccgttccagcgcctggtgcgggagatcgcgcaggactttcagaccgacctacgcttccagagctctgctgtctccgcgctgcaggaggcggctgaggcctaccttgtcgggctcttcgaggacaccaacctctgcgccatccacgccaagcgcgtcaccatcatgcccaagggacatcagcttgcccgccgcatccggggggagaggggctaagcgtcatattttctgtcatcagtgcccgatcaaaaatgtagagatatgctgggttctgtattttgggtactggccaatcatcgagtgtggccg

SEQ ID NO: 53765 - protein, 50 aa, Zea mays
  misc_feature: Ceres CLONE 1476266-F
MARTKQTARKSTGGKAPRKQLATKAARKSAPATGGVKKPHRFRPGHVALR

SEQ ID NO: 53766 - DNA, 656 bp, Zea mays
  misc_feature: Ceres CLONE 1476272-F
  misc_feature: Encodes the peptide sequence at SEQ ID NO. 53767
  misc_feature (182)..(182): n is a, c, t, g, unknown, or other
  misc_feature (431)..(431): n is a, c, t, g, unknown, or other
aagctggagctccccgcggtggcggccgctctagaactagtggatcccccgggctgcaggaattcgtctcacccctagaaaaattttgtgctgccgccccttgctccctcccatggggcttcccctggatccctctccatggtggatcagccctagctttccatggatgtcgccctcctctncctgatgctggcgtctccactccctgtgggcatggacgatttcctctgctccctgctcttccctccatagctgacccatggtacattaattgatcatgtgctatggaagacgagtggaattgatctccaagtgatgctgatggacgaagctaaaatggatgaatcaaccaagtgccaggatggaagatgctcacccagtggtcgtcaattaacaacactaacatagttttatccccaggtaaaattttngtctggtgtggatggtgctaagtgccggtgggctcaaccttctatataggtatatcccatctttagcttctttattgagggctgtcacttaagctagcatgtattttaaaacttataaatgttttataccttcaaaattgtaatatttttgaatcaaattcctcttgtaatcactccaatgatatatgggaatatgggttaaaacttaataaaggtgggaacttg

SEQ ID NO: 53767 - protein, 30 aa, Zea mays
  misc_feature: Ceres CLONE 1476272-F
MLMDEAKMDESTKCQDGRCSPSGRQLTTLT

SEQ ID NO: 53768 - DNA, 651 bp, Zea mays
  misc_feature: Ceres CLONE 1476273-F
  misc_feature: Encodes the peptide sequence at SEQ ID NO. 53769
aaagctggagctccccgcggtggcggccgctctagaactagtggatcccccgggctgcaggaattcgtctcacccctagaaaaacctagaaaaaaagttcctgcacgtacgcacgcaccgggacaccagcaacccccaacagcgccactgtccagtgcgcgcgtcaagcttgcttagctagccgccatggcctccctcgccgccgtctccgtgaagcccgtggccatcaagggtctcgccggcagctctatctccggaaggaagctcgccgtcgccaggccgtcggcccgctccatccgcaggccccgcgcagccgccgtggtggccaagtacggcgacaagagcgtctacttcgacctcgacgacatcggcaacaccaccggacagtgggacctctacggctctgacgcgccctcgccctacaacccgctacagagcaagttcttcgagacgttcgcggctccgttcaccaagagaggtctgctgctcaagttcctgctgctgggcggcggctcacttctggcctacgtcagcgcgtcggcgtcaccggacctcctgccgatcaagaagggacctcaggagccgccgcagccgggcccgcgcggcaagatctaagctcagctactccatttgcatggtctagtagtagct

SEQ ID NO: 53769 - protein, 142 aa, Zea mays
  misc_feature: Ceres CLONE 1476273-F
  misc_feature (5)..(142): Pfam Name: PSI_PsaH Pfam Description: Photosystem I reaction centre subunit VI
MASLAAVSVKPVAIKGLAGSSISGRKLAVARPSARSIRRPRAAAVVAKYGDKSVYFDLDDIGNTTGQWDLYGSDAPSPYNPLQSKFFETFAAPFTKRGLLLKFLLLGGGSLLAYVSASASPDLLPIKKGPQEPPQPGPRGKI

SEQ ID NO: 53770 - DNA, 648 bp, Zea mays
  misc_feature: Ceres CLONE 1476275-F
  misc_feature: Encodes the peptide sequence at SEQ ID NO. 53771
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
ggagctccccgcggtggcggccgctctagaactagtggatcccccgggctgcaggaattcgtctcacccctagaaaaaatccactctcatcaccagctaagaacagggcttcgtctcaatggaaggcaaaacagggcagctcaggtgctgtttcgtcgccatcgtgctcgtcctgggtcttgtccttgagtcccaccaggctgaagctggaggcaaatggtgctgcgaaaccgccaccggaaaataccattttaatcgctgcgttgactcgggtttggtcgacaatattgggttctgtgcgggtaatgccggttgcatcattatggaagacagatgtggaggccgttggccggtgcctgctcgtgatgcgctttccctggatgtcatttgattaattataagcaagtacgtgaagaaacgagggccagacgactgtcgtccagcgattggttatttgtgaacttgtcgtttgtcttcttatttcaactttccataagccccttcgtgaagtgtcatccccttcaaagtctgtcgactgttacgtatacaaatctatatatcaaataaagacggcgccgtacgtgtgtatatgtctctaannnnnnnnnnnnnnnnnnnnnnnnnnnnnnnnnnnnnnnnnnnnnnnna

SEQ ID NO: 53771 - protein, 90 aa, Zea mays
  misc_feature: Ceres CLONE 1476275-F
MEGKTGQLRCCFVAIVLVLGLVLESHQAEAGGKWCCETATGKYHFNRCVDSGLVDNIGFCAGNAGCIIMEDRCGGRWPVPARDALSLDVI

SEQ ID NO: 53772 - DNA, 671 bp, Zea mays
  misc_feature: Ceres CLONE 1476277-F
  misc_feature: Pfam Name: ABA_WDS Pfam Description: ABA/WDS induced protein
  misc_feature (285)..(285): n is a, c, t, g, unknown, or other
  misc_feature (294)..(294): n is a, c, t, g, unknown, or other
  misc_feature (369)..(369): n is a, c, t, g, unknown, or other
aagctggagctccccgcggtggcggccgctctagaactagtggatcccccgggctgcaggaattcgtctcacccctagaatcctactgtcacacacacacagagagagacaagtggtttccaaagccaagtgtgtactagcagtctagcaaccagctagctcgggcggcagcaggcagccatcatgtcggaggagaacaccaccacttcttcacccaccacagaagacgaagagcagcccgcggcgagtacgggtactccgagacccgagtggtcaccgccaccnggcgaggcnagtacgaagaggtacagaagggagagaaaggagcacagcacaaagcggcccctcggggaaggccggcgccatcgncggcggggcctttcgactctacgaaaagcacgaggcaaaaaggacccccgaccaccgccaagggccaaaatcccggagggaggtcctggcccgggggggccttcgcccccggttttcctttttccccggggccccgggaaaaaaaaaaggccccctgggccccccgaggggtttcgggcaaaaaaaaacccccccccctctttcggtaaaaaaaaaacaccggcggggggaacaaaaaaaaaatttttttttccgggaaaaaaaaacaaaccaccggttttatttccgccgggggggggggg

SEQ ID NO: 53773 - DNA, 665 bp, Zea mays
  misc_feature: Ceres CLONE 1476282-F
  misc_feature: Encodes the peptide sequence at SEQ ID NO. 53774
  misc_feature (372)..(372): n is a, c, t, g, unknown, or other
  misc_feature (489)..(489): n is a, c, t, g, unknown, or other
aaagctggagctccccgcggtggcggccgctctagaactagtggatcccccgggctgcaggaattcgtctcacccctagaaaaaaatatacgtatatagacgtggtcaggatgacgtcgtcctccgtcttcttcctcctgctcgcttgcttcgccacatgcgccggcgccgccacgttcacggtacgaaacaactgcgggttcacggtgtggccagcaggcatcccggtcggcggcggcacgcagctgaacccgggctcgacgtggactgtcaacgtgcaggccgggaccagcggaagcaggatctggggccgcaccggctgctccttcagcggcggccgggggcgctgcgcgacgggcgactgcggaagcncctactcctgcagcctggtcgggcagcccccggcgacgctggccgagttcaccatcgggcggcggcagcaaccacgactactacgacatctcggtgatcgacggggtacacctgccnatggacttctcgtgcagaaccggccccgccctcggggcagggactccggctgccccgacgcgtaccacagcccaacgaccctaagaaccgttcgtggcacgggaatagcaactaccaggtcctcttctgcccttgatgaaatgcatgcagcttgccattgacccatgcatgcatga

SEQ ID NO: 53774 - protein, 179 aa, Zea mays
  misc_feature: Ceres CLONE 1476282-F
  misc_feature (27)..(160): Pfam Name: Thaumatin Pfam Description: Thaumatin family
  misc_feature (88)..(88): Xaa is any aa, unknown, or other
  misc_feature (127)..(127): Xaa is any aa, unknown, or other
MTSSSVFFLLLACFATCAGAATFTVRNNCGFTVWPAGIPVGGGTQLNPGSTWTVNVQAGTSGSRIWGRTGCSFSGGRGRCATGDCGSXYSCSLVGQPPATLAEFTIGRRQQPRLLRHLGDRRGTPAXGLLVQNRPRPRGRDSGCPDAYHSPTTLRTVRGTGIATTRSSSALDEMHAACH

SEQ ID NO: 53775 - DNA, 675 bp, Zea mays
  misc_feature: Ceres CLONE 1476284-F
  misc_feature: Encodes the peptide sequence at SEQ ID NO. 53776
  misc_feature (210)..(210): n is a, c, t, g, unknown, or other
  misc_feature (216)..(216): n is a, c, t, g, unknown, or other
  misc_feature (331)..(331): n is a, c, t, g, unknown, or other
  misc_feature (372)..(372): n is a, c, t, g, unknown, or other
  misc_feature (675)..(675): n is a, c, t, g, unknown, or other
aagctggagctccccgcggtggcggccgctctagaactagtggatcccccgggctgcaggaattcgtctcacccctagaaaaagcaaaccctcctaccccattccgccgcccgccgcccgccgcccgccccgcgaccccgaggaggaggcaagatgaagacgatcctggcgtcggagacgatggacatcccggagggcgtcacggtgacngtggcngcccagctggtgacggtggagggcccccgcgggaagctcacccggaactttcagcacctcaacctcgacttccagctgcaggagggcggcccgcaagctcaggtggatgcatggntccgcacccgcccgcacatggccgccatccgcaccgcatcntccacgtccagaacctcatcaggggggtcacaaggggctaccgctacaagatgagggtcgtctacgcccatttcccatcaacgcgtccatcacaaactccaacacccgcatcaagataaggaacttcctcggcgagaagaaagtcaaaaaggtggacctgctttgacggcttgaacttccctccgctccgagaaaggtcaggaccatctttattctcgattggccacaacctccaagttagtctctccgctccgcctccctcatcaaaccaaaaaatgctttgttcaggaagaatgattttcn

SEQ ID NO: 53776 - protein, 90 aa, Zea mays
  misc_feature: Ceres CLONE 1476284-F
  misc_feature (60)..(60): Xaa is any aa, unknown, or other
MKTILASETMDIPEGVTVTVAAQLVTVEGPRGKLTRNFQHLNLDFQLQEGGPQAQVDAWXRTRPHMAAIRTASSTSRTSSGGSQGATATR

SEQ ID NO: 53777 - DNA, 668 bp, Zea mays
  misc_feature: Ceres CLONE 1476286-F
  misc_feature: Translation starting site: 227
aaagctggagctccccgcggtggcggccgctctagaactagtggatcccccgggctgcaggaattcgtctcacccctagaaaaaactcggcacgcaggcagaggcagcatagcatcagccagctccatccatcctcttacccctcctcgcttcgcttcctcggcggattcctcctccctcgaccgaccgcgtccgcgtccccttccggcgcgcaagctcgcccgagatggcaaacgcaagatcgggtgtcgctgtgaatgacgagtgcatgctcaagatcgacgagctgcagacgaataggctgcaccgcttcctaactttccagatggaccacaagttcaaggagatcgttgtggaccaggtcggggatcgagctaccagctaccaggacttcacaaacagcctccccgagaatgactgccgatacgctatctatgatttcgactatgtcactgcagaagatcgtccagaagagcaggatcttctatatcctatggtccccatcctccgccaaggtgaagagcaagatgctttatgcaagctcaaaccaaaaattcaagagtgggctcagtggcattcacgtggaactgcgcgctactgatgcaagtgaaatccgccttgatgagatcaaggatcgggctcgctaggcatcatcatgatcatgcatc

SEQ ID NO: 53778 - DNA, 685 bp, Zea mays
  misc_feature: Ceres CLONE 1476287-F
  misc_feature: Encodes the peptide sequence at SEQ ID NO. 53779
  misc_feature (241)..(241): n is a, c, t, g, unknown, or other
  misc_feature (256)..(256): n is a, c, t, g, unknown, or other
  misc_feature (257)..(257): n is a, c, t, g, unknown, or other
  misc_feature (342)..(342): n is a, c, t, g, unknown, or other
  misc_feature (491)..(491): n is a, c, t, g, unknown, or other
ctggagctccccgcggtggcggccgctctagaactagtggatcccccgggctgcaggaattcgtctcacccctagaaaaaaagaccaccgacgcgtagcacagtccattattgccgtctcccttttgcgtgagcaaagaaagagagcgagaagagcagtcgccatgtctggcatcatccacaagatcgaggagaagctccacatggggggcgaccacaagaataaggaggaggagcaccancagatggcgagagcnncccccccaggaggaggggagggggagcaccccacacacggaggcggggagacacagggaaggcatccctggaaaaaatcaagganaagatcaccgggaagcacgggggacaggtccggcccccgccggggaaaggaggggcaagagaaaaaagaaattcgggggagggggcacaaccacggagggggggccacattatcagcagcagcgacagcgacttgatatcgtggtgtcnacaacacaagtgccaccacatgtatggcttggctggtgggaagatccataccagctggaggccgatggaggggtttccctgggggcaggcaagcgtcgtgctattataatcaaaaaaaaaaaaaaaacgaggcgctcgggggccccatttcccccctatgggggggtctaattccccccgctcacggggcgttt

SEQ ID NO: 53779 - protein, 104 aa, Zea mays
  misc_feature: Ceres CLONE 1476287-F
  misc_feature (26)..(26): Xaa is any aa, unknown, or other
  misc_feature (32)..(32): Xaa is any aa, unknown, or other
  misc_feature (60)..(60): Xaa is any aa, unknown, or other
MSGIIHKIEEKLHMGGDHKNKEEEHXQMARAXPPGGGEGEHPTHGGGETQGRHPWKKSRXRSPGSTGDRSGPRRGKEGQEKKEIRGRGHNHGGGATLSAAATAT

SEQ ID NO: 53780 - DNA, 653 bp, Zea mays
  misc_feature: Ceres CLONE 1476288-F
  misc_feature (54)..(54): n is a, c, t, g, unknown, or other
  misc_feature (82)..(82): n is a, c, t, g, unknown, or other
  misc_feature (172)..(172): n is a, c, t, g, unknown, or other
  misc_feature (496)..(496): n is a, c, t, g, unknown, or other
caaagctggagctccaccgcggtggcggccgctctagaactagtggatcccccngggctgcaggaaattcgtctcacccctnagaaaaaaaaaaaaaaaaaaaaaaggtcaagggctaatatgtttaagaacaagagggtgcttactggagagtatccacaagtccaaggcntgagaaggccagagagaacacactttctgatcagtttgacgccaagcgtgcaaagagcaaggcaagccgtgagaggaacattgctaggagggaggagaggctcgcccagggcccaagagaaccaacagcacctgtcgcagccccagctccatctactggggtgccaaagaaagcaaagaagtgaagtatggaaacaaagctgtagctttttggtactatataagcatgactttggagcacctgaagtattttgctgttatatagttcgtgtctcaatattctgagtcttgtatctctaccgtttctgttgataaatgcatgcgntaagagttgtttatggagcctttttttgttacagaccccctaaaatgtttgtttgacggatgtttggaattgggtcatgtttacaaaaaaaaaaaaaaaacgagacgctcgaggtacccattccccctataggggaggctatttaccccgcctcccg

SEQ ID NO: 53781 - DNA, 623 bp, Zea mays
  misc_feature: Ceres CLONE 1476289-F
  misc_feature: Encodes the peptide sequence at SEQ ID NO. 53782
  misc_feature (243)..(243): n is a, c, t, g, unknown, or other
  misc_feature (251)..(251): n is a, c, t, g, unknown, or other
  misc_feature (354)..(354): n is a, c, t, g, unknown, or other
  misc_feature (623)..(623): n is a, c, t, g, unknown, or other
ggagctccccgcggtggcggccgctctagaactagtggatcccccgggctgcaggaattcgtctcacccctagaaaaagcgcccggcgtctcccttctccaacctccgtttctaatccgcgctgctaatccactccctagtccagctcgtccgctgagatggacagtagcagcctcaaatccgcgcagctcctggagctgatgcgccagcacctggccaccgatgccggcaaggaggtcaccnagaggtcngtctcgtctacagctcacatcgcccccaagagatcggcgttgatgaagagatctcgtgtcgacctcaagaaggcgagggtcacaagggccgtacagggaagcngatgcccttttctcttcacgacacgatttctttgaatcgcaccgcaagacgaatcgcagatgcattcattcgagggggattaaatcaggggaggtcagtgcggccaaaattccaccctgacatcttccccagcctgtaagctgaagaagggtaaatgtttattaccttggcgagaaaaatataatgttgccaccttccattactatgtacaagaaacatggaggggacactgaaaaccccttcctcgggggggattttggatttggtan

SEQ ID NO: 53782 - protein, 76 aa, Zea mays
  misc_feature: Ceres CLONE 1476289-F
  misc_feature (29)..(29): Xaa is any aa, unknown, or other
  misc_feature (66)..(66): Xaa is any aa, unknown, or other
MDSSSLKSAQLLELMRQHLATDAGKEVTXRSVSSTAHIAPKRSALMKRSRVDLKKARVTRAVQGSXCPFLFTTRFL

SEQ ID NO: 53783 - DNA, 656 bp, Zea mays
  misc_feature: Ceres CLONE 1476291-F
  misc_feature: Encodes the peptide sequence at SEQ ID NO. 53784
  misc_feature (353)..(353): n is a, c, t, g, unknown, or other
  misc_feature (371)..(371): n is a, c, t, g, unknown, or other
  misc_feature (401)..(401): n is a, c, t, g, unknown, or other
  misc_feature (420)..(420): n is a, c, t, g, unknown, or other
  misc_feature (483)..(483): n is a, c, t, g, unknown, or other
aaagctggagctccccgcggtggcggccgctctagaactagtggatcccccgggctgcaggaattcgtctcacccctagaaaaaggccaccaaaggtaccttgcaatcacaacgaacagaagctctcgatctcaccgacaccgaggaagaagagatcaatggcgtccgagcagggagtcgtgatcgcgtgccacagcaaggctgagttcgacgcccacatgaccaaggcccaggaagccggcaagctggtggtcatcgacttcactgccgcctggtgcggtccatgccgcgccatcgccccactgttcgtcgaacacgccaagaagttcactcaggtcgtcttcctgaaggtnggacgtgacaaagtgaangaagtcaccgcggcctacgaggtcgaggcnatgccaaccttccacttcntcaagaaacgcaagacggtcgcgaccatcggtgggtgccaggaaagaccagctccctggcaanatcgagaagcatgcccgcgcctgcgcctgcgtctgcgtctgcctaaaggaaatcagtcgtcccccgtcaataaggcccagccccgttggctgtaaatgttggccgttaacaattccgggctttgtcgttttgggggcaattggaaaccaatgaggttgttttgtttccacccg

SEQ ID NO: 53784 - protein, 139 aa, Zea mays
  misc_feature: Ceres CLONE 1476291-F
  misc_feature (8)..(103): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
  misc_feature (71)..(71): Xaa is any aa, unknown, or other
  misc_feature (88)..(88): Xaa is any aa, unknown, or other
  misc_feature (109)..(109): Xaa is any aa, unknown, or other
MASEQGVVIACHSKAEFDAHMTKAQEAGKLVVIDFTAAWCGPCRAIAPLFVEHAKKFTQVVFLKVGRDKVXEVTAAYEVEAMPTFHFXKKRKTVATIGGCQERPAPWQXREACPRLRLRLRLPKGNQSSPVNKAQPRWL

SEQ ID NO: 53785 - DNA, 673 bp, Zea mays
  misc_feature: Ceres CLONE 1476293-F
  misc_feature: Encodes the peptide sequence at SEQ ID NO. 53786
  misc_feature (214)..(214): n is a, c, t, g, unknown, or other
  misc_feature (225)..(225): n is a, c, t, g, unknown, or other
  misc_feature (331)..(331): n is a, c, t, g, unknown, or other
  misc_feature (391)..(391): n is a, c, t, g, unknown, or other
  misc_feature (394)..(394): n is a, c, t, g, unknown, or other
  misc_feature (397)..(397): n is a, c, t, g, unknown, or other
  misc_feature (403)..(403): n is a, c, t, g, unknown, or other
  misc_feature (430)..(430): n is a, c, t, g, unknown, or other
  misc_feature (431)..(431): n is a, c, t, g, unknown, or other
  misc_feature (434)..(434): n is a, c, t, g, unknown, or other
  misc_feature (435)..(435): n is a, c, t, g, unknown, or other
  misc_feature (469)..(469): n is a, c, t, g, unknown, or other
aagctggagctccccgcggtggcggccgctctagaactagtggatcccccgggctgcaggaattcgtctcacccctagaaaaagccgctgctgacagggcacctgatggattgatttcctcgagcagtcagcggcgctaaagagtcacgagcttactggttgtaagcaacgatcgacgaacgaggggtgtagggagtgcaaggaaagagctcancgttcatgganagccccaaggaggagcaggcggcggtggggtggatgaccgtgccggcgttcggggagtgggacgtgaagaacggcgccgtgccggactactccatggacttctccnagatccgcgagatgcgcaagcagaacaggcgcgagctctcccggtcccgggccagcgtcngcngcngcaacnacgacgacgacctactccagagagcannccnnccgcatgagggaggagggaaagcaggcccacccncgcaacaagccctccgcggctgtcgcggaccacggccaccgtctagcgctgcacgactactcccctacggggaagaaagaagttcctgagctatttccagtgctgtaccagagcggtgagaaaactcccaagactttgttcttcctctgctgcgctgcgcaggtaactgcatggttgggcttccttcctgaaatgaatgaaaag

SEQ ID NO: 53786 - protein, 112 aa, Zea mays
  misc_feature: Ceres CLONE 1476293-F
  misc_feature (2)..(2): Xaa is any aa, unknown, or other
  misc_feature (38)..(38): Xaa is any aa, unknown, or other
  misc_feature (58)..(58): Xaa is any aa, unknown, or other
  misc_feature (59)..(59): Xaa is any aa, unknown, or other
  misc_feature (60)..(60): Xaa is any aa, unknown, or other
  misc_feature (62)..(62): Xaa is any aa, unknown, or other
  misc_feature (71)..(71): Xaa is any aa, unknown, or other
  misc_feature (72)..(72): Xaa is any aa, unknown, or other
  misc_feature (84)..(84): Xaa is any aa, unknown, or other
MXSPKEEQAAVGWMTVPAFGEWDVKNGAVPDYSMDFSXIREMRKQNRRELSRSRASVXXXNXDDDLLQRAXXPHEGGGKAGPPXQQALRGCRGPRPPSSAARLLPYGEERSS

SEQ ID NO: 53787 - DNA, 662 bp, Zea mays
  misc_feature: Ceres CLONE 1476297-F
  misc_feature: Translation starting site: 164
  misc_feature (1)..(1): n is a, c, t, g, unknown, or other
  misc_feature (313)..(313): n is a, c, t, g, unknown, or other
naaagctggagctccccgcggtggcggccgctctagaactagtggatcccccgggctgcaggaattcgtctcacccctagaaaaaagctcgcactcactcacacccgcagcgaaggagggagcttgcacgggccaacgcacacacaacacaagctcgtcgtcgatggcgcggtgggctgcggtgctggcgctggccgcggccacggccatcgccgtggcgtccgtggcgggcggcgacatgaacgcggacaagacggagtgcgcggaccagctggtgggcctggcgccgtgcctgcagtacgtgcaggggcanggcccgcgcgccgccgcccgactgctgcggcggcctgcgccaggtgctggggaaagaagccccagtgctgtgcgtgctcgtcaaggacaaggacgaccccaacctgggcatcaagatcaacgccaccctcgcgctcgcgctccccaaacgctgcggcgccacccgcgccaacgtctcccactgcgctcagctcctgcatattcccccgggctccaaagacgccgccgtcttcagtcccggcagcgacaagggctcccactgcgctcccagcaaggaacactcgacggcgacgaccgactcccgcgcgctgcaggcgaccacgggacgcggcgtctcctcctcggcggag

SEQ ID NO: 53788 - DNA, 642 bp, Zea mays
  misc_feature: Ceres CLONE 1476308-F
  misc_feature (341)..(341): n is a, c, t, g, unknown, or other
  misc_feature (440)..(440): n is a, c, t, g, unknown, or other
  misc_feature (456)..(456): n is a, c, t, g, unknown, or other
  misc_feature (606)..(606): n is a, c, t, g, unknown, or other
aagctggagctccccgcggtggcggccgctctagaactagtggatcccccgggctgcaggaattcgtctcacccctagaaaatatacggcggcttcaaggggaagcttggcgtcgaggatgcccccgagctgcagctcaaccgcatccgcatcacactctcatccaagaacgtcaagaacttggagaaagtttgtgcggatttggtaagggagccagggacagcatttgagggttagggacctgtcaggatccctactaaggttctccacatcaccactcgcaagtccccttgcggtgaaggacaaacacatgggatcggtttgagttcccattcacaagnaggtgattgacctaatcagctcccctgatgtggtgaagcagatcacctcatcacaattgagcccgggtgtgaggttgaggtgaccattgccgacgtgtnaagacgtgaagttcancaatgtcatcgacaatctttttctttgtgctccctgtgtgctcgcagagagattttgagttatattagcatacaagactttctccccccctatattctatggtagctgtttgtctgatctatgggcctgtcaacttgaatttttgatcanaaatctttaggtggggctaattgaactgggatccca

SEQ ID NO: 53789 - DNA, 645 bp, Zea mays
  misc_feature: Ceres CLONE 1476315-F
  misc_feature: Encodes the peptide sequence at SEQ ID NO. 53790
aagctggagctccccgcggtggcggccgctctagaactagtggatcccccgggctgcaggaattcgtctcacccctagaaaaaacaacagcgaacacatctcctcgcatttcttcccatccgatccccccttcgcaaccaaaaccccaactcgccccgcatcgatggcgcccaaggccgagaagaaacccgcggcgaagaagccggcggaggaggagcccgcggccgagaaggcgcccgcggggaagaagcgaaggcggagagcgggtccccgctggcaatccgctgccaaggaagcggcgagggcaagaggggcaagaagaggggcaagagagcgtggaacctacaaatctacatcttcaggtgctgaagaggggcacccggacattgcatctcctccaggccatgtccatcatgaactcctcattaacatatcttcaagaactcgctgctgaggccgccaagctcgcgcgctataacaagaagccaccctcccctcccgggaaatccagactccgggggcctcgtctttccgggggaggtccccaagcacgccgtcctccaagggcaccaaggccccccccaagttccccctcggcctaagggggcgcggcccgcccttgacagattctccccggggggtccc

SEQ ID NO: 53790 - protein, 96 aa, Zea mays
  misc_feature: Ceres CLONE 1476315-F
MAPKAEKKPAAKKPAEEEPAAEKAPAGKKRRRRAGPRWQSAAKEAARARGARRGARERGTYKSTSSGAEEGHPDIASPPGHVHHELLINISSRTRC

SEQ ID NO: 53791 - DNA, 662 bp, Zea mays
  misc_feature: Ceres CLONE 1476321-F
  misc_feature (433)..(433): n is a, c, t, g, unknown, or other
aagctggagctccccgcggtggcggccgctctagaactagtggatcccccgggctgcaggaattcgtctcacccctagaaaaaagtcgcctccttcctgcgccgccgccgccgccgccgccgccgctaccaccgcctcgcggccgcctgcggctccgcgtttccgcacggaagttggtgaggtttcttgaggctgagacatggtgctgaagacggaactttgccgcttcagcggccagaagatttatcctgggaaagggcattagatttatccgtgctgattctcaggtcttcctttttgccactcgaaatgcgagcgctacttcccacaccgcctgaagccctgcaagcttacctggacagcaatgtacaggaagcagcacaagaaggatatccatgctgaaagcggtaaagaagaggcgccgcgcccaccnagaaccatactccaggtcattggtgggtgcttccttggaggtaatccagaagaagagagctgaagaacccagaggcccgcgatgctgctagagaagctgctcttcgtgagatcagggagcgcatccagaggaccaggatgaaaaaaaagcgaggaaggcggaggtaaccaagccccaaaaaacccaaacaaggggtgccggccaaaaagggttcccaggcccccaagtg

SEQ ID NO: 53792 - DNA, 675 bp, Zea mays
  misc_feature: Ceres CLONE 1476517-F
  misc_feature: Encodes the peptide sequence at SEQ ID NO. 53793
aagctggagctccccgcggtggcggccgctctagaactagtggatcccccgggctgcaggaattcgtctcacccctagaaaaaacacaaaaaacctcaccttctcattccttcaagcgtcagcagcaaaaccagagcttcccttcaacccagcaagaaaaccaagcgacctagttagcgcagcggcagttatttgtgcagcccccgatctgactgagagaggcaggcggcagctcgatcggcagtgaccgcgcgcgagccatgggactggcctggatggtggcggcggccgtcgcggccgtgctggcgtcgtgggcgttcaacgcgctggttcacctcgtgtggcgtccttacgccatcacccggaggctccgcgcgcagggcgtgcgcgggccgccctacacgttcttaaccgggagcccccgcgagatcaagcggctccgcggcgagggcgccgccgtcacgctggacgtctacgaccacgactttctcccatggtgcgcccccatctgcgcaatgggatcgggttcttaggggcggaagttcgtgtatggaaccggacacgaggccaaacccgcgcctggcccaaaccgaaacgtgggtccggaaggggcccttcgaaccgtcccggcccctttacccccagaagcttcaggaaccccgccacaacccccgg

SEQ ID NO: 53793 - protein, 90 aa, Zea mays
  misc_feature: Ceres CLONE 1476517-F
  misc_feature: SWISSPROT Homolog: EC 1.3.3.9 Secologanin synthase
MGLAWMVAAAVAAVLASWAFNALVHLVWRPYAITRRLRAQGVRGPPYTFLTGSPREIKRLRGEGAAVTLDVYDHDFLPWCAPICAMGSGS

SEQ ID NO: 53794 - DNA, 624 bp, Zea mays
  misc_feature: Ceres CLONE 1476530-F
  misc_feature: Encodes the peptide sequence at SEQ ID NO. 53795
agtggatcccccgggctgcaggaattcgtctcacccctagaaaaagaatcgtattctcaacagttctcaccgcgacaccgcccatcctctctccgacatcgattcgcgccgagccgccgaccacctgccgccgtctcctccttagtcccagccatggccggcggcgacggcgatcggcatcgcgcgccgaagcggcacaagtcctcggcgccgtcgaaagcggccctggtggacgagagcgccgagttcgactacgctgatgactttgatgacgacgcccacgatgctgatatggaggttaagaagagggattttacgaagctcgagttgaaggtggaccacgcgagccgtccgctctgggcgtgcgccgaaggacgcatcttcctcgagaccttctcgccgctctacaagcaggcttacgattttctcatcgccatcgccgagcctgtgtgcgggccaaaatctatgcatgaatacaatctaactccccactcattgtatgctgccggcctcaatgggactttgaaccagccctatcatcaggggtcttggagaaaactattctaaaacccaggttgcccccgggaaataattggatttcttccctgggatcaaccggctaac

SEQ ID NO: 53795 - protein, 137 aa, Zea mays
  misc_feature: Ceres CLONE 1476530-F
MAGGDGDRHRAPKRHKSSAPSKAALVDESAEFDYADDFDDDAHDADMEVKKRDFTKLELKVDHASRPLWACAEGRIFLETFSPLYKQAYDFLIAIAEPVCGPKSMHEYNLTPHSLYAAGLNGTLNQPYHQGSWRKLF

SEQ ID NO: 53796 - DNA, 763 bp, Zea mays
  misc_feature: Ceres CLONE 1476531-F
  misc_feature: Encodes the peptide sequence at SEQ ID NO. 53797
  misc_feature (20)..(20): n is a, c, t, g, unknown, or other
  misc_feature (32)..(32): n is a, c, t, g, unknown, or other
  misc_feature (33)..(33): n is a, c, t, g, unknown, or other
  misc_feature (37)..(37): n is a, c, t, g, unknown, or other
caggggtgggttattttttnctttctggtganngaangaggccacactaccccactggaactccccgcggtggcggccgctctagaactagtggatcccccgggctgcaggaattcgtctcacccctagaaaaaaaagaacactgctcttcctccgcatagctcgtcgccctctctctcctatcagtcctcccagctccagctaccacagcagccctctcgcttaaaggaggagggagaagggggcgaggcgagcaatgtctgagcagcagcagccattgccgcagcctcggagcagcatgcgggaggcgctggagaaggaggacaaggagaaggcggctgcggcggcggcggccaaggagaaggcggcagtccccaagaacggcaacggcaacggcggcaagaatggcggcgacgccggcagcggcaaagggcggaaaatgcccccggaattcggagaagaaaaggttcttgaaaaaccggggggccgggaagcgaaccccccaagaagggcccgcccggccatggctatagggggaggggccgcggggggggggcaagcctcgacggggggggacccttcccgggtttttgggtccgaaatagacatcccaaacgggtggggtggggggggtcattcttccggcggggacagaatcagggcggggggggcgcgcttccccgcaatttctcgagattctggggggtcgatacacaccgtctaataaccaccccgcggagggggagagcttcgcgcgcgggtg

SEQ ID NO: 53797 - protein, 155 aa, Zea mays
  misc_feature: Ceres CLONE 1476531-F
MSEQQQPLPQPRSSMREALEKEDKEKAAAAAAAKEKAAVPKNGNGNGGKNGGDAGSGKGRKMPPEFGEEKVLEKPGGREANPPRRARPAMAIGGGAAGGGQASTGGDPSRVFGSEIDIPNGWGGGGHSSGGDRIRAGGARFPAISRDSGGSIHTV

SEQ ID NO: 53798 - DNA, 666 bp, Zea mays
  misc_feature: Ceres CLONE 1476532-F
  misc_feature: Encodes the peptide sequence at SEQ ID NO. 53799
ggagctccccgcggtggcggccgctctagaactagtggatcccccgggctgcaggaattcgtctcacccctagaaaaagcaaatcgcaagaacaagagaagaaccaatccgacaacgtctccattctccctcacatctccttgctcgcccagcagctggcactccccgtctcccctcgcatccgcatcgaatcgaggcatatcgccctatatatcccattccgctcggttggattcagcttcccctccctctcccccatcgataaaaccgatgcgtcgcccggcctcgcgtaccctaccggcgacgggacgaggggaaggttacaggcacggcgcgtgaagggtcctgcccagtcctgcccggtccgccgcgatgccgtggtttgagatgtggctgcctcctgtgcctggaaacgcggctgtggcggcggcgggggggctgttcctcgacggcgccgatgcggcggggcacggcgcgctcctcgcggccatgcctggttgctccttgtcgttcgggctccggaaccagcggttgcaggggggccgccgccggggttccctggcgctgaaaatgtccggcaaagggggggaagggggcttttgtgcccggccccggagggggttgctccgctgggggcggaaggaaaaaaagcggggtcggaagaat

SEQ ID NO: 53799 - protein, 98 aa, Zea mays
  misc_feature: Ceres CLONE 1476532-F
MPWFEMWLPPVPGNAAVAAAGGLFLDGADAAGHGALLAAMPGCSLSFGLRNQRLQGGRRRGSLALKMSGKGGEGGFCARPRRGLLRWGRKEKKRGRKN

SEQ ID NO: 53800 - DNA, 784 bp, Zea mays
  misc_feature: Ceres CLONE 1476534-F
  misc_feature: Encodes the peptide sequence at SEQ ID NO. 53801
  misc_feature (29)..(29): n is a, c, t, g, unknown, or other
  misc_feature (30)..(30): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (91)..(91): n is a, c, t, g, unknown, or other
tgtttttttttttcgtttctttcctcctnnatnnnnnnnnnnngggggagnnnnnnactcctggggctcaccgcggtggcggccgctctanaatagtggatcccccgggctgcaggaattcgtctcacccctagaaaaaacgaccgcttggcgcttcatcactcgttccctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcaaaccatcgacgatctgcactcgctgcagcggaagcggtccgcgcccagcacgcccaaggcgggcggcgcccaccacggcccatcagggggggtgccccccccccccctgggggggggggggggttctcaaaaaccaatccccacaccccattaaaaccccctcccaccatcggcgtccgtggggcggcctccagaacgcgcgggaaacaccgggcctctaaggggggggccaaggggggaaccccgggtcgggtaaaaggcctcaacggccccctccccgcagggtgccccgccccatctgcaccccccaaaggggcgccctttggggggtatcccgtccatctcccttgcgccccccgccgctacccaccggtggggggggaggaggttgccccccgggtttgctctccagggggcgccacacaaaacccctcccagttctggctgcggccacag

SEQ ID NO: 53801 - protein, 84 aa, Zea mays
  misc_feature: Ceres CLONE 1476534-F
  misc_feature: SWISSPROT Homolog: EC 4.1.1.49 Phosphoenolpyruvate carboxykinase (ATP)
MATPNGLARIETTGKKKQDNGVWYDDSSAPVRAQTIDDLHSLQRKRSAPSTPKAGGAHHGPSGGVPPPPLGGGGGSQKPIPTPH

SEQ ID NO: 53802 - DNA, 624 bp, Zea mays
  misc_feature: Ceres CLONE 1476542-F
  misc_feature: Encodes the peptide sequence at SEQ ID NO. 53803
  misc_feature (595)..(595): n is a, c, t, g, unknown, or other
tctgaactagtggatcccccgggctgcaggaattcgtctcacccctagaaaaagtcggaatatcatacgaaaaccctcgcggcgaggagcgctctccgtcccacacacgcgcgccgcagcctccgcagtccgcacctgcctccacgacctggcgtgctcgtgcgctactctcctcgagcgcggcgcggagcacggggacatcaaatggcggcagcggcggagatcggtggtttcgcggcggcgagagtggcggtggcaacgctcaggccggctgcgcacccagccccggcggcggcggcggcaccgcagcctaggagggcggtggcggcgcagtcgctgcagacgaccgccaccgaggcgctgacggcggatctcgccggcacgaccaaccccgctgtgcatgctcggatgaatagtaaggctacaagtgaaatcacttcacaggcagttactgcaaattctaggagaaagacaaagatagtctgcaccataggtccctcaaccaacactcgtgagatgatttggaagcttgcaaagactggaatgaatgtagccgcgccttaatatgtcccatggggaccacccgttcgcaccngaaggttattgatttggtcagggagtaca

SEQ ID NO: 53803 - protein, 119 aa, Zea mays
  misc_feature: Ceres CLONE 1476542-F
  misc_feature: SWISSPROT Homolog: EC 2.7.1.40 Pyruvate kinase
MAAAAEIGGFAAARVAVATLRPAAHPAPAAAAAPQPRRAVAAQSLQTTATEALTADLAGTTNPAVHARMNSKATSEITSQAVTANSRRKTKIVCTIGPSTNTREMIWKLAKTGMNVAAP

SEQ ID NO: 53804 - DNA, 669 bp, Zea mays
  misc_feature: Ceres CLONE 1476545-F
  misc_feature: Encodes the peptide sequence at SEQ ID NO. 53805
tggagctccccgcggtggcggccgctctagaactagtggatcccccgggctgcaggaattcgtctcacccctagaaaaaaccgcctccgctagcccttccgctccatactagccgaaagagatctcggcaccgccgcccgtcgccatggcggcggccaacgcccccatcgccatgcgcgaggcgctcacgctcaccagtctaggcatcgcgccgcagttcgtcaccttcacccatgtcaccatggagtcggagaagtacatctgcgtccgcgagacctccccgcagaacagcgtcgtcatcatcgacatggccatgcccatgcagccgctccgccgtcctatcaccgccgactccgcccttatgaaccccaacgccaggatcctcgcgctgaaagcccaaatacctggaacaacacaggatcaccttcaaatatttaacattgaggctaagactaagatcaagtctcaccaaatgcccgagcaggttgtattttggaaatggatcactcctaaattgttgggtttagtgacacaaacatctgtttaccactggtcaattgaaggtgattctgagccaaccaagatgtttgataggacagctaatttggcaaacaatcagatcatcaactatcgatgtgacccagcggagaagtggcttgtacttattgg

SEQ ID NO: 53805 - protein, 174 aa, Zea mays
  misc_feature: Ceres CLONE 1476545-F
MAAANAPIAMREALTLTSLGIAPQFVTFTHVTMESEKYICVRETSPQNSVVIIDMAMPMQPLRRPITADSALMNPNARILALKAQIPGTTQDHLQIFNIEAKTKIKSHQMPEQVVFWKWITPKLLGLVTQTSVYHWSIEGDSEPTKMFDRTANLANNQIINYRCDPAEKWLVLI

SEQ ID NO: 53806 - DNA, 655 bp, Zea mays
  misc_feature: Ceres CLONE 1476550-F
  misc_feature: Encodes the peptide sequence at SEQ ID NO. 53807
  misc_feature (541)..(541): n is a, c, t, g, unknown, or other
tggagctccccgcggtggcggccgctctagaactagtggatcccccgggctgcaggaattcgtctcacccctagaaaaactattgctttaacaaagccagagacatgttctccaacaaatcctgttgaagacagagattcgagttctgcttctgcggtgtcttgtcagtcaggggctcctgcctgcattccccaacccgatccaacatctacatgtaattcaagtaagattgaggcaaccatggatcagcataaaacatgccagcctgacacatcaaatgaatcattcggccggcttcctgaacctcaaagtggctcactcttttccttgaaaactctaaatcttgagtccgagcaccctagtcctaccccaaaactggaggggaaggaaacttccatgaaccagtcaggatcaacatcagtagcacatgagaatttagctacaaagacatgtgtccacccacctaccagtaaaattgatagcttgcaaccacttaaggaaagatcatgtccaacagaaagggactcaatcactcaattanagcatctgtttgaagagaatgtggtaaagagaaataacgaagtggtcaatcctgtatctgatgctgaagggattgctgtatcagatgtgttggaatcgttaacagaacaagatg

SEQ ID NO: 53807 - protein, 138 aa, Zea mays
  misc_feature: Ceres CLONE 1476550-F
  misc_feature (101)..(101): Xaa is any aa, unknown, or other
MDQHKTCQPDTSNESFGRLPEPQSGSLFSLKTLNLESEHPSPTPKLEGKETSMNQSGSTSVAHENLATKTCVHPPTSKIDSLQPLKERSCPTERDSITQLXHLFEENVVKRNNEVVNPVSDAEGIAVSDVLESLTEQD

SEQ ID NO: 53808 - DNA, 607 bp, Zea mays
  misc_feature: Ceres CLONE 1476551-F
  misc_feature: Encodes the peptide sequence at SEQ ID NO. 53809
agtggatcccccgggctgcaggaattcgtctcacccctagaaaaactgcagccgccggccctcagcaagcaagcaagggacagacgcggcggggatgggcagcggggtccgggcgctgatgcgccggaagcaggtagactccgagcggacgcgcgccgccggcagcgcccaccagctccgcaaggagctctccgtcacccagctcgtcgccatcggtgttgggtcgacgattggagctggcgtctacgtccttgttggcacagttgcgcgggagcattccgggccggcattgacgctttcatttctgatagccggaatagcagctgcgctttcagccttctgctatgcggagctggctagccgttgcccttcggaaacacacgcctatcattattcgtacatctgcgttggcgaaggagttgcatggctgattggctgggctgtgatacttgaatacacgattggtggatcagccgttgcccgtggcatttctcctaatctagccttattttctggaggacaggatagtctgccatggattttagcacgacatgagaatcccatggctttgatgtcccttgtaaatcccttggtgcttcttttcatc

SEQ ID NO: 53809 - protein, 171 aa, Zea mays
  misc_feature: Ceres CLONE 1476551-F
MGSGVRALMRRKQVDSERTRAAGSAHQLRKELSVTQLVAIGVGSTIGAGVYVLVGTVAREHSGPALTLSFLIAGIAAALSAFCYAELASRCPSETHAYHYSYICVGEGVAWLIGWAVILEYTIGGSAVARGISPNLALFSGGQDSLPWILARHENPMALMSLVNPLVLLFI

SEQ ID NO: 53810 - DNA, 811 bp, Zea mays
  misc_feature: Ceres CLONE 1476556-F
  misc_feature: Encodes the peptide sequence at SEQ ID NO. 53811
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (17)..(17): n is a, c, t, g, unknown, or other
  misc_feature (18)..(18): n is a, c, t, g, unknown, or other
  misc_feature (21)..(21): n is a, c, t, g, unknown, or other
  misc_feature (36)..(36): n is a, c, t, g, unknown, or other
  misc_feature (45)..(45): n is a, c, t, g, unknown, or other
  misc_feature (46)..(46): n is a, c, t, g, unknown, or other
  misc_feature (49)..(49): n is a, c, t, g, unknown, or other
  misc_feature (51)..(51): n is a, c, t, g, unknown, or other
nggttgggttnnttttnnccncccaaacgtttcctncttaaaaannaananacaaaactggagctccccgcggtggcggccgctctataatagtggatcccccgggctgcaggaattcgtctcacccctagaaaaagccggtcgccaccaccaatggggccacccgccatggcgttccaagccctcaccctcacgccactccccttctcactccacagctcgagccgccgcgtccgcgtgcttgccgttgcggccgaccagactcctccgcccgcccccccttcggagccggcgaacagccctagccgcctccttcgcgagctcgcgcagcggaagaaggccgtatcccctaagaaaaacatccgccgcgtcgcttcatcctggagccacctctcgatgacaagcgccttacccggcggttcctcaacagccccgcagctggcggttcaagggagtttccgatagtttcgccaccccctccccttccgggccggttcttcaacggccaaaagaagacctggaatgggaaaaaaaaccccccccccaaagccaaaaaaaggggtcctgcggaaaacctccttcccggccccccccagaaaacccccccccgcaaaaagaaaaaaaaatggccccccccgcgggagattttaaaaaggggggggggtctcccaccccagctgcccaccacatttgagacccctctcaaaaccacgaccgcccgaaaataggcgacacccacaaaaaaaagccccccacccacgggctgcgggtgtccggcggggtaaccgcaaccgttaatcaacacgccccc

SEQ ID NO: 53811 - protein, 103 aa, Zea mays
  misc_feature: Ceres CLONE 1476556-F
MGPPAMAFQALTLTPLPFSLHSSSRRVRVLAVAADQTPPPAPPSEPANSPSRLLRELAQRKKAVSPKKNIRRVASSWSHLSMTSALPGGSSTAPQLAVQGSFR

SEQ ID NO: 53812 - DNA, 681 bp, Zea mays
  misc_feature: Ceres CLONE 1476557-F
  misc_feature (361)..(361): n is a, c, t, g, unknown, or other
  misc_feature (365)..(365): n is a, c, t, g, unknown, or other
  misc_feature (372)..(372): n is a, c, t, g, unknown, or other
  misc_feature (373)..(373): n is a, c, t, g, unknown, or other
  misc_feature (681)..(681): n is a, c, t, g, unknown, or other
ggagctccccgcggtggcggccgctctagaactagtggatcccccgggctgcaggaattcgtctcacccctagaaaaaaaaaacgccccacagcgcaagcgagcagatcctcctccctttctgcttcctggcatcctctctgcctccccgcgccgatctcgagcacctggggagaccgcgagacgtgcgcctgatttttctcatcgcagcagccctcaagttccccacctcttttttcttgcagctttcaattaatctggttatttagctacatctttattttactttcattttaccctttatctgtttagttccattgcatcttctgcggttgcgggttagtatgctgtttcctgctccntggnttctggnntctttggctctaaccatggacgcaggaacctactccatctcatcaaaaaagagccccccggcggcagcgggggcgcccccttctttggggaggccggaatccggccttaattgccgtttcttaaacaagggatccccaaacccggtggccaaggggttgggggaaaagggtttccccccgaacgggccgccaaaggaaaagaaaatggggcccatcctcggtccccggggccccccgagggaaaaagaaaaaaggggggggggctcccccccccctcccgggggggggcccggggaggtccgcccccn

SEQ ID NO: 53813 - DNA, 652 bp, Zea mays
  misc_feature: Ceres CLONE 1476558-F
  misc_feature: Encodes the peptide sequence at SEQ ID NO. 53814
tggagctccccgcggtggcggccgctctagaactagtggatcccccgggctgcaggaattcgtctcacccctagaaaaaatcgcccccgccaggcgccagcctcccgtatttgatgtttcacaaacgcgtgagcggctcgccctcctctccagtccctcctccctccggtccgcacaggggagcagccggcagcagctagctaccacaggtacgcctgtctccggtccagtgcaatcttgtcttctttttggatttgtgatcgacgatgatgtagtatgtagcaaagtgtttgcttggcatgtgggctcaaggcgtaagtaaggatcagtctagaggtttggttgccaagttcagtgcactacgctgacactccctcctctccctgcgtgcactgctgctagtaccagcagcaataagctaatcagctacgatggcggactacgtgtatggccccgggcggacccacctgttcgtgccgggccccgtgaacatcccggaccccgtgatccgcgccatgaaccggcagaacgaggactaccgctcgccggcggtgccggcgctgaccaaggtcctgctggaggacgttaagaagatcttcaagaccacgacgggcacgcccttcatgatcccgacgacggggacgggcgcgtg

SEQ ID NO: 53814 - protein, 73 aa, Zea mays
  misc_feature: Ceres CLONE 1476558-F
  misc_feature: SWISSPROT Homolog: EC 2.6.1.45 Serine--glyoxylate transaminase
MADYVYGPGRTHLFVPGPVNIPDPVIRAMNRQNEDYRSPAVPALTKVLLEDVKKIFKTTTGTPFMIPTTGTGA

SEQ ID NO: 53815 - DNA, 793 bp, Zea mays
  misc_feature: Ceres CLONE 1476566-F
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (632)..(632): n is a, c, t, g, unknown, or other
  misc_feature (716)..(716): n is a, c, t, g, unknown, or other
  misc_feature (744)..(744): n is a, c, t, g, unknown, or other
tttccccccttcccgtttccccccagcccccttttnnnnnnnnncaccccnnntcacactggagctccccgcggtggcggccgctctataatagtggatcccccgggctgcaggaattcgtctcacccctagaaaaaaacgaaccatctagtagctggttccctccgaactttccctcaggatagctggagcccacccgagttctatcgggtacaaccaatgattacagggatccggggtgtaacgccctcgcactattctcaaattttaaatagcgaggaccgcgcgactgccttgtggagccggggtacggaaccggggagtctaagggggccattcttggtacctcagaaatggccatgccgcgatgaacccgaatgcccggttacccgggccaatcggcgcgtttcccctttaattcccccttcgccttttgccccgactacgactagctcccatcctgccccattggcaatttaaaaaatataaaaaaaaaaaaaatattaacaacctttcccccgtcccccccaacccccccctcaataccccctttcccccctttaagaaccgggtgtatgcgcgttccttttcccatttggctcccccgcccacgtgcccccccccatactaanccgacggcacttccgcatggaacgtaccaaaaacccccgggagcggcggtgtccacgagatctacggtaaccacccccaccccnaaaacatcctccgtctcccaccctcacnccaatcatagccagttttaccgcgggtctccaacccaaccgcaaggtgg

SEQ ID NO: 53816 - DNA, 786 bp, Zea mays
  misc_feature: Ceres CLONE 1476569-F
  misc_feature: Encodes the peptide sequence at SEQ ID NO. 53817
  misc_feature (1)..(1): n is a, c, t, g, unknown, or other
  misc_feature (734)..(734): n is a, c, t, g, unknown, or other
nttgcctccgccccttttgcccccctcccatttagcttgcccaaccctttaaaactgggactccaccgcggtggcggccgctctatactagtggatcccccgggctgcaggaattcgtctcacccctagaaaaaagtcgtcccccccgggcccgacccccctccgtttgccaacgactccgggctccactgtcgctcgctctcgctcccttccctcccacgcaatggtggccgatcgcctccgcctcgcgctgctgctctccgcgtgcctctgctccgcgtgggcgcgcccacgcctcgagccgaccatccgcctgccgtccgagcgcgcggcggccgacgacgccgtcgggacccggtgggccgtgctcatcgccggctccgagggctactacaactaccggccaccccggtggacttccgccctgccattccctatcatggaagaagggcggtactttacggattaaaaatatcgcccatctccgtgtgccgataaacatcacctcatccatccgccaaaacccccaggactttggcggcctttccctggtttcctccccctggcggggctgtccgttcgggggttgggtgttggcctcggggaactcccaccgggtctgaacaaggggccacgttccaacaaattcccttttggtgtgttggagccctctgggtaacccaaatctcgttcttcccgggcgctggctagtcgttccagcgttcgacataaanagcgggatctctcgagtgacctgaacacttataggtccagttgaaagcagag

SEQ ID NO: 53817 - protein, 81 aa, Zea mays
  misc_feature: Ceres CLONE 1476569-F
  misc_feature: SWISSPROT Homolog: EC 3.4.22.34 Legumain
MVADRLRLALLLSACLCSAWARPRLEPTIRLPSERAAADDAVGTRWAVLIAGSEGYYNYRPPRWTSALPFPIMEEGRYFTD

SEQ ID NO: 53818 - DNA, 659 bp, Zea mays
  misc_feature: Ceres CLONE 1476571-F
  misc_feature: Encodes the peptide sequence at SEQ ID NO. 53819
  misc_feature (585)..(585): n is a, c, t, g, unknown, or other
tggagctccccgcggtggcggccgctctagaactagtggatcccccgggctgcaggaattcgtctcacccctagaaaaaacgtctccggctccggcgtccgcttccaaccaactcacaccaaagtggcgacatcgccttccgccgcctgacagtctgacacgtttggagttgtagttttagccgccagctccatggagtctgctcccgccgcggtcatggagcgggagcgcctcacggccgagatggccttccgcggcgcggacgaagcgcggcgggacggcggcgagccggcgcccagcatcgtcatcaagatccgccgccggctcccggacttcgcccgcagcatcaagctcaagtacgtcaggctcgggatccgacacggaggcagccccacgtcggtgctgccgatgctctgcgtgccggcggtcgccgccgccgcctactcgttcgtccgcctcgacgtcatctactactccatcgacctgctcacctgcgtcgcctggctcggcaccgcgctgctgctgctcaccgtctactacttcaagcggccccgcccggtgtacctcgtggacttcgcgtgctancagccggagcagcagctcaagatctccaagtccgccttcctcgagatgaccgagagcacgggggtcctttcatg

SEQ ID NO: 53819 - protein, 155 aa, Zea mays
  misc_feature: Ceres CLONE 1476571-F
  misc_feature: SWISSPROT Homolog: EC 2.3.1.119 Icosanoyl-CoA synthase
  misc_feature (131)..(131): Xaa is any aa, unknown, or other
MESAPAAVMERERLTAEMAFRGADEARRDGGEPAPSIVIKIRRRLPDFARSIKLKYVRLGIRHGGSPTSVLPMLCVPAVAAAAYSFVRLDVIYYSIDLLTCVAWLGTALLLLTVYYFKRPRPVYLVDFACXQPEQQLKISKSAFLEMTESTGVLS

SEQ ID NO: 53820 - DNA, 675 bp, Zea mays
  misc_feature: Ceres CLONE 1476574-F
  misc_feature: Encodes the peptide sequence at SEQ ID NO. 53821
tggagctccccgcggtggcggccgctctagaactagtggatcccccgggctgcaggaattcgtctcacccctagaaaaagaagctgcgtgggcggctcgttcggctcggctggacctggacgcttcacctcccccctctctgtcttgtccgcttttggtcgaccgcgccaccgcggccttgggcggatcaatccatcgtggagtgggccaagaagcggccgcctgatcaagccgaaccaacggccgacgcggcgcacgccatggaagaagctggcaatccacctcctaaaccgtgggaacgtgcacgaaattcatctggcccagtggcttttaaaccgccctctggtggtaacaccagtgatgttgttgaagcttctgggacagcaaaacatggagaacttgtttctgcttctggaaacaatgttgcctccaatgtaaacagcacaatttcaatgcctgtgcccccaaggccttggcagcagcaaggctatgaaaactcttatgggggttatggctccagtatgtatagctcttaccgtggatatagtggaccctatggaaataacatgtactcacgttatggacgaggttatggaggtatgtatggaggttctggtaatgtatggtggacccatgtatatcggtggaatgggaggaccctatgttggctatggt

SEQ ID NO: 53821 - protein, 138 aa, Zea mays
  misc_feature: Ceres CLONE 1476574-F
MEEAGNPPPKPWERARNSSGPVAFKPPSGGNTSDVVEASGTAKHGELVSASGNNVASNVNSTISMPVPPRPWQQQGYENSYGGYGSSMYSSYRGYSGPYGNNMYSRYGRGYGGMYGGSGNVWWTHVYRWNGRTLCWLW

SEQ ID NO: 53822 - DNA, 708 bp, Zea mays
  misc_feature: Ceres CLONE 1476581-F
  misc_feature: Encodes the peptide sequence at SEQ ID NO. 53823
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
tggcggccgctctagaactagtggatcccccgggctgcaggaattcgtctcacccctagaaaaaacgacacctcgctcgcttctcttccaggcttcgacctccacttccacatggccgctcccatccacgcgcgtctcctcccgctccccttgcacccgaacccaagccccagtctccacgcgagcggcacacgacgggtgccctggcccccgcgccaccgccgccgctgcctcgcgacgccgccgtcgcggaacgggagctcctcctcgccggagattgactggtgcccggtgcctccggaccagctccccgtgaacgagtacgaggcgctcgcggcctccctgcccttctcctgggcggcggggggcctccgcgtctactgctcccgcctcgcgctcacgggcgccgccgtcgcgctcttcgtcgggctcccggtcgccgccttcgggggccgcggcgggccggcggcgacgctctgcacctcgcgctcggcgccacggggtccgggatcctcgccgcacgctcgctgtcgtggacgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 53823 - protein, 144 aa, Zea mays
  misc_feature: Ceres CLONE 1476581-F
  misc_feature (59)..(125): Pfam Name: DUF1230 Pfam Description: Protein of unknown function (DUF1230)
MAAPIHARLLPLPLHPNPSPSLHASGTRRVPWPPRHRRRCLATPPSRNGSSSSPEIDWCPVPPDQLPVNEYEALAASLPFSWAAGGLRVYCSRLALTGAAVALFVGLPVAAFGGRGGPAATLCTSRSAPRGPGSSPHARCRGRG

SEQ ID NO: 53824 - DNA, 723 bp, Zea mays
  misc_feature: Ceres CLONE 1476583-F
  misc_feature: Encodes the peptide sequence at SEQ ID NO. 53825
ctagaactagtggatcccccgggctgcaggaattcgtctcacccctagaaaaactctgattctccccctgctggtctgctctgctcccatcccatggagcccgacgccgcccaaaaccctagccccagccccgtccccccgcccatctccgcctactaccagacgcgcgccgaagaccacggcgtcgtaactagcgactgggtcggccacgccgccgccgcagccgcagccttccccggcgccgataccgtcgatgactacccggcccagtcccccgggggcgaggggaagatctaaggatttaactattggggacgaaagtccctagccccaccacccggggggggggggtcttgggttcttcagcaaagtaatcacgattacacacagccctccacccactcggggaactacgggaaagaaaaactcggagaacgtcccccgacgcatcatgtgggacgcaggagattgggtccataccgagtcttccatcctggccgacctcgtcgcaatcgcatcgtgcggaactcgcggtcttacaaaaccgccacatctagcaagcattaagaaatgttatgctatctgacaagcaaacacaaggctcggtgtgggtgcgggtgactggcagaccaccggggcaataaacaacgattggtcagggaagtcgcaaagcaagcaaaactgcggagggtgcttactgtgtggattatttgtataatgtta

SEQ ID NO: 53825 - protein, 67 aa, Zea mays
  misc_feature: Ceres CLONE 1476583-F
MEPDAAQNPSPSPVPPPISAYYQTRAEDHGVVTSDWVGHAAAAAAAFPGADTVDDYPAQSPGGEGKI

SEQ ID NO: 53826 - DNA, 668 bp, Zea mays
  misc_feature: Ceres CLONE 1476585-F
  misc_feature: Encodes the peptide sequence at SEQ ID NO. 53827
ctccccgcggtggcggccgctctagaactagtggatcccccgggctgcaggaattcgtctcacccctagaaaaaaaaaaccaacgtgctcgatctccctccgccactccatccatctcctcgctcccagtccccgggaagctacgaagcatggcgtccgtcaccgcccgcgccccggtcgcggcccttcgcccgtcgtcggcatcgctcaagtcgtcgtcggccttccttggccactctagccgcctcggccgcaccgcgtcgcccacgaggcgcagcctcaaggcggaggccaagggcgagtggctccccggccttccctccccctcctacctcgacggcagcctggcgggtgacaatggcttcgacccgttgggcctggcggaggaccccgagaacctgcggtggttcgtgcaggcggagctggtgaacggccggtgggccatgcttggcgtggccgggatgctcatcccggaggtgctgaccaaagccgggctgatcaacgcgctgttcgtggtcgagttcatcctgttccactacgtggagatccggcggtggcaggacatcaagaaccccggcagcgtcaaccaggaccccatcttcaagagctacagcctgccgccgcacgagtgcggctacccgggcagcgtcttcaacccgctcaacttc

SEQ ID NO: 53827 - protein, 173 aa, Zea mays
  misc_feature: Ceres CLONE 1476585-F
  misc_feature (57)..(173): Pfam Name: Chloroa_b-bind Pfam Description: Chlorophyll A-B binding protein
MASVTARAPVAALRPSSASLKSSSAFLGHSSRLGRTASPTRRSLKAEAKGEWLPGLPSPSYLDGSLAGDNGFDPLGLAEDPENLRWFVQAELVNGRWAMLGVAGMLIPEVLTKAGLINALFVVEFILFHYVEIRRWQDIKNPGSVNQDPIFKSYSLPPHECGYPGSVFNPLNF

SEQ ID NO: 53828 - DNA, 648 bp, Zea mays
  misc_feature: Ceres CLONE 1476587-F
  misc_feature: Encodes the peptide sequence at SEQ ID NO. 53829
gctctagaactagtggatcccccgggctgcaggaattcgtctcacccctagaaaaaacccgttgcatagtcccgtcgattcccgtcccacttcctcccatctcgtctgccgccgattgtatccggttcttccaaccctcgggaattgatggcgacgaacactagcgggggctccctcggcgatgcggatctgaacgccaccaatgtgtccgcgcgcatcgatctcgacgtccctctcgacgatgcttccaggatgtcttgccacaaccggatgctacccgaccgttcctttctctcttcctcttccactatggatacaaggtctctctcggagctcctcgtcttgggccatcggcgtctccctttccacagcttgatacctcatgttctcacgtgtctgatctcctcgcagtgaagtgccgagggcactgatcgcatggtgaacacgtgcagagttgcctgcctatttgccagactgggtagctctgggccatcagatggtcaatgctaccggcaggaaaaggagaccgaactggagttggctagaagctccccacggtagacgaccttaagtcccagcaacctttttgcccccccaaaagaattttaggcttagccaaaggagtcccccgggtttcccagcccgggg

SEQ ID NO: 53829 - protein, 88 aa, Zea mays
  misc_feature: Ceres CLONE 1476587-F
  misc_feature: SWISSPROT Homolog: EC 2.7.2.3 Phosphoglycerate kinase
MATNTSGGSLGDADLNATNVSARIDLDVPLDDASRMSCHNRMLPDRSFLSSSSTMDTRSLSELLVLGHRRLPFHSLIPHVLTCLISSQ

SEQ ID NO: 53830 - DNA, 632 bp, Zea mays
  misc_feature: Ceres CLONE 1476592-F
  misc_feature: Encodes the peptide sequence at SEQ ID NO. 53831
  misc_feature (632)..(632): n is a, c, t, g, unknown, or other
cgcggtggcggccgctctagaactagtggatcccccgggctgcaggaattcgtctcacccctagaaaaaaccggccgcgaggcggcccgaagccagcgtccttccgtaatgtcttaactccccttctcgagtccatctccaacctcatccctcccaccccaataatacatccagccggcgccatcacgcccggcaacgcgcaaacgaggctgaccatcaaaccctactccccggtcgagccgccctccgccgagacttgcgggcgtgctgcgtcatccctctaagtctccctccgttccattcggctcgtatcccacacggaatacacacccctcatctctgaagccaccgcttataccgagaataagatgcacctgtttttggaggatatactcaatacgtctcagaagaagaatcctggacgccacaaacccccgagacagcagataatcaaacctccattccagaatggaaaatctcatactagtgacggcaaggttcagagcttgatggactccagatcaacgattagacgaggagtacttgcacagagacagccaaatcttgggtgcaaatcaattccatgctacaaagaatgctgcgaacaaggctgctgctatgacaatgcacan

SEQ ID NO: 53831 - protein, 87 aa, Zea mays
  misc_feature: Ceres CLONE 1476592-F
MHLFLEDILNTSQKKNPGRHKPPRQQIIKPPFQNGKSHTSDGKVQSLMDSRSTIRRGVLAQRQPNLGCKSIPCYKECCEQGCCYDNA

SEQ ID NO: 53832 - DNA, 672 bp, Zea mays
  misc_feature: Ceres CLONE 1476594-F
  misc_feature: Encodes the peptide sequence at SEQ ID NO. 53833
ggagctccccgcggtggcggccgctctagaactagtggatcccccgggctgcaggaattcgtctcacccctagaaaaaactagaaaaaaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttccccgagctgctcgcccgcaacggcgtcaagttcggcgaggccgtgtggttcaaggccggctcccagatcttcagcgagggcgggctggactacctcgggaacccgagcctcatccacgcgcagagcatccttgctatctgggcctgccaggtcgtgctcatgggcgccgtcgagggctac

SEQ ID NO: 53833 - protein, 175 aa, Zea mays
  misc_feature: Ceres CLONE 1476594-F
  misc_feature (65)..(175): Pfam Name: Chloroa_b-bind Pfam Description: Chlorophyll A-B binding protein
MASSTMALSSTAFAGKAVNVPSSSAFGEARVTMRKTAAKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGY

SEQ ID NO: 53834 - DNA, 652 bp, Zea mays
  misc_feature: Ceres CLONE 1476596-F
  misc_feature: Encodes the peptide sequence at SEQ ID NO. 53835
acccgcggtggcggccgctctagaactagtggatcccccgggctgcaggaattcgtctcacccctagaaaaagctcgtgccagcgcccagcaggccattctgctcgccttactccctcacagaacccagtaaaatattgccagtcccgccgtcgagatggccccacgccgcctgctcgtcctcgccgtcctcgccctcgcggccaccgccgccgcggccaactccggcttcgcggactccaacccgatccgccctgtcaccgaccgcgcggcctccgcgctcgagtccacggtcttcgccgcgctcggccgcacccgcgacgcgcttcgcttcgcacgcttcgccgtcaggtacggcaagagctacgagagcgcggcggatgtccataagcggttcaggatcttctccgagagcctccagctggtccgctccaccaaccgcaaaggcctctcctaccgcctcggcatcaaccgcttcgcggacatgagctgggaggagttccgtgcgacccggctcggcgcagcccagaactgctccgccacgcttaccggcaaccaccggatgcgcgccgccgccgttgcgctgccggagacgaaagactggagggaggatgggattgtgagcccagtgaataaccagggccactgtggat

SEQ ID NO: 53835 - protein, 165 aa, Zea mays
  misc_feature: Ceres CLONE 1476596-F
  misc_feature (59)..(115): Pfam Name: Inhibitor_I29 Pfam Description: Cathepsin propeptide inhibitor domain (I29)
  misc_feature: SWISSPROT Homolog: EC 3.4.22.16 Cathepsin H
MAPRRLLVLAVLALAATAAAANSGFADSNPIRPVTDRAASALESTVFAALGRTRDALRFARFAVRYGKSYESAADVHKRFRIFSESLQLVRSTNRKGLSYRLGINRFADMSWEEFRATRLGAAQNCSATLTGNHRMRAAAVALPETKDWREDGIVSPVNNQGHCG

SEQ ID NO: 53836 - DNA, 651 bp, Zea mays
  misc_feature: Ceres CLONE 1476598-F
  misc_feature: Encodes the peptide sequence at SEQ ID NO. 53837
ctccccgcggtggcggccgctctagaactagtggatcccccgggctgcaggaattcgtctcacccctagaaaaaatgccgagtccaccatcgcctgccgaccgcccccgcctccccacttccatggtgatctgtctctgctcgtcgcgtctctcgcgcccacctacttggtctactgcgcaacactggtcccacatcggcgggcaggatgatgatgttgatccactgctcgacgtgccgtaacccgctgctgctgccgcgcggtgctccctgtatgccgatgcgcgcatctgtggggctatcgcgcccgatcgcccccgcccctcctgtctagcccaaccgcatgtgccgcaccaccaccgccggtgtggggtccaccgccgccgccggtgcactcggccatacccaaccgcggtgcgccgtatagtcgtatcgacactcccgctcttcagcttagagggtgcactcagacgacttctcgtgcgtgtgccacctcctcatgacgcgcatttgtttccccgaccactccttcgttatgctcactcatcaacctccgtctccatacacgtccgcacataccataacatctggatcgtcatgtattgccttgcgccatggtgtcaacctgcacactcgttgctgttcccttatt

SEQ ID NO: 53837 - protein, 41 aa, Zea mays
  misc_feature: Ceres CLONE 1476598-F
MMMLIHCSTCRNPLLLPRGAPCMPMRASVGLSRPIAPAPPV

SEQ ID NO: 53838 - DNA, 800 bp, Zea mays
  misc_feature: Ceres CLONE 1476598-R
  misc_feature: Encodes the peptide sequence at SEQ ID NO. 53839
gggaaaagattatttgcatagtcttccttattgtgattgtcattccccgatactgcttaaaatcagtgatggtagaaatgtacactcatgatcctttgataactcctaatgggtagggcatctacagctccatgaactcatcttatggagaagggcttcacatacacatcaaaaggctcacatgacgccccttgtggttcctgtctcctaccaccaacaaataagctccctccactaagaatcattgtaattaatgatgtaacatcaccgcctcctacacctgctgagtcatctgtgttgctcattgaccaacgcttgcaggtcaggatactaccgcacgtggagccctgtccacattccataggatgtatcaacccaaatgtcattgcaccagtcgaaatgaccttcgaacacccagaagtatctgcaccaggtctgatcatcatcacaaccaccaaaagaaatatcctccccaccactagtgcctttccagacaccccatggtggacggcgatcttcccctacatatagcccactcctgtgcattctgcagagggaatgcaaatcaagtgccattcccctatgactagcatccatgaatgcatggatcttaactccacgagaaactggtcgaacaactactgcatttaaggcagcatccacaatcattccttgtgtctcacaatcaaatgagcaaagggtttcatcgaacccatcaacctcatctccattgcagattctttgatgaggcccctgcccgagatactggaacaccgatcaatctactacatgacgaccaa

SEQ ID NO: 53839 - protein, 37 aa, Zea mays
  misc_feature: Ceres CLONE 1476598-R
EKIICIVFLIVIVIPRYCLKSVMVEMYTHDPLITPNG

SEQ ID NO: 53840 - DNA, 833 bp, Zea mays
  misc_feature: Ceres CLONE 1476598-R2
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
nnnnnnnccaattgggtcctccagcgtctcgtttttttttttttttttacctgtgagacaaacgacatatatgcatcgccttccttatatcggattgtaattccccgacactgttcacaatcaggatggtgaaatgtacactatgatccgttgtatcacttgaaatgggtgggcagtcatcagcaccatgaacgcatcttatggagaagggcttcacatacacatcaaatggctcacatgccgtcccttgtggctcctgtctcctaccaccaacaaataagctccctccagtaagaagcattgtcattaatgatgtaacatcaccgccacctacacctgctgagtcatctgtgttgcgtattgaccaacgcatggatttcatggatactaccgcacgtggtgccctgtccacgttcaatagcttgtatgaagccaaatgtcattgcaccagtcgaagagaccttcgaacaccttgagtatctgcacaggtctgatcatcatcagcacgactaaatgaccaatcctcgcacgactcgtgacgttctgacacacacggtggtcggggatcttcccctacctatagcccactcctgtcattctgttaaggtaggcaaaaccagggcatttcccttttgaaagggttaaagaatgttgaaaatttaactcccgggaaaaaggggccaaaaaccgggcgtttttaaagggccgccccaaaaaaattctttggggtcccaaagccaccggggggaaaggtttttcgaaaaccaaaaaaagctttggggaaatgggaattttttttgagaaaacccccgggcccaaaaaaaatggagagg

SEQ ID NO: 53841 - DNA, 653 bp, Zea mays
  misc_feature: Ceres CLONE 1476608-F
  misc_feature: Encodes the peptide sequence at SEQ ID NO. 53842
  misc_feature (518)..(518): n is a, c, t, g, unknown, or other
ggagctccccgcggtggcggccgctctagaactagtggatcccccgggctgcaggaattcgtctcacccctagaaaaaacgcacctcacctctcacaattccaagcccaccagtccaccactctccgcttcgcttcttgtcgctgcggcgcgcggccatggtctccctccgcttccctaccgctgcaatcccccgcctcccgccatcccaggcccccaacggcgtcgccatcgccgccacggtcgccgctgcagccgcggccgcagctgcagtagcggccagcttgaccctcacgggcaagtccaccggccggccagtcccgcaccctgcccctctctgggcctccctctccctggccgacgcggcggcccccagctccgtcgaaccccggaccggcgcgacattccccaccgaggccgacgatgggcgccgactactcggcatacgcctccggaatgacagcgtcctcgtgctcaagtatatcgacgtctacgcattcggcgtgtatgcgcatgacnacgattctgagcatcagctgaaggacatcactccaaagttctcgtctccgaactgaaagggaaacgagagctgatcgacgatgcgcctgaacggggactaccaatgacggacaggcctgaaattgatttacggaa

SEQ ID NO: 53842 - protein, 138 aa, Zea mays
  misc_feature: Ceres CLONE 1476608-F
  misc_feature (121)..(121): Xaa is any aa, unknown, or other
MVSLRFPTAAIPRLPPSQAPNGVAIAATVAAAAAAAAAVAASLTLTGKSTGRPVPHPAPLWASLSLADAAAPSSVEPRTGATFPTEADDGRRLLGIRLRNDSVLVLKYIDVYAFGVYAHDXDSEHQLKDITPKFSSPN

SEQ ID NO: 53843 - DNA, 645 bp, Zea mays
  misc_feature: Ceres CLONE 1476610-F
  misc_feature: Encodes the peptide sequence at SEQ ID NO. 53844
ctccccgcggtggcggccgctctagaactagtggatcccccgggctgcaggaattcgtctcacccctagaaaaattactctagggataacaggatgatcttccccaagagtccacatcgactggaaggtttggcacctcaatgtcggctcttcgccacctgtagctgtatgtggttccaagggttgggctgttcccccattaatgaggtacgtgagctgggttcagaacgtcgtgagacagttcggtccatatccggtgtgggcgttatagcattgataggacctttccctagtacgagaggaccgggaaggacgcacctctggtgtaccagttatcgtgcctacggtaaacgctgggtagccaagtgtggagaggataactgctgaaagcatataagtagtaagcccaccccaagatgagtgctctctcgtgcacgcactcccaatggcacccggcggcggcggcggcatcagagccccttcgccagacctcccagtcccagcccggcaaaagttcgcaaactcgacgagaagaccacgggcttattccgctgccagtgcgctaccgagactcccacggactcagtcgatcagacacgaaaccgtgatggtaatggtagcatgcacccgcggaagcgagcagca

SEQ ID NO: 53844 - protein, 66 aa, Zea mays
  misc_feature: Ceres CLONE 1476610-F
MAPGGGGGIRAPSPDLPVPARQKFANSTRRPRAYSAASALPRLPRTQSIRHETVMVMVACTRGSEQ

SEQ ID NO: 53845 - DNA, 695 bp, Zea mays
  misc_feature: Ceres CLONE 1476612-F
  misc_feature: Encodes the peptide sequence at SEQ ID NO. 53846
  misc_feature (370)..(370): n is a, c, t, g, unknown, or other
  misc_feature (463)..(463): n is a, c, t, g, unknown, or other
  misc_feature (471)..(471): n is a, c, t, g, unknown, or other
  misc_feature (473)..(473): n is a, c, t, g, unknown, or other
  misc_feature (474)..(474): n is a, c, t, g, unknown, or other
  misc_feature (485)..(485): n is a, c, t, g, unknown, or other
  misc_feature (583)..(583): n is a, c, t, g, unknown, or other
ctccccgcggtggcggccgctctagaactagtggatcccccgggctgcaggaattcgtctcacccctagaaaaattccggccctctcgcccgtccgtctcctgcccccgtccctggtcggaccacgagagccccggactgcgttcacctctgccttttgttcacccctcttgtctcgtgcgtgcgacaacaactgggcgaccgccgccgccgccctacgccaggtgcgcaggtcttcgtcggatccttcgccggcgaggcgacgagcacccaccaggtgatgcccccggcttaattgaatgggctctcttctcaccaggactggcatcctgccatggctccaggccaagatcgttgatcccgtgctgcangtcatcagaaggggagcagaaccccagcaactggccttctctgctgcccctcgtgtcacgattgggatctttccgatatgtgggaccactggntatctggntnngctgtgtgtancaatggtggggaaagtcgtgcaatgctggtacccttatgggttctaatttgggcccgccttccaattgaactaagccttgatcggccctttccttgcnttggggtgaaaccgtcactggcaacggggcacttccccttgaaagcccgacccttttgaaaaatggttctccccggtcatgccccaaaagggtttggcatagggaacattcc

SEQ ID NO: 53846 - protein, 77 aa, Zea mays
  misc_feature: Ceres CLONE 1476612-F
  misc_feature (24)..(24): Xaa is any aa, unknown, or other
  misc_feature (58)..(58): Xaa is any aa, unknown, or other
  misc_feature (59)..(59): Xaa is any aa, unknown, or other
  misc_feature (63)..(63): Xaa is any aa, unknown, or other
MGSLLTRTGILPWLQAKIVDPVLXVIRRGAEPQQLAFSAAPRVTIGIFPICGTTGYLXXLCVXMVGKVVQCWYPYGF

SEQ ID NO: 53847 - DNA, 683 bp, Zea mays
  misc_feature: Ceres CLONE 1476613-F
  misc_feature: Encodes the peptide sequence at SEQ ID NO. 53848
  misc_feature (483)..(483): n is a, c, t, g, unknown, or other
ctggagctccccgcggtggcggccgctctagaactagtggatcccccgggctgcaggaattcgtctcacccctagaaaaatctcaaacctgtgcgtctgcccctttccagctttcctctcaaacggagagatgtactcggatcagatctccaccgggcgcaagcgctccatccatgaccgccttgacggcgacctccctgccggcacgggcgccggcggctgtgtccgtcacacggtgtccaagaggcaacgacagatagatgaaaaatggaagcatgatctgtatcgggaagatgatgaaccagcttcaaaatcaacagatccgaaggatttgcgattgaagcttcagaggcgaagttttcaacaagattttaccagcacaagaagttctggtgtgcgtgatctacgtgagaagctatctggtataatgaacccacagccatcaaatgctgacccaccaaagccaaagccaaagccagtatncggaggttgttaacatctcaaggcgtcaaattgctgatgaaatgcatgcacgccaaaataagaaaccaccaaagcagacttcatcgaagaaggcatctcagcccagaccagagcaggaaagtatcctattgcaggcacaacaacaggtgcagttgcagaaacttgtgtatcaagttggagcgcttccctacaaaggtgta

SEQ ID NO: 53848 - protein, 121 aa, Zea mays
  misc_feature: Ceres CLONE 1476613-F
  misc_feature (118)..(118): Xaa is any aa, unknown, or other
MYSDQISTGRKRSIHDRLDGDLPAGTGAGGCVRHTVSKRQRQIDEKWKHDLYREDDEPASKSTDPKDLRLKLQRRSFQQDFTSTRSSGVRDLREKLSGIMNPQPSNADPPKPKPKPVXGGC

SEQ ID NO: 53849 - DNA, 615 bp, Zea mays
  misc_feature: Ceres CLONE 1476619-F
  misc_feature: Translation starting site: 157
  misc_feature: Pfam Name: DUF829 Pfam Description: Eukaryotic protein of unknown function (DUF829)
  misc_feature (405)..(405): n is a, c, t, g, unknown, or other
  misc_feature (501)..(501): n is a, c, t, g, unknown, or other
  misc_feature (543)..(543): n is a, c, t, g, unknown, or other
  misc_feature (558)..(558): n is a, c, t, g, unknown, or other
ctggagctccccgcggtggcggccgctctagaactagtggatcccccgggctgcaggaattcgtctcacccctagaaaaacttccctcccaattcaaggcggtccggaagctcctgcagccttccggaagggcttcgaggccgaggcgggcacgggatgtgggggcggcactactggggcggcggccggcgcccaagctgggcgcccggaggggacggagccggcaccggcggcgtggtggtgatgttcgcgtggctgtccagccaggagcggcacgtgcgggcgtacgtggagctgtacgcggcgcacgggtgggcgtgcctcgtctgccactccgacttcctcaccctgtttttccctgagaaggctgccatgctcgccgacagggtgattggggagcttgtncaggtgctgaagatacacctgtacctggtgtgtttgcgtcgttttcgggagggccaaaagggtgcacatacaaggttcttcagctgatcgagaggngatgtgaagggccactaagcatggatgagtaccagctcgtancagattgtctatgcngacaaatggatgattccaagccctgtggattttgtcagtggactggggcactcgctt

SEQ ID NO: 53850 - DNA, 661 bp, Zea mays
  misc_feature: Ceres CLONE 1476621-F
  misc_feature: Encodes the peptide sequence at SEQ ID NO. 53851
  misc_feature (357)..(357): n is a, c, t, g, unknown, or other
  misc_feature (397)..(397): n is a, c, t, g, unknown, or other
  misc_feature (405)..(405): n is a, c, t, g, unknown, or other
  misc_feature (411)..(411): n is a, c, t, g, unknown, or other
  misc_feature (421)..(421): n is a, c, t, g, unknown, or other
  misc_feature (498)..(498): n is a, c, t, g, unknown, or other
  misc_feature (506)..(506): n is a, c, t, g, unknown, or other
aagctggagctccccgcggtggcggccgctctagaactagtggatcccccgggctgcaggaattcgtctcacccctagaaaaactctcgcgccgccgcggaacacaacaccgcaccacactacccagcggaatccgcccacccgcacccgcacccggagcagaggagatatgtcgcaggggaagggaggagcggcgaggaaggaggaggtggtcaccagggagtacaccatcaacctccacaagcgcctccacggctgcacattcaagaagaaggcacccaacgccatcaaggagatcaggaagtttgcgcagaaggccatgggcaccacggacattaggatcgatgtgaagctcancaagcacatctggagcagcgggatcaggagcgtgccgcgnagggttcntgtgangatcgccccncaagaggacgacgagggagatgccaaggagagctctactcccttgtcaccgtcgcagagatccccgccgagggcttngaagggcntggggacaaaggtcgttgaccaaaccgattaggctgtcgcgttatctacatctttagagagttcctagtttgtatttgcaacagcaaaacctttttgtatcccaaagttgtctatttccccaaccgaattggcatggctagttttctttttcaaa

SEQ ID NO: 53851 - protein, 122 aa, Zea mays
  misc_feature: Ceres CLONE 1476621-F
  misc_feature (10)..(104): Pfam Name: Ribosomal_L31e Pfam Description: Ribosomal protein L31e
  misc_feature (63)..(63): Xaa is any aa, unknown, or other
  misc_feature (79)..(79): Xaa is any aa, unknown, or other
  misc_feature (81)..(81): Xaa is any aa, unknown, or other
  misc_feature (110)..(110): Xaa is any aa, unknown, or other
  misc_feature (113)..(113): Xaa is any aa, unknown, or other
MSQGKGGAARKEEVVTREYTINLHKRLHGCTFKKKAPNAIKEIRKFAQKAMGTTDIRIDVKLXKHIWSSGIRSVPRRVXVXIAPQEDDEGDAKESSTPLSPSQRSPPRAXKGXGTKVVDQTD

SEQ ID NO: 53852 - DNA, 661 bp, Zea mays
  misc_feature: Ceres CLONE 1476622-F
  misc_feature: Encodes the peptide sequence at SEQ ID NO. 53853
  misc_feature (300)..(300): n is a, c, t, g, unknown, or other
  misc_feature (343)..(343): n is a, c, t, g, unknown, or other
  misc_feature (381)..(381): n is a, c, t, g, unknown, or other
aaagctggagctccccgcggtggcggccgctctagaactagtggatcccccgggctgcaggaattcgtctcacccctagaaaaaagctaacgacctgcagccaaccatctaccagcgactcagcgagcgagagcagcacacactgcacgcagctagctaggagcagcagcagcggcggcgatggcggcctccatgatctcctcgtcagctctggcggtggcgcctcatggcctgccgcccctcggccgccgcgcctcctccttcgccgtcgtctgctccaagaagaagatcaagaccgancagccctacgggattgggggtggcctgaccgtcgacgtctacncctacgggagaaagggcaaggggcagggcatgtaccanctcgtcgactagtacggctcgcacttcaacagatacagcccatttctacacgaggatgactggtctcccacgggcgacgtctacgtcggtggaaccactgggcttctgatctgggccgtcaccctcgctgggatcctcgggggcggcgccctcctcgtctactacaccggcgccctctccggctaaggatatccaatgcatgcgcttcttggggattcgtcatgtaaaatcagggtggctggtcttaaatctgccctccatggatgctcaacccttcggg

SEQ ID NO: 53853 - protein, 70 aa, Zea mays
  misc_feature: Ceres CLONE 1476622-F
  misc_feature (40)..(40): Xaa is any aa, unknown, or other
  misc_feature (55)..(55): Xaa is any aa, unknown, or other
  misc_feature (67)..(67): Xaa is any aa, unknown, or other
MAASMISSSALAVAPHGLPPLGRRASSFAVVCSKKKIKTXQPYGIGGGLTVDVYXYGRKGKGQGMYXLVD

SEQ ID NO: 53854 - DNA, 627 bp, Zea mays
  misc_feature: Ceres CLONE 1476626-F
  misc_feature: Encodes the peptide sequence at SEQ ID NO. 53855
  misc_feature (398)..(398): n is a, c, t, g, unknown, or other
tggagctccccgcggtggcggccgctctagaactagtggatcccccgggctgcaggaattcgtctcacccctagaaaaatcaaatttcttgaagatatgtagctgctccatcttctaacaccttctcttggtgtattgtctgcaaaagcaagagaatatcagtgtacagattgattgttagtgcttgtgaagtcctgttagcgtcacagataaacaaatgtcaggggcatgtgcaccaaataacaaaaaaaacgagacgctcgaggtacccaattcgccctatagtgagtcgtattacgcgcgctcactggccgtcgttttaaacgtcctgactgggagaacccctgcgttcccaacttagtcgccttgcagcacatccccctttcgcagctggagtntagcgaagaggccgcacgatcgcccttccaagagttgacaacctgaatgcggatggaattcgtagcgttattatttggttaaattcgcgtgaaatttttgttaatcacctcattttttaaaccataggccgaaatcggcaaaatccttttaaatcaaaaaatcaaccgatatagggttgagtgttcttcccatttggaacaaaagtcccttattaaggaacggggactc

SEQ ID NO: 53855 - protein, 38 aa, Zea mays
  misc_feature: Ceres CLONE 1476626-F
GAPRGGGRSRTSGSPGLQEFVSPLEKSNFLKICSCSIF

SEQ ID NO: 53856 - DNA, 651 bp, Zea mays
  misc_feature: Ceres CLONE 1476629-F
  misc_feature: Translation starting site: 237
  misc_feature: SWISSPROT Homolog: EC 3.2.1.23 Beta-galactosidase
  misc_feature (545)..(545): n is a, c, t, g, unknown, or other
aagctggagctccccgcggtggcggccgctctagaactagtggatcccccgggctgcaggaattcgtctcacccctagaaaaaatccaggcaccacagctccctccccactcgagggtccgagctttattttttcttgttttgtttcgttttcttggagaggagtcaccatatcttcttggcggcttcttcctcctcgctctctaccctactagagaggagacgatataaatccggatgcatcgcttcagggtttgtataaagggattctctatctgttccactatccccatagaaagagaagtattacgcgagccgctcggggtaccctattcgccctatagagagtcgtattactcgcgctcactggcttactttttacaacgtcgagactggtaacaccctgtggttactaacttagacgccttgacgatatccccttttcgccagttggcataataaagaagaggcccgcaccgatcgcccttacctactgttgcacatcctgaatgattaatggaaattgaaatcgttaatattacgatnaagtccacgtcagcatgttcgttatatcaactcatttatttacccaataggccggaagactgcaacatcccctatgaatccagaggactaccactgaagtaggggt

SEQ ID NO: 53857 - DNA, 664 bp, Zea mays
  misc_feature: Ceres CLONE 1476632-F
  misc_feature (381)..(381): n is a, c, t, g, unknown, or other
aagctggagctccccgcggtggcggccgctctagaactagtggatcccccgggctgcaggaattcgtctcacccctagaaaaagcgacccccaggtcagtcgggactacccgctgagtttaagcatataaataagcggaggagaagaaacttacgagggatttcccctagtaacggcgagcgaaccggggagcagcccagcttgagaatcgggcgggcctcgccgcccgaattgtagtctggagaggcgtcctcagcgacggaccgggccccaagttctctggaaagggacgcctgggagggtgagagccccgtccggcccggaccctgtcgcacccacgagcgccgtcaacgagtcggggttgtttggaaatgcaccccnatcgggcgggaaactccgtcaaaggctaaaaaaaaaaaaaaacgagacgctcgaggtacccaattcgccctatagtgagtcgtattacgcgcgctcactgggcgttcgttttaacacgtcgtgactgggaaaaaccctggggtaacccactttaatcggctttgcacacatccccccttccgcagggtggggtaatagcggaagaggcccgaaacgattcccccttcccaaaagtttccccaccctggatgggaaatggaaattggaaccctttaattttttg

SEQ ID NO: 53858 - DNA, 673 bp, Zea mays
  misc_feature: Ceres CLONE 1476636-F
  misc_feature: Encodes the peptide sequence at SEQ ID NO. 53859
  misc_feature (297)..(297): n is a, c, t, g, unknown, or other
  misc_feature (370)..(370): n is a, c, t, g, unknown, or other
  misc_feature (411)..(411): n is a, c, t, g, unknown, or other
  misc_feature (514)..(514): n is a, c, t, g, unknown, or other
aagctggagctccccgcggtggcggccgctctagaactagtggatcccccgggctgcaggaattcgtctcacccctagaaaacgactatgaccgccttaaggctgcttacgacgcattcgcccgccgaccaccaggccctcctggccgacaacgataacctccgggcacaggtgttctccctgacggagaagctgcaaggcaaggagacatccccgtcggcaaccactgctgcccaagaggtcgaccagccagacaaacacaccgctgtgtcaggcacggaagaactgctggcgcancagctcaaggacaacctccacagcagcggcgactgcactggccatggcaccctctcttcggaagaagacgacngtggcttggtcagtgacgagggctgcaccttcgctctcccngatgccatgttcgctgccgggttcacccaccatggcgccgaggagtgcaccttgccaactggacatccttgttctggaactgatcaccgaatggatgcatccnagtgcaaagatcggattcctctcctcgcctcaccccttttctgcacattataattaccgtgtttattattgtgccccccgaatttttttaagggctcatgttttaaagtttggtgtttttttgaagaattttttattgtccataataaaagaaaaatgg

SEQ ID NO: 53859 - protein, 159 aa, Zea mays
  misc_feature: Ceres CLONE 1476636-F
  misc_feature (70)..(70): Xaa is any aa, unknown, or other
  misc_feature (95)..(95): Xaa is any aa, unknown, or other
  misc_feature (143)..(143): Xaa is any aa, unknown, or other
MTALRLLTTHSPADHQALLADNDNLRAQVFSLTEKLQGKETSPSATTAAQEVDQPDKHTAVSGTEELLAXQLKDNLHSSGDCTGHGTLSSEEDDXGLVSDEGCTFALPDAMFAAGFTHHGAEECTLPTGHPCSGTDHRMDASXCKDRIPLLASPLFCTL

SEQ ID NO: 53860 - DNA, 649 bp, Zea mays
  misc_feature: Ceres CLONE 1476638-F
  misc_feature: Encodes the peptide sequence at SEQ ID NO. 53861
  misc_feature (85)..(85): n is a, c, t, g, unknown, or other
  misc_feature (486)..(486): n is a, c, t, g, unknown, or other
tggagctccccgcggtggcggccgctctagaactagtggatcccccgggctgcaggaattcgtctcacccctagaaaaactcggntccactctccgcttcccgctccgatcgacctgctccctcccctcgccgccgtgtgtgggctggatggcctgctttcttgtgctcctcatatatatgagatgtactccctctaaggagcagggtttcattactttttcgtactcgctacagttacagctggtacgtactatactaataaaagctgcagtttctccaaaaaacaaaaaatgacgagacggctcgaggtaccaagttcgccctatagtgagtctcattacgcgcgctcactggacgtcgttttaaaacgtgatgactgggaaaaccctgagcttaccagctttaatcgcgttgtagacatccccctttcggctgctggcgtatagcgagaaggcccgcacgttcgcctttcccacagatgcgantcgtggatggggaatgggaattgtaccggttaatattttgttaaaatcgcggtaaaatttttgtaaatcggttcatttttttaaccagtgggccgaactccgaaaatccccttatatcaaaaaaatatcccgagatggggtttgattgttcttccatttggaa

SEQ ID NO: 53861 - protein, 48 aa, Zea mays
  misc_feature: Ceres CLONE 1476638-F
MACFLVLLIYMRCTPSKEQGFITFSYSLQLQLVRTILIKAAVSPKNKK

SEQ ID NO: 53862 - DNA, 672 bp, Zea mays
  misc_feature: Ceres CLONE 1476647-F
  misc_feature: Translation starting site: 112
  misc_feature: SWISSPROT Homolog: EC 5.2.1.8 Peptidylprolyl isomerase
agctggagctccccgcggtggcggccgctctagaactagtggatcccccgggctgcaggattcgtctcacccctagaaaaataatccgatcgaccttgcgcagttgctccgatgggcaaggactcgaagccgaaggacgccaaggggaagggcaagcaggcggccggctcctctggcggcgacaacggcggcgggcagggaggcaagggcaagggcaagggcaagggcggcaagtccgctgacggactcggcacttgcacctacgtcaaagctaggcacgtattgtgtgagaagcaggggaaagatcaatgaagcttataaaaagttgcaggatggatggctgaataatggggacaaagtccctcctgctgagtttgctaaggtagcacaagagtattctgaatgcccatcagggaagaaaagtggagatcttggttggttcccgcgtggcaggatgctggtcctttccaggaggtgctttcacacacctgagggaactgttagcgcaccattcaagtccacgcacgggttatcacttttatcctctgccgagggaaggaagaactgatctgggaaatgcccgtttggggagactgcatcactccggtttgtataaaaacccaattgcaactacttcccctttctctattaaacccctggaaaattgtgtat

SEQ ID NO: 53863 - DNA, 647 bp, Zea mays
  misc_feature: Ceres CLONE 1476649-F
  misc_feature: Encodes the peptide sequence at SEQ ID NO. 53864
  misc_feature (288)..(288): n is a, c, t, g, unknown, or other
  misc_feature (358)..(358): n is a, c, t, g, unknown, or other
  misc_feature (379)..(379): n is a, c, t, g, unknown, or other
  misc_feature (403)..(403): n is a, c, t, g, unknown, or other
ggagctccccgcggtggcggccgctctagaactagtggatcccccgggctgcaggaattcgtctcacccctagaaaaatccccaaggttgaccggcgaaatcagcagtccgagaaccgcgagcttctgcctgatccactgatccagcctcatcccgccatggacgaatctgaggagcacagcaacggcggcgggcacccccacccgcaccacgggtacgagtggaagttcccggcggcgctgagcgcgaacacgacgagtgtgcacgtgacggcgctggacggcgtgntgaacgtgaactcgctgttcacggtggccgtgttcgtggggctgtcgctggcgaccccggggcagctgcngagcctggcgggggacccgcngtgcgacgccggccccggcgtggncgcgtccctgctggtgctggaggtgggggccttctcgtccttcctctttctccagctgggtggcgcagggcctgaagctggcgctcaacctcatcaaactccaggacccgcacgacgcggcgcgcgcccacatcgacgcccgcgtgctccgcctcggcatgctcgcctccgccgtcggatccgtcgtcgggtgcttcttcctcatgacgtcatggtcatggtcgtgcaagtccccctcggccgc

SEQ ID NO: 53864 - protein, 163 aa, Zea mays
  misc_feature: Ceres CLONE 1476649-F
  misc_feature (44)..(44): Xaa is any aa, unknown, or other
  misc_feature (67)..(67): Xaa is any aa, unknown, or other
  misc_feature (74)..(74): Xaa is any aa, unknown, or other
  misc_feature (82)..(82): Xaa is any aa, unknown, or other
MDESEEHSNGGGHPHPHHGYEWKFPAALSANTTSVHVTALDGVXNVNSLFTVAVFVGLSLATPGQLXSLAGDPXCDAGPGVXASLLVLEVGAFSSFLFLQLGGAGPEAGAQPHQTPGPARRGARPHRRPRAPPRHARLRRRIRRRVLLPHDVMVMVVQVPLGR

SEQ ID NO: 53865 - DNA, 699 bp, Zea mays
  misc_feature: Ceres CLONE 1476651-F
  misc_feature (419)..(419): n is a, c, t, g, unknown, or other
  misc_feature (646)..(646): n is a, c, t, g, unknown, or other
ggagctccccgcggtggcggccgctctagaactagtggatcccccgggctgcaggaattcgtctcacccctagaaaaacatcctactgtcacacacacacagagagagacaagtggtttccaaagccaagtgtgtactagcagtctagcaaccagctagctcgggcggcagcaggcagccatcatgtcggaggagaacaccaccacttcttcaccaccacaagaaggacgaggagcaccccgccggcgagtacgggtactccgagaccgaggtggtcaccgccaccggcgagggcgagtacgagaggtacaagaaggaggagaaggagcacaagcacaagcagcacctcggcgaggccggcgccatcgccgccgggcgccttcgcactctacgagaaacacgaggcgaagaagcccccnagcacgcgcacaggcacaagatcacggaggaggtcgctgccgcggcggccgtccggcccggcggctactttttccccaacccccccgagaaagaaaaggaccacaagggaccccgaagaaggctagccggcaaaaaaaaacccccacccaccttcttccgggttgaccgttattaaccgggcccggggcggcgaccaaaacttaacttaggcctccgggggccaaanaaaccccccaccgctgtggttttaatttcctcgaactggcattggccttggtt

SEQ ID NO: 53866 - DNA, 645 bp, Zea mays
  misc_feature: Ceres CLONE 1476659-F
  misc_feature: Encodes the peptide sequence at SEQ ID NO. 53867
ccccgcggtggcggccgctctagaactagtggatcccccgggctgcaggaattcgtctcacccctagaaaaatccatcaatcctcatcgccacccaacccgccgagtccccaagcaagttgagcatccatccatccatggcgggaggcaagtccaccggcaatgccgcgcgcagcacgaatcgcgtcgaggcaaccgtcctcaagcgctccagggacgggagcgccttcaccatatgcgatgcctgcaacaaggacgtccccgtcgtcctcatcgacatgcacagctgcagcctctacgagaagatcaggatgacgctcgaggcgcaggtcgacgagaagaccgtcgaggtcgccagtgcggaccgcaagaagtcctccgccaagggaggtggtaacaaggacgccaagcgcaagcgctcgcccaccgccttcttcctcttcatggacgacttcaggaaggagttcaaggccacccatcctgacaacaagagtgtctctaccgttgcaaaggaaggaggcgagagctggaagtccatgacagacgaggagcataagccttaccttgaataggccgcgtagctcatggctgaggccgagaatgactacggcagtggtcataacaatgttgccactaagaaagccag

SEQ ID NO: 53867 - protein, 144 aa, Zea mays
  misc_feature: Ceres CLONE 1476659-F
  misc_feature (93)..(144): Pfam Name: HMG_box Pfam Description: HMG (high mobility group) box
MAGGKSTGNAARSTNRVEATVLKRSRDGSAFTICDACNKDVPVVLIDMHSCSLYEKIRMTLEAQVDEKTVEVASADRKKSSAKGGGNKDAKRKRSPTAFFLFMDDFRKEFKATHPDNKSVSTVAKEGGESWKSMTDEEHKPYLE

SEQ ID NO: 53868 - DNA, 693 bp, Zea mays
  misc_feature: Ceres CLONE 1476661-F
  misc_feature: Encodes the peptide sequence at SEQ ID NO. 53869
  misc_feature (371)..(371): n is a, c, t, g, unknown, or other
gctctagaactagtggatcccccgggctgcaggaattcgtctcacccctagaaaaaacgagcacacgcgacgactgacaaggcgaggggagcaatcggcggctatgggcggcggcggcgcacatggcggcaccacctacaagggctacaccatcccgcacaacaagcgctggcacaccgtcgccggcaagggcctctgcgccgtgatgtggttctgggttttctacagggctaagcaggatggtgctacgctcttgggtttgcgtcatcctttgggaggaacatgatgaccactctcatggccatggacacggggcatgaggcatcatcatcgtcctcttcaccttaagttcgtttattgggctgcaaacnaatgttcggcattgttccaaacaaccaaagcctcaagtaaaaaaaattctatcccccctgaatggggactcatgttgttttgccaaatgggttaaacaacaaacctggtccttggtaacctattggcgcccaatggtattttgaatatcaaaatttcccaattaaacaggcccggggaaaaaaaaaccccggggggcctgttggaaaaaaaaaaaaaaaaaaaacccgaaaactctttcgagggtaaccccaattccccccccttttttggggaactcctattttcccccgcgcccctccaacggggccccctcctttttta

SEQ ID NO: 53869 - protein, 60 aa, Zea mays
  misc_feature: Ceres CLONE 1476661-F
MGGGGAHGGTTYKGYTIPHNKRWHTVAGKGLCAVMWFWVFYRAKQDGATLLGLRHPLGGT

SEQ ID NO: 53870 - DNA, 667 bp, Zea mays
  misc_feature: Ceres CLONE 1476664-F
  misc_feature (436)..(436): n is a, c, t, g, unknown, or other
ggagctccccgcggtggcggccgctctagaactagtggatcccccgggctgcaggaattcgtctcacccctagaaaaaaaattaggtagcatgtgaatgattcattctttcagttgcaggttcccaccaaatgtccatatttccattagttttggttgtatagttgcaccgattcctgattttggagtgtaaagtttgtataacctagtgttatctgttatgcaccagttatatgctgagtgccatgttttttgcggtttgctactgtatcacagcgagccgacattttacaacagttatatgtaatgttctgtagtgatacaatagtgcctattctgggtgatatgtatttttttccctgtaggaaatttgctgctgtcgagggcatcctcgcaatttgtttatgcacgatttgaagcctttgtgtatggaatcnttccccaaaaaaaaaaaaaaacgagacgctcgaggtacccaattccgccctatatggagtcgtattacccccggctcctgggccggcctttttacaacccccggacttggaaaaaacttggcgttaccccaatttaaatggcgtgggagaaaattcccctttcccccgggtggggtaaaaacaaaaaaaggccgacccaaatcccttccccaaaagttgggcaccccggat

SEQ ID NO: 53871 - DNA, 729 bp, Zea mays
  misc_feature: Ceres CLONE 1476667-F
  misc_feature: Encodes the peptide sequence at SEQ ID NO. 53872
  misc_feature (79)..(79): n is a, c, t, g, unknown, or other
tcttaacttgtggatcccccgggctgcaggaattcgtctcacccctagaaaaccactaggctaggttagccttttaatncgtctcaagaagcaagaagggcgcgcacgcaagcaggcaagcaagaagagagccgatcgaccgagagctagcacgcgatggcgaggtcttccaagatgatggtggcggcagctctgctggccttggccctgggcgtgtcgaccgccgaggcgaggaacatcaagaccacgactacggataaaaaggacgacgcggtggtgcagcccgaagaccttcccgccccttcaaccggccttcggggggcgggggcttccccgggggttcgggcgggcctccccgggaggcagcatttccctgggcaccaacatttcccggggttccacccccccccgggccccccggcaggggccctacccccggggttcaatctttgccccggaaggggggcgagcattgccccctttcttcggggggggggctccccccggggcttccagcgggttttcgggggggattgccccgggttccccccaaccggcccgggcttccggtcccccaaaaaaccgccaaacaaagccccttggaaccgcccaccaaagcggtgggcaagtagagaggcggcccctcccgggttcccgtggaaaacccccacctgcgtgttctattgccaacccccggggtgtcgggagggttctccccctaaggccccg

SEQ ID NO: 53872 - protein, 191 aa, Zea mays
  misc_feature: Ceres CLONE 1476667-F
MARSSKMMVAAALLALALGVSTAEARNIKTTTTDKKDDAVVQPEDLPAPSTGLRGAGASPGVRAGLPGRQHFPGHQHFPGFHPPPGPPAGALPPGFNLCPGRGASIAPFLRGGGSPRGFQRVFGGDCPGFPPTGPGFRSPKKPPNKAPWNRPPKRWASREAAPPGFPWKTPTCVFYCQPPGCREGSPPKAP

SEQ ID NO: 53873 - DNA, 643 bp, Zea mays
  misc_feature: Ceres CLONE 1476671-F
  misc_feature: Encodes the peptide sequence at SEQ ID NO. 53874
  misc_feature (431)..(431): n is a, c, t, g, unknown, or other
tccccgcggtggcggccgctctagaactagtggatcccccgggctgcaggaattcgtctcacccctagaaaagttccccacccatatcgtgaacccgccgccgactcagcagcaggagacgcgccaaggagagcccgcaaggaggcgactatgagggccaagtggaagaagaagcgcatgaggaggctgaagaggaagcgccgaaagatgaggcatagatccaagtacgctgatggggattgtggatggtggtgacgacatggttgtgttacgattcttcgatgcgtgtgagttcatggagagatgtcacatcctagttcgtcgtcaccgtttgccatgtgtccaatagctcgtcttggaaacctgcacttcagtagggcatctatcgtggtttctagctatatccagagttttgtgctaagacaaatcantcagtccgttttggtgacctactatgatggagctttatttgctgctaatatccgactacctattaagtgaaaaaaaaaaaaaaaacgagacgctcgaggtacccaattcgccctatagggagtcgtattacgcgcgctcactggccgtcgttttcaacgtcgtgactgggaaaacctggggttccccacttaatcggcttggcacactcccc

SEQ ID NO: 53874 - protein, 65 aa, Zea mays
  misc_feature: Ceres CLONE 1476671-F
  misc_feature (43)..(43): Xaa is any aa, unknown, or other
MSHPSSSSPFAMCPIARLGNLHFSRASIVVSSYIQSFVLRQIXQSVLVTYYDGALFAANIRLPIK

SEQ ID NO: 53875 - DNA, 646 bp, Zea mays
  misc_feature: Ceres CLONE 1476675-F
ggagctccccgcggtggcggccgctctagaatagtggatcccccgggctgcaggaattcgtctcacccctagaaaaatcttgggcggcaaccttcctcgagcccgagcaagcaatggttgatgctcagctttcggcggagcggagatgcacgagaacattcgagcatccggcactcgcaaggatgaaatgctgtcacgctagtactccatctacctccacaaacgcctccacggatgcaccttcaagaagaaggcaccaaatgccgtcaccgtagatcacgacgttcgctttgacggtcatgtctactactgatgtccggattgacgtggagctcactagcacatctggtactgtagcatccgctgtgtgtcgaggcgtgtctgtgtcagatttgcccgcaacccgaacgatgaggatgacgcgaggacgtactctactccctggtcacagtagctgacatccagctggtagcttctcacgtttgggaactaaggttgctcacgatgatgattaagccctgtatcccatgaccataatttgagaatgttgcttcagcttattgttatctactgcccatgactcatgtaataaattcttcgagacttgtctcctttcaagtgcttcgtcaaggccaatatctgcctg

SEQ ID NO: 53876 - DNA, 640 bp, Zea mays
  misc_feature: Ceres CLONE 1476677-F
  misc_feature: Encodes the peptide sequence at SEQ ID NO. 53877
  misc_feature (220)..(220): n is a, c, t, g, unknown, or other
  misc_feature (234)..(234): n is a, c, t, g, unknown, or other
  misc_feature (522)..(522): n is a, c, t, g, unknown, or other
  misc_feature (578)..(578): n is a, c, t, g, unknown, or other
tccccgcggtggcggccgctctagaactagtggatcccccgggctgcaggaattcgtctcacccctagaaaaaatcactctcatcaccagctaagaacagggcttcgtctcaatggaaggcaaaacagggcagctcaggtgctgtttcgtctccatcgtgctcgtcctgggtcttgtccttgagtcccccaggctgacgctgggagcaaatgctgctgcntaactgccaccggnaataccattattatcgctgcgttgactctggtttgctcgacgatattgtgctctgtgctggctatgccggctccttcattatcgaagacagatgatgaggccgttggccggtgcctgctcctgatgctcgttgcctggatgtcatttgattattatgagccagtacgtgaataacgagggtcagacgactgtcgaccagcgattggttatttgtgaacttggcgcttggcttcttattgcaactttcaataagccccttcgtgaatgtcatccccttcaagtctgtcnactgttacgtatacacatctatatatcaaataaagaccgcgacgtacgtgtggtanaaaaaaataaacgcctccggggaattaaaaaataaaggggggcatgttgaatggatgaaaaa

SEQ ID NO: 53877 - protein, 36 aa, Zea mays
  misc_feature: Ceres CLONE 1476677-F
MEGKTGQLRCCFVSIVLVLGLVLESPRLTLGANAAA

SEQ ID NO: 53878 - DNA, 648 bp, Zea mays
  misc_feature: Ceres CLONE 1476678-F
  misc_feature: Encodes the peptide sequence at SEQ ID NO. 53879
tccccgcggtggcggccgctctagaactagtggatcccccgggctgcaggaattcgtctcacccctagaaaaatcgataaccaagaacaaaccattgttggacgcgttcccctcctgcacgcaacctcatctcgtcctccagatcctggatggccgtcctccttgataccttgcctcgcgagtgctctcggtgagctactttgttttgatttatcagggaatccgtttgcttcatgttatgcaggctcagatctgattgctggattcggcatcttacgggcttgaatagagctaggactgggagaaaaacacaaacccgcgttggatcctgtatcgatctggagaaatttctaagtcgtcgtcgtcgtcgtccttcggttcggagcggatctgaggcgaccatggctgggaggcggcggatctctgggtctgcagtcctgcttcacctcgatggatgatgtctctgccctgataattattggatcaatttcgataattattagtagatctatgagatatgccccctgggaagaagcgaaggtaacctgcaccatgtaaaagtctgcttgccgtcaaccggcaaaaaggagaaaaaaaggatgtgacattcctagaggagggcttttgccatggagggtgcccctccca

SEQ ID NO: 53879 - protein, 74 aa, Zea mays
  misc_feature: Ceres CLONE 1476678-F
MLCRLRSDCWIRHLTGLNRARTGRKTQTRVGSCIDLEKFLSRRRRRPSVRSGSEATMAGRRRISGSAVLLHLDG

SEQ ID NO: 53880 - DNA, 658 bp, Zea mays
  misc_feature: Ceres CLONE 1476680-F
  misc_feature: Encodes the peptide sequence at SEQ ID NO. 53881
  misc_feature (474)..(474): n is a, c, t, g, unknown, or other
  misc_feature (507)..(507): n is a, c, t, g, unknown, or other
  misc_feature (528)..(528): n is a, c, t, g, unknown, or other
  misc_feature (626)..(626): n is a, c, t, g, unknown, or other
ggagctccccgcggtggcggccgctctagaactagtggatcccccgggctgcaggaattcgtctcacccctagaaaaaagggttcagtgaagtgtagtgcagccaaggcagcagagcgtgaggtgcactaccaggcaacaaggaaaaaaatggagctccaggcaaggtgcgtctgcgtcgtcgcgatgctcctggtggccagcttcgcggggctggatacggcgcacggcgcgggagagtgcggccgcgtcccggtggaccaggtggcgctcaagcttgctccgtgcgcggcggccacgcagaacccgcgcgccgcggtgccgccgagctgctgcgcgcaggtgcgcgccatcgggcgcgtccccaagtgcctgtgcgccgtcatgctgtccgacaccgcgcggaaggccggcgtcaagcctgccgtggccatgaccatccccaagcgctgcgccatcgccaaccgccccgtcngctacaagtgcggcccatataccctgccatgangtgatcatgaagaagcaagtngatgcgggcagtgttgtggcagtggcacctgaaggactccaaactctgactgccaatatgccgtgacctctgtcgcatcttactttcccaagatcccngagataaatgtgctgtaataaatgcctcactt

SEQ ID NO: 53881 - protein, 118 aa, Zea mays
  misc_feature: Ceres CLONE 1476680-F
  misc_feature (31)..(112): Pfam Name: Tryp_alpha_amyl Pfam Description: Protease inhibitor/seed storage/LTP family
  misc_feature (109)..(109): Xaa is any aa, unknown, or other
MELQARCVCVVAMLLVASFAGLDTAHGAGECGRVPVDQVALKLAPCAAATQNPRAAVPPSCCAQVRAIGRVPKCLCAVMLSDTARKAGVKPAVAMTIPKRCAIANRPVXYKCGPYTLP

SEQ ID NO: 53882 - DNA, 762 bp, Zea mays
  misc_feature: Ceres CLONE 1476685-F
  misc_feature (221)..(221): n is a, c, t, g, unknown, or other
  misc_feature (276)..(276): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (457)..(457): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (507)..(507): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (553)..(553): n is a, c, t, g, unknown, or other
  misc_feature (554)..(554): n is a, c, t, g, unknown, or other
  misc_feature (587)..(587): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (649)..(649): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (694)..(694): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
ggagctccccgcggtggcggccgctctagaactagtggatcccccgggctgcaggaattcgtctcacccctagaaaaaattccccatctccggaccagcgccgccgccagtcgctgtccacgggcaccccgggcgcgcctcctccgagcccagactcgagctccatcccgccgtggatcaccgcgtgaggtggggcgcaccgacccgggaaccccccgggnaagggggcccaaagaatggggttggttcccgggcgcccggatgggggccaagtanccgcgtttcggcgggccaccaaccggatccggcggcgacccggcaaagggtttcttttaggggggaggggccccccccctgttttttttttcacaaaaagtggggggcccaaaaaaaaaaaaacccccccccccccccctccttttttttnnntnnnnaagaagggaaaggagggggcggntgtnnntttttttttcccccccccccnnnntctttttttttttttttttntagaagggnnnnnnccccagaggacnnnaaaaggtgagaagagggnntttttttttctctttctcccccccccccccccnggggggggggcgggggggggggggggggggggnnnnnnngggggaagaactagaaannnagngaggggtcgnnnnnnnnnnnnnnnnnnnnnaggggaggggggggngaannnnnnnnnnnnnnnnccaaagaaattggggggcggggnnnnnnnnnnnnnnnnnnannnnnnaa

SEQ ID NO: 53883 - DNA, 676 bp, Zea mays
  misc_feature: Ceres CLONE 1476698-F
  misc_feature: Translation starting site: 285
  misc_feature (275)..(275): n is a, c, t, g, unknown, or other
  misc_feature (411)..(411): n is a, c, t, g, unknown, or other
  misc_feature (419)..(419): n is a, c, t, g, unknown, or other
  misc_feature (484)..(484): n is a, c, t, g, unknown, or other
  misc_feature (499)..(499): n is a, c, t, g, unknown, or other
  misc_feature (509)..(509): n is a, c, t, g, unknown, or other
  misc_feature (540)..(540): n is a, c, t, g, unknown, or other
  misc_feature (545)..(545): n is a, c, t, g, unknown, or other
  misc_feature (552)..(552): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (562)..(562): n is a, c, t, g, unknown, or other
  misc_feature (668)..(668): n is a, c, t, g, unknown, or other
ggagctccccgcggtggcggccgctctagaactagtggatcccccgggctgcaggaattcgtctcacccctagaaaaatcccattctcgaagccgctgcggcacgcgtcccgcttctggtttgcttgcctcccagatcttgccaactaattggaggcacgcatcccgcaacgcgccgtctcgacggcggatcgttttcttctgcttctactgcgtgatcttttggcaagaagaatagacacgtccaagcgtcgccacaccaagggcggcttggtngcagtcaagatggggaaggacggagaaatctgccagctgaaggaggagaagaagtccaaggaagagatccatctgaaggtcaagagcaaggacgagcggtcccggcgagaaaacggcaaggaggaggtcgaggtanagattgangcccagtttgttgagaaaggagaagtcaaagactcgggtgacggtgcgggaggaaagggtaccangaagaaggataccanggagaaagancagaaaaagaaggaaggtggtgaggattcanggaanggcaaangaannnacanaagggataagcgaaggatccggaggggcagggccaagtgagaaagaaaaagagggatggtgcttgaaaccacggaggcaaggaaaaaggcaaaaaaaaaaaagatnagaggggc

SEQ ID NO: 53884 - DNA, 669 bp, Zea mays
  misc_feature: Ceres CLONE 1476699-F
  misc_feature: Encodes the peptide sequence at SEQ ID NO. 53885
  misc_feature (235)..(235): n is a, c, t, g, unknown, or other
aagctggagctccccgcggtggcggccgctctagaactagtggatcccccgggctgcaggaattcgtctcacccctagaaaagttcatccactctcatcaccagctaagaacagggcttcgtctcaatggaaggcaaaacagggcagctcaggtgctgtttcgtcgccatcgtgctcgtcctgggtcttgtccttgagtcccaccaggctgaagctgggaggcaatggtgctgcnaaacccccaccggaaaataccattttaatcgctgcgttgactcgggtttggtccaccatattgggttctgtgccggtaatgcccgttgcatccttatggaaaaccgatgtggaggcccttggccggtgcctgctcctgataccctttccctggatggcatttgattaatttaagccagtacctgaaaaaaccggggccacacaactgtcctccaacgattggttatttgtgaacttggcctttgtcttcttatttcaacctttccaaaaacccccttccgaaatgggacctcccttcaagtctgtggactgtgtcctatacaaatctctatatcacataaaaacggggccccacttgtgtaaaaaaaaaaaaaaaaacaagacgctcgagggtacccatttccccctatagggaggcgtattacccgcccctcg

SEQ ID NO: 53885 - protein, 90 aa, Zea mays
  misc_feature: Ceres CLONE 1476699-F
  misc_feature (37)..(37): Xaa is any aa, unknown, or other
MEGKTGQLRCCFVAIVLVLGLVLESHQAEAGRQWCCXTPTGKYHFNRCVDSGLVHHIGFCAGNARCILMENRCGGPWPVPAPDTLSLDGI

SEQ ID NO: 53886 - DNA, 700 bp, Zea mays
  misc_feature: Ceres CLONE 1476706-F
  misc_feature: Encodes the peptide sequence at SEQ ID NO. 53887
  misc_feature (371)..(371): n is a, c, t, g, unknown, or other
  misc_feature (372)..(372): n is a, c, t, g, unknown, or other
  misc_feature (423)..(423): n is a, c, t, g, unknown, or other
aagctggagctccccgcggtggcggccgctctagaactagtggatcccccgggctgcaggaattcgtctcacccctagaaaaagcataccgaccttccttgcattttctcaataccttgaacaactaagcaagtccaatgtctcatgcccagccccttcgtttacaggcccagtggaaacacgtcgatattcaggataaccaagccaatgctatgaaggaaccaggaaccagtggtgggtatggctccccaatgaaagatgacaagaacaaggatgtggatacaatagcttcgaacttcatcaagcttaagcacagggcttgggcactccagaagagcacaaccatgtaccaaccttccactttaaagtgnntgctagtcaataaatcaatactatatataactatgcttgtctctataaagnctataagtcctagttcaaaataacggatgctgcttgcaccccttggatatttgtggaagggaacccattggtgaataccttattgaataaaaaagtaatgggaatttcccgggaaatgggtaatttttggggaaaaattatttttaaaaaataggaggctggggaaaccttttctggtttaaaaaaaaaaaaaaaaaaaaaaagaaaaagcctccaggggaccccattttcccccaaaaagggaggtttgtttaaccccgcgccccctgtgtgcgcg

SEQ ID NO: 53887 - protein, 102 aa, Zea mays
  misc_feature: Ceres CLONE 1476706-F
  misc_feature (78)..(78): Xaa is any aa, unknown, or other
  misc_feature (79)..(79): Xaa is any aa, unknown, or other
  misc_feature (96)..(96): Xaa is any aa, unknown, or other
MSHAQPLRLQAQWKHVDIQDNQANAMKEPGTSGGYGSPMKDDKNKDVDTIASNFIKLKHRAWALQKSTTMYQPSTLKXXLVNKSILYITMLVSIKXISPSSK

SEQ ID NO: 53888 - DNA, 653 bp, Zea mays
  misc_feature: Ceres CLONE 1476707-F
  misc_feature: SWISSPROT Homolog: EC 3.2.1.23 Beta-galactosidase
  misc_feature (465)..(465): n is a, c, t, g, unknown, or other
ggagctccccgcggtggcggccgctctagaactagtggatcccccgggctgcaggaattcgtctcacccctagaaaaagaaccgatccggtttaaaagatccgccgagaacgtctacatacagaagatggagcgggagaagctggagaaactgaggaggaaggaggacaaggccaaggccgaggcggccaagagggccgccgccgccgccagaggcgacacgaagaatggtgaggaggctcatccgagctgatcatcgccaaaatcggaccagtgctcccgtgaatcgtgtgatgctgtactactgatgacacgtagatgcaaatagacgccgtcgtactactctgctttgcaactctgctcgtcgtgtcgtgtgtgatcccatccctgtcactgttgtgaacttcgcttgtagctagcgacggttttgccttgtcccttgtcggtgcaaatgtaatggagtggnagcgtccttgagcctctttcatgtacataataatgaataaatgtagtcccctcgtcgaaaaaaaaaaaaaaaacgagacgctcgaggtaccccaatcgccctatagtgagtcgtattacgcgcgctcactggccgtcgttttacaacgtcgtgactgggaaaaccctggcgttacccaacttaatcgc

SEQ ID NO: 53889 - DNA, 645 bp, Zea mays
  misc_feature: Ceres CLONE 1476714-F
  misc_feature: Encodes the peptide sequence at SEQ ID NO. 53890
  misc_feature (283)..(283): n is a, c, t, g, unknown, or other
  misc_feature (324)..(324): n is a, c, t, g, unknown, or other
  misc_feature (543)..(543): n is a, c, t, g, unknown, or other
  misc_feature (545)..(545): n is a, c, t, g, unknown, or other
aagctggagctccccgcggtggcggccgctctagaactagtggatcccccgggctgcaggaattcgtctcacccctagaaaaatacgaggacaagggtaacgggaaagaaggccaaccgccccaatctcgcgtcccgccggcggccaccaccaccaccgccatgataagcatcctcgcgcatgagcgcctcctcgggttcgccctgggctccgtctctatgggacgtttcgtactcactagcgccgcgacatctaccactcaatcgctgaagccgatgggtcntcctacttctaccagcctgatgaaattgcaggtcctaaaanttcaactgaactcgttcatgactggaacaaggctgtcgacgacactcttggcaaactggttgggtaccttaactctcgtcgatggtgatccagctccatgtccaacatggctctgacgatgcacgggtggacgaacactctttttttaagccccatgtgtgctcatatgtctcctgatccggaatgagtatgttttgtttaaaacacaccatcctcctngntatgggtgttgttttgaggaaaaaatgggtgtccgtgccgctcgaggtccccaattccccttatgggggccctattacccgcgctcactggcctcttttt

SEQ ID NO: 53890 - protein, 145 aa, Zea mays
  misc_feature: Ceres CLONE 1476714-F
  misc_feature (94)..(94): Xaa is any aa, unknown, or other
  misc_feature (108)..(108): Xaa is any aa, unknown, or other
AGAPRGGGRSRTSGSPGLQEFVSPLEKYEDKGNGKEGQPPQSRVPPAATTTTAMISILAHERLLGFALGSVSMGRFVLTSAATSTTQSLKPMGXPTSTSLMKLQVLKXQLNSFMTGTRLSTTLLANWLGTLTLVDGDPAPCPTWL

SEQ ID NO: 53891 - DNA, 638 bp, Zea mays
  misc_feature: Ceres CLONE 1476738-F
  misc_feature (265)..(265): n is a, c, t, g, unknown, or other
  misc_feature (396)..(396): n is a, c, t, g, unknown, or other
ccccgcggtggcggccgctctagaactagtggatcccccgggctgcaggaattcgtctcacccctagaaaaaccccagcttgctcagtagtggttgctagcatacatatccaatccaattatattgctacaatacaggcctacaccctcagctcaacgtcgacgtcggcgatgtgtctgcggttctcctgtggcacggcggtgaccatgacacaaaggagtctgaggtggaaagccaccttattatcatccgtctcctgtgaaangagcacatgatggtcaccgtgcgaccaacgacatgcctcccgtcgtcgaagacaaccagcagaacggaggagggcacacgacgggtttcagcagccactcagacgacggcgttgtccgaagtggagagacnacgaatactaccgaggggatcgtggcgccgcccaccactactccagcacggaaggctgcttctagggatctggctgtgcagcaagctcctcaggatacgtatgtctctgctagtcgtcctccccaacaacaatggccgggggtcgtcggaaacattcccccccaggggggcccgtcttcaccaaaagtcaaactaccaattggctcctccggggggggaaagactactaagaatagtccccc

SEQ ID NO: 53892 - DNA, 653 bp, Zea mays
  misc_feature: Ceres CLONE 1476739-F
  misc_feature: Encodes the peptide sequence at SEQ ID NO. 53893
  misc_feature (136)..(136): n is a, c, t, g, unknown, or other
  misc_feature (247)..(247): n is a, c, t, g, unknown, or other
  misc_feature (255)..(255): n is a, c, t, g, unknown, or other
  misc_feature (437)..(437): n is a, c, t, g, unknown, or other
ctccccgcggtggcggccgctctagaactagtggatcccccgggctgcaggaattcgtctcacccctagaaaaagctttgcatctgcaaccccgcccgatcaatcttcctcgttccgccgctccctcgcctccggnagcgaggtgaggccaccgatcggacctttcctagcggcggcgcctaccaaccctcaggagcgatggctctgtctgcgacgctacggatttctcttagcgtcgcgttctttnggggtctngcgttcgtgcttggtgtcatcgccgaaaacaaaaagcctgcttccgggactcctatcctaggaaaggatgtcgtcatctgcacgtttccaagtgatccgactcttgcgatgggggagcctgtccattgtggcactttgtggagctgccatcgtagggcatgttgccatcttctttcatactncggcaagtcagttcctcgtggagcgctgtttcaaagcacagcttgacagtgttctttgttgttgctgagcttgtctcagccctggctcttgcaatggccctgggggcaacttgtcaccgagggtctttccccccagcaagaacatccccccacgaattggaacaccagtggccctactggccagaccggcctttgttgggcgggcgccgtttttcc

SEQ ID NO: 53893 - protein, 94 aa, Zea mays
  misc_feature: Ceres CLONE 1476739-F
  misc_feature (17)..(17): Xaa is any aa, unknown, or other
  misc_feature (80)..(80): Xaa is any aa, unknown, or other
MALSATLRISLSVAFFXGLAFVLGVIAENKKPASGTPILGKDVVICTFPSDPTLAMGEPVHCGTLWSCHRRACCHLLSYXGKSVPRGALFQSTA

SEQ ID NO: 53894 - DNA, 701 bp, Zea mays
  misc_feature: Ceres CLONE 1476741-F
  misc_feature: Pfam Name: Lipocalin_2 Pfam Description: Lipocalin-like domain
aagctggagctccccgcggtggcggccgctctagaactagtggatcccccgggctgcaggaattcgtctcacccctagaaaacagtggcagccattgacagtgcttcagttcctctgaagtttgacaacccttcagatgatgtcagcacagggatgatgatgagggggtatggaccgccaaaaacttcgatcccagttcgctactctgggtagatgggtttgagggtacccctcgtttgaaaccgtggattttcctgggtcagggaacaaggaagacctgtcactggtactcaggggagtggattcctttttgatgaggaaggcaccctcaatcccaggtgggatacatttctgtggccccggtggaccctgatggatacatcacccggctttcggggaagggtgcaatggcctatcctaaaaaagaatttgcaagtgctaacacacatctttaaagggcagaaaatgtcccctaaaaaatgttttttccggttccccacactggcctttcataccccaggaaccctttgatgtcctttgccccaaactttggacatttttcccatttgtgtctgggacctaaggatacaaactttttttcaagatatactcaaaaacacccccccccgggcccaaaatttttttggaaagttccagttctttttgtggccaaattccggttatacccccaagcaagaatc

SEQ ID NO: 53895 - DNA, 643 bp, Zea mays
  misc_feature: Ceres CLONE 1476751-F
  misc_feature: Translation starting site: 500
ctccccgcggtggcggccgctctagaactagtggatcccccgggctgcaggaattcgtctcacccctagaaaaaaaccgcaagctcaagcaaaaacacaaagcgcttaaaccacactcaaaccaaccgccagccaacaaacaggcctcctagtcccgaccagaactcgctcgtagccccgagaacccgacagcgcgagatggctcccgagctgatgacagccaagatgaccgccaagaaggccgccgcggcggcggcggcggcggcggcggcaaacctggcacgagggcgtacgtgacgttcctggcgggcgacggcaactactggaagggcgtggtggggctggccaagggcctgcgcaaggtccgctcggcctaccccctggtgggtggcgtgctgcccgacgtgcccgagtcccacccgcgcatcctcgtctcgcagggctgcgtcgtccgcgagatcgagcccgtgtacccgcctgagaacagacgcagttcgccatggcgtactacgtcatcaactactccaagctccgcatctggggagttcgtggagtacgagaggatggtgtacctggacccggacatccaggtgttcaagacatcgacggcctgttcgagctcgaaagggggtcttctacgcgg

SEQ ID NO: 53896 - DNA, 649 bp, Zea mays
  misc_feature: Ceres CLONE 1476755-F
  misc_feature: Encodes the peptide sequence at SEQ ID NO. 53897
aaagctggagctccccgcggtggcggccgctctagaactagtggatcccccgggctgcaggaattcgtctcacccctagaaaaaagccgccgccatcccttctccctctccctcctctcctctagcttctctccctcgcttccctcccctgcagcttcctcacgccatgcttccggacccgcgccaagccttggccacgcagcgagcgcccaacccgacgcagccgcgacaccgaccctgcccctccctgcactcgacgcgcctggagccccgccagccgagtactgtgaagcgcgccaccgaccggcatccagacccgcgtcgagccccagcccgacaccccggcttccccgcgtctacgtagcagcgccctgctcatccgcaagaactggcagcgaagcttgtcgttaaggagatattaatcatgtggagatgcagaggattgacggagaggaagcaaaaaatgactgtatgggagaatatgcagaaagctgaagcagaagcagccatacaaaaccttgtgataaaacttgaaaagaaaaggccatactcgctagagaggattttcacaccccttagtctggctctcggaagcacaggtggtacgcagtacatcaaccgcaaatcagaatcagcatatttccagaac

SEQ ID NO: 53897 - protein, 75 aa, Zea mays
  misc_feature: Ceres CLONE 1476755-F
MWRCRGLTERKQKMTVWENMQKAEAEAAIQNLVIKLEKKRPYSLERIFTPLSLALGSTGGTQYINRKSESAYFQN

SEQ ID NO: 53898 - DNA, 664 bp, Zea mays
  misc_feature: Ceres CLONE 1476757-F
  misc_feature: Translation starting site: 132
  misc_feature (366)..(366): n is a, c, t, g, unknown, or other
  misc_feature (367)..(367): n is a, c, t, g, unknown, or other
  misc_feature (443)..(443): n is a, c, t, g, unknown, or other
  misc_feature (602)..(602): n is a, c, t, g, unknown, or other
ctccccgcggtggcggccgctctagaactagtggatcccccgggctgcaggaattcgtctcacccctagaaaaaatccaacgaactgaccacaactacctaagctaaaagctaaccaccgtacccccggccatggcgctcgcgcccacctccgctgccgtgctcaagaccccgttcctcggggccaggcgcgcgctcgccaagcccgcgcctcgccgcgcgctcgtcatcgccgccgcggccgccgccaagaagtcgtggatcccggccatcaagagcgacgccgagatcgtcaacccgccctggctcgacggctcgctccccggcgacttcgggttcgacccgctggggctgggcaaggaccccnngcgtccctcagtggtaccggggagggcgagctgatccacggggcggtggcgatggcggccgtgctgggcatcttcntggggcaggcgtgaagcggcatcccgtggttcgaggccggcgcggacccgagcgccatcgcgcccttctccttcgggtcgctgctgggcacgcagctgctgctgatgggggtgggtggagtcaaagccggtgggtggacttcttcaacccggactcccnaggccgtggagtggggcaccgccgtggttcgcgcaccgctgagaacttcgcccaacttcacg

SEQ ID NO: 53899 - DNA, 655 bp, Zea mays
  misc_feature: Ceres CLONE 1476769-F
  misc_feature: Translation starting site: 128
  misc_feature (454)..(454): n is a, c, t, g, unknown, or other
  misc_feature (559)..(559): n is a, c, t, g, unknown, or other
ctccccgcggtggcggccgctctagaactagtggatcccccgggctgcaggaattcgtctcacccctagaaaaaaacgaactgaccacaactacctaagctaaaagctaaccaccgtacccccggccatggcgctcgcgcccacctccgctgccgtgctcaagaccccgttcctcggggccaggcgcgcgctcgccaagcccgcgcctcgccgcgcgctcgtcatcgccgccgcggccgccgccaagaagtcgtggatcccggccatcaagagcgacgccgagatcgtcaacccgccctggctcgacggctcgctccccggcgacttcgggttcgacccgctggggctgggcaaggacccggcgttcctcaagtggtaccgggaggcggagctgatccacgggcggtgggcgatggcggccgtgctgggcatcttcgtggggcaggcgtggagncgcgtcccgtggttcgaggccggcgcggacccgagcgccatcgcgcccttctccttcgggtcgctgctgggcacgcagctgctgctgatggggtgggtggagtcnaaagcgtgggtggacttcttcaaccggactcccaggccgtggagtgggccacgcccgtgtcgcgcacgctgagaacttcgccactttcaccgggag

SEQ ID NO: 53900 - DNA, 624 bp, Zea mays
  misc_feature: Ceres CLONE 1476770-F
  misc_feature: Encodes the peptide sequence at SEQ ID NO. 53901
  misc_feature (46)..(46): n is a, c, t, g, unknown, or other
  misc_feature (409)..(409): n is a, c, t, g, unknown, or other
  misc_feature (427)..(427): n is a, c, t, g, unknown, or other
  misc_feature (447)..(447): n is a, c, t, g, unknown, or other
ggagctccccgcggtggcggccgctctagaactagtggatcccccngggctgcagggaattcgtctcacccctagaaaatccaagcctgagcactccatccactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccagacgccctcgtacctgaccgggcgagtccccggcgactacngctgggacaccgccgggnctgtccgcgacccggaggcngtcgcgcggaacagggcgctggaagtgatccacgggccggtgggcgatgctgggtgcgctgggctgcatcacccccggaggtgctggaaaaagtgggtgcccgtggacttcaaggaaccccggtggttcaagggcggggccccaaaatcttctcgggagggccgggctggacctact

SEQ ID NO: 53901 - protein, 154 aa, Zea mays
  misc_feature: Ceres CLONE 1476770-F
  misc_feature (83)..(83): Xaa is any aa, unknown, or other
  misc_feature (89)..(89): Xaa is any aa, unknown, or other
MASTIMAATSRIVAAKTPFLGQGRAAAAAANASPLRDVAAAAAGGRITMGNDLWYGPDRVKYLGPFSAQTPSYLTGRVPGDYXWDTAGXVRDPEAVARNRALEVIHGPVGDAGCAGLHHPRRCWKKWVPVDFKEPRWFKGGAPKSSREGRAGPT

SEQ ID NO: 53902 - DNA, 647 bp, Zea mays
  misc_feature: Ceres CLONE 1476772-F
  misc_feature (432)..(432): n is a, c, t, g, unknown, or other
  misc_feature (480)..(480): n is a, c, t, g, unknown, or other
  misc_feature (481)..(481): n is a, c, t, g, unknown, or other
ctccccgcggtggcggccgctctagaactagtggatcccccgggctgcaggaattcgtctcacccctagaaaaaactcccgactccacctctctccgatcgtctcatcttcttccttctcttccaccacatccttggcatctcatccggatcgaccagtacacgccccagtagtactaaagaaccagtttctgagtaaaacatggcggcgtcgccttccccgtccggcagcggcggcggcaaggccggcgtggaccggatcaagggcccctggagccccgagaggacgaggccctgcagcgcctcgtgcgccgccacggcgcgcgcaactggtccctcatcagccgctccgtcccgggccgggtccgcaagtcgtgccgcctccggtggtgcaaccagctgtcgccgcgggtggagcaccgccccttcacgnccgacgaggacgacgccatcctccgcgcgcacgccagggtcggcaacnnagtggggcacatcgcgcggctccctctcgggagcacggacaacgccatcaagaaccactggaactccacgctcaagcgcgagcgcgagcgcgagcgcgagtactacgccgatgcgcgccccggccccggggacagcgctcgctcaagcgcaccagcagcgacgggg

SEQ ID NO: 53903 - DNA, 658 bp, Zea mays
  misc_feature: Ceres CLONE 1476774-F
  misc_feature: Encodes the peptide sequence at SEQ ID NO. 53904
  misc_feature (246)..(246): n is a, c, t, g, unknown, or other
  misc_feature (247)..(247): n is a, c, t, g, unknown, or other
  misc_feature (254)..(254): n is a, c, t, g, unknown, or other
  misc_feature (255)..(255): n is a, c, t, g, unknown, or other
ctccccgcggtggcggccgctctagaactagtggatcccccgggctgcaggaattcgtctcacccctagaaaaaatcttccattcctcctctctccttccctgtgtctctctcctcgcgagctcttcatcccttcttccagcgcggtttggcgatggcggcagcgcaggcgatctcgaaggggagcgtggtgtctccatgcgggcatcgagcggcgccgggcttcctttgcaggcggagggtgccnntgcggcnncgatggcaccgtcagcggcgcggatcgggggcttctgggagaagaacgcgtttcctggcgggaggctaaccctgaggacgaggagatccagggccgcgtcaccgacgcagatgaacatgaaccttgcgctggggaaatcgatgaggtgggggggagaaggggttcaaccccaacatgcgtgagatcgagtccggcccaagaccttgtcgatgcttttgaccaacgccggggacaggggttcgtcgtcgtcaacttcttctctccctggctggggcggctgccgtgcttttcaccccaagatttgtcaatttgcggaacaaaatccagatgtgctgttccttgcagtgaactacgaggagccccagtctttgtgcccacgccttcatggtcatgtcctacccct

SEQ ID NO: 53904 - protein, 79 aa, Zea mays
  misc_feature: Ceres CLONE 1476774-F
  misc_feature (17)..(17): Xaa is any aa, unknown, or other
  misc_feature (20)..(20): Xaa is any aa, unknown, or other
MRASSGAGLPLQAEGAXAAXMAPSAARIGGFWEKNAFPGGRLTLRTRRSRAASPTQMNMNLALGKSMRWGGEGVQPQHA

SEQ ID NO: 53905 - DNA, 673 bp, Zea mays
  misc_feature: Ceres CLONE 1476775-F
  misc_feature: Translation starting site: 143
  misc_feature (302)..(302): n is a, c, t, g, unknown, or other
  misc_feature (336)..(336): n is a, c, t, g, unknown, or other
  misc_feature (404)..(404): n is a, c, t, g, unknown, or other
gagctccccgcggtggcggccgctctagaactagtggatcccccgggctgcaggaattcgtctcacccctagaaaaaaagaaccaacgtgctcgatctccatctcgaccgtcgctcaccgggaagctacgctacgacgaagcatggcgtccgtcaccgcccgcgccccggtcgcggccctgcgcccgtcggcgtctctcaagtcgtcgtcgtcgtcggcggcggccttccttggccactctagccgcctcggccgcactgctaccgcgtcgccgacgaggcgcagcctaaaggcggaggccnagggcgagtggctcccgggccttcccctcccccngctactcgacggcagcctgccgggtgacaatggcttcgacccgttggggccctggcgaagacccgganaacctgaggtggtacgtgcaggcggagctggtgaacgggcgggtgggcgatgctgggcgtggccgggatgctgatccggggagtgctgaccaaggcggggctgatcaacgccccgcagtggtacaacgcccgcaagtcggagttatttcgcgtcgtcgtcaaccgtgtttcgggatccaatttctcccggtttcccctacggggaaatcccggggggggcaggaacatcaggaacccccgggaagcggtaacccaggaaccccttcttt

SEQ ID NO: 53906 - DNA, 650 bp, Zea mays
  misc_feature: Ceres CLONE 1476776-F
  misc_feature: Translation starting site: 340
  misc_feature (296)..(296): n is a, c, t, g, unknown, or other
  misc_feature (322)..(322): n is a, c, t, g, unknown, or other
  misc_feature (361)..(361): n is a, c, t, g, unknown, or other
  misc_feature (386)..(386): n is a, c, t, g, unknown, or other
  misc_feature (387)..(387): n is a, c, t, g, unknown, or other
  misc_feature (395)..(395): n is a, c, t, g, unknown, or other
  misc_feature (398)..(398): n is a, c, t, g, unknown, or other
  misc_feature (455)..(455): n is a, c, t, g, unknown, or other
  misc_feature (492)..(492): n is a, c, t, g, unknown, or other
  misc_feature (493)..(493): n is a, c, t, g, unknown, or other
ctccccgcggtggcggccgctctagaactagtggatcccccgggctgcaggaattcgtctcacccctagaaaaaatacagtgtcatccattttaacaaaacagatgctcgcttagccaataatggtatcagtacagagattcaactgcttagatgccgtgttaattttcatgccctgaaattcacacctcaaattgagggattagggaatgaactggtacataaactgcgagccaagggatcatttgtagccttgcatttacgttatgagatggatatgctggcgttttctggttngcacccatggctttcacctgaagaangctgaggagctcaaaaaatgagatatgcttatccatggntgagagataaagaaattgattcccnnagcaaganggntgcaagactatgcccacttactcccgaggaggcatcacttgttttgaaagctcttgnatttcaaaaagatgctcttatatacatcgcagctggnngaaatttatgggggagatagagactagagccactacgggctgcttttcaaacccttcgttgaatatttttaggtacgaaaagtgatgctgctaaactctgaagttctgcgtcaattccaaatcactcttcccagatggctgcacttgatttcattgt

SEQ ID NO: 53907 - DNA, 633 bp, Zea mays
  misc_feature: Ceres CLONE 1476777-F
  misc_feature: Encodes the peptide sequence at SEQ ID NO. 53908
  misc_feature (633)..(633): n is a, c, t, g, unknown, or other
ctccccgcggtggcggccgctctagaactagtggatcccccgggctgcaggaattcgtctcacccctagaaaaaaccagcaccgcagagctctcatcctctctctctctctctttctcgcgctcgctttgcttcctcgtcgaggtccaagttcctgcattgatggcgaccgaggtggctgagactcccgcgccgttggcggaggcggtccccgagacccccgcggaggcaccggcggcgcccgccgccgaggcgaagcctaccaagggcaagaaggctctgcgcccaggaagcgtgccaacccgacccacccgccgtacgccgagatgatctcggaggctgtcacgtcgctcaaggagcggacggggtccagccagtacgcgatcgccaagttcgtcgaggacaagcacaaggacaagctcccgcccaacttccgcaagctcctgctcggccagctcaagaagctcgtcgccggcggcaagctcaccaaggtgaagaactcctacaagctgcccgcacgcgccccggccgccgcaaagcgaaaccccagtcaaaaccgctgtgaagacccccaaggccggtgccaagaagcccaaggccgccaccaaggccaagccgaagcccaaggccaagn

SEQ ID NO: 53908 - protein, 102 aa, Zea mays
  misc_feature: Ceres CLONE 1476777-F
  misc_feature (1)..(64): Pfam Name: Linker_histone Pfam Description: linker histone H1 and H5 family
MISEAVTSLKERTGSSQYAIAKFVEDKHKDKLPPNFRKLLLGQLKKLVAGGKLTKVKNSYKLPARAPAAAKRNPSQNRCEDPQGRCQEAQGRHQGQAEAQGQ

SEQ ID NO: 53909 - DNA, 691 bp, Zea mays
  misc_feature: Ceres CLONE 1476781-F
  misc_feature (384)..(384): n is a, c, t, g, unknown, or other
tccccgcggtggcggccgctctagaactagtggatcccccgggctgcaggaattcgtctcacccctagaaaaacacgctcgcgattcaacaaagacgtacgtacatgcacaaaactagagcgagctgtgtgtgtgtgtgtccttcatttcctccgatcatggcaaaggcccagccccaggtggccgcaagttcatgatggaagccccccccccccaggtggtgtccgtcatgccgcggaaagaaggccccaaggaacctgacccccatcccccaggacaacagggagatgctggccccttgcgggtccccgtcggaccacggccacctacatacccttaactggggcgggtagagataccgtctcttactgggtgggtggtgtntgtgtttatcaactcctcgatgcatggccaaagcccaggcgcaggtgggggccaggttcacaacgggagggggcccccccgcagggggtgtctgtctttcaacaaagggaaggggccaaagaacccttgaaaccattccccgaagaccaccgggggaccaccagctggggggggggggtcccccattcggaaccacgggctttcgcgaagggggtgggtccttcccctcccaaaagaaaacccaaaccccccccccaaccccccccccggggaacccccccaggggtgggtttccctgaaacacaag

SEQ ID NO: 53910 - DNA, 662 bp, Zea mays
  misc_feature: Ceres CLONE 1476797-F
  misc_feature: Encodes the peptide sequence at SEQ ID NO. 53911
aagctggagctccccgcggtggcggccgctctagaactagtggatcccccgggctgcaggaattcgtctcacccctagaaaaacgaccacacaccaccgctccacacacaagaagagagccgagagctagctacctagcgcgcgatggcgatgtccgcttccaagatgatggcggtcgccgccgctgccctgctagccctggtcctggccgcgtcgaccgcggaggcgaggaacatcaagacgacgacgacgacgacggagaagaaggacgatgcggtggtgcagccgcagaccttcccgcccttcgaccgcctcggcggcggcgcgtccccggcgtccggtggcctcccggcacctcgtcgggcggcagcagcattccagcgttcagcatgccgggcagcggcagcagccctccccggcgggtcgttctttgcccgcagcagcggcagcatcggcagcatgcccctcttcagcggcggctcccccgccctcagcggcttcggcggcatgccccgggtccccgccggcgggtccgtctccgtcgtccccgtgcacggcagcaagccctgaaaatccgtcccgtcgcggaacccgggaatctgtcgggcccaacttgggccctagtactcctttgcctgcatggaattggagagtttggatcc

SEQ ID NO: 53911 - protein, 141 aa, Zea mays
  misc_feature: Ceres CLONE 1476797-F
MAMSASKMMAVAAAALLALVLAASTAEARNIKTTTTTTEKKDDAVVQPQTFPPFDRLGGGASPASGGLPAPRRAAAAFQRSACRAAAAALPGGSFFARSSGSIGSMPLFSGGSPALSGFGGMPRVPAGGSVSVVPVHGSKP

SEQ ID NO: 53912 - DNA, 646 bp, Zea mays
  misc_feature: Ceres CLONE 1476803-F
  misc_feature: Encodes the peptide sequence at SEQ ID NO. 53913
  misc_feature (525)..(525): n is a, c, t, g, unknown, or other
  misc_feature (613)..(613): n is a, c, t, g, unknown, or other
ctccccgcggtggcggccgctctagaactagtggatcccccgggctgcaggaattcgtctcacccctagaaaataggcaccgttgtggctgtgcggaactgcacaagagcgtttcgcctcggccaccacgaacggagaaggcggcagccatggccatggaggaagcggggaagatgacgtgcaggaagaagggtggtctgagaacaatgcccttcatcttcgccaacgaggtggcggagaagctcgccgtggtgggtttctcgaccaacatgctgacgtacctgaccactcagctgcacatgccgctagcgaaggccgccaccacgctcaccaacttcggcggcacctccgccgcgacgcccctcatcggtgccttcctcgccgacgcctgcatcggccggttctggaccatcgccgccgcgtccgtcgtctaccaagccgtacgtgcactgtggaaccctctttgccagcaatgcatacagcatacgtcgtgggcgtggtgaactgcgccctgcgcgcgctgcnagtgaatgaatgatcactgacgtccgtggcgcacagggcatggcgctcctgacggtgtcagcggcgctgccgcggttcccgccggcgncctgcaagccgggcggcgcggtggcatgccaga

SEQ ID NO: 53913 - protein, 117 aa, Zea mays
  misc_feature: Ceres CLONE 1476803-F
MAMEEAGKMTCRKKGGLRTMPFIFANEVAEKLAVVGFSTNMLTYLTTQLHMPLAKAATTLTNFGGTSAATPLIGAFLADACIGRFWTIAAASVVYQAVRALWNPLCQQCIQHTSWAW

SEQ ID NO: 53914 - DNA, 707 bp, Zea mays
  misc_feature: Ceres CLONE 1476804-F
  misc_feature: Pfam Name: Peptidase_C15 Pfam Description: Pyroglutamyl peptidase
  misc_feature (331)..(331): n is a, c, t, g, unknown, or other
agagctggagctccccgcggtggcggccgctctagaactagtggatcccccgggctgcaggaattcgtctcacccctagaaaaactgggccggctgcatctttctcctcccaccatcacctcctccacctcctcctctttatccatctgccagggcgcacgaggagaacggcggcgtctgagatcgcgaggccgaggcttgtcccgtccccgctccgctcctcccacccacggtttctggaggacaattcttcgctgtctagccttcctcaaaagtaaagagggtaaatgggatcagaagggcccttcagttgtcactgtccatgttactngattttagaagttccatggggttgctgagaacccaacgagaaaaatgtgaccaatcttaaatctttcttggaaaagcgagggttgcaaaaaatcttgtccttcgaagctgcacagttctcaaaacccccggggaagagggccctttgccccttaaataaaggtttaaaagcctgcctttccaaaacaaggaaattgggtcccccgacacgggacaagaaatttggaccccttttggggcccaaagggggccataaaggtttgccccttaaaaacccacgtttaaaaggggcccccttccgggtttcccaaaagtcttggggggaaacccccgggggggccccctttttgcccccctagggggaggctctccccgga

SEQ ID NO: 53915 - DNA, 703 bp, Zea mays
  misc_feature: Ceres CLONE 1476807-F
  misc_feature: Encodes the peptide sequence at SEQ ID NO. 53916
ggagctccccgcggtggcggccgctctagaactagtggatcccccgggctgcaggaattcgtctcacccctagaaaaagtcccccgccgccgccgctcccagtctctacgcggaagcagcgcctcgcaccgctcctacccaatggcgccgacgtcgaagctgtcgatgggcatcaagcgtgcgtcgcggtcgcacgcgtaccaccgccgtgggctctgggccatcaaggccaagaacggcggcgtcttccccaaggccgagaaacccgccgccgccgcggaacccaagttctaccccgccgacgacgtcaagcctcgcgttcccagcacccgcaagcctaatcccaccaagctcaggtcgagcatcacgcctgggacggtgctgatcctcctcgcggggcgcttcaccccgaagagagtggtgttcctcaagcagctcaactccggcctgctcctcgtctctggtccattcaagatcaatggagtaccgatccgtcgtgtcaaccagacctatgtcattgctacatcaaccaaggttgacatctctggtgttgatgtagcgaagtttgatgacaagtactttgccagggagaaaaagcagaaggtgaagaagaccgagggtgagctttttgagacagagaaggaggcgtccaagtctctgcctgatttcaaaaagatgaccagaaggccgtggatgctgctct

SEQ ID NO: 53916 - protein, 187 aa, Zea mays
  misc_feature: Ceres CLONE 1476807-F
  misc_feature (112)..(186): Pfam Name: Ribosomal_L6e Pfam Description: Ribosomal protein L6e
  misc_feature (1)..(49): Pfam Name: Ribosomal_L6e_N Pfam Description: Ribosomal protein L6, N-terminal domain
MAPTSKLSMGIKRASRSHAYHRRGLWAIKAKNGGVFPKAEKPAAAAEPKFYPADDVKPRVPSTRKPNPTKLRSSITPGTVLILLAGRFTPKRVVFLKQLNSGLLLVSGPFKINGVPIRRVNQTYVIATSTKVDISGVDVAKFDDKYFAREKKQKVKKTEGELFETEKEASKSLPDFKKMTRRPWMLL

SEQ ID NO: 53917 - DNA, 694 bp, Zea mays
  misc_feature: Ceres CLONE 1476808-F
  misc_feature: Encodes the peptide sequence at SEQ ID NO. 53918
aagctggagctccccgcggtggcggccgctctagaactagtggatcccccgggctgcaggaattcgtctcacccctagaaaaagctcgccttattcataaccacaccggctaagcgccactgcacacgtcactcgctgtccgttctagcataccgcaccacacttcggcgccggtccgcgagcagatcaacagatggccacggcgacctacctctcctcctcctccttctcctcgccgccgccgcccccgtcatcacgcgcccgcctgcggcggcagacgaccagggcgggcgcgtcggcggcgacggaccgcccgcgcgaggtgctgtccccgaagcgccggctcccgctgcgggaggtgccgggtgactacggcccgccggtgctgggcgcggtccgcgaccggttcgagtacttctacgggccgggcggccgcgacggcttcttcgcctcccgcgtgcgcgcgcacggctccaccgtggtgcggctcaacatgccgccgggccccttcgtggcgcgcgacccgcgcgtggtggcgctcctggacgccgcctccttcccggtgctcttcgacacctcgctcgtcgacaagacggacctgttcacgggcaccttcatgccctccaccgacctcaccggcggctaccgcgtgctctcgtacctcgaccccgccgaacccagctacgcccgctca

SEQ ID NO: 53918 - protein, 167 aa, Zea mays
  misc_feature: Ceres CLONE 1476808-F
  misc_feature: SWISSPROT Homolog: EC 4.2.1.92 Hydroperoxide dehydratase
MATATYLSSSSFSSPPPPPSSRARLRRQTTRAGASAATDRPREVLSPKRRLPLREVPGDYGPPVLGAVRDRFEYFYGPGGRDGFFASRVRAHGSTVVRLNMPPGPFVARDPRVVALLDAASFPVLFDTSLVDKTDLFTGTFMPSTDLTGGYRVLSYLDPAEPSYARS

SEQ ID NO: 53919 - DNA, 643 bp, Zea mays
  misc_feature: Ceres CLONE 1476812-F
  misc_feature: Translation starting site: 139
  misc_feature: SWISSPROT Homolog: EC 1.10.2.2 Ubiquinol--cytochrome-c reductase
  misc_feature (329)..(329): n is a, c, t, g, unknown, or other
  misc_feature (435)..(435): n is a, c, t, g, unknown, or other
gctccccgcggtggcggccgctctagaactagtggatcccccgggctgcaggaattcgtctcacccctagaaaaagaccctagccgagatcagatcggaggcgagcgccaccaccgaccggaggaagaggacgacacgatgctgcgggttgcggggagaaagctctcgtcttccctctcctggcgccccgccgcggcggtagccaggggccccctcgccggcgctggcgtccccgaccgggacgacgactcggctcgcggacggagccagccgcggttctccatcgactcccccttctttgtcgcttccaggggtttctcttctactgnaacagttgtcccaaggaccaagatgctggcctagctgacctcccagcactgtggctgctgtgaagaatcctaaccctaaggtggttatgatgagtacaccatgaangatatcctcctggagatccccagcagcgtgcctttgcatactttgtcctgagggggggagggtcatatatgcttcactgctgcgtcttctcgtactgaagtttgtcctgagcatgtcagcaagcaaggatgtgcttgcccttggctcactggaggtggacctcctcagtatcgagcccgggaccacagggaccgtgaagtggcgtgga

SEQ ID NO: 53920 - DNA, 695 bp, Zea mays
  misc_feature: Ceres CLONE 1476815-F
  misc_feature: Pfam Name: DUF760 Pfam Description: Protein of unknown function (DUF760)
aagctggagctccccgcggtggcggccgctctagaactagtggatcccccgggctgcaggaattcgtctcacccctagaaaaaactaattgtttcctgtgacttggattattggagagatgttggctaatttcccttgttttcttgagataggcggattgctgaagtaaaagagcaaggaacggagaaggactttggaggagatactctatgctctggttgttcagaagttcgttgaagctggtgtctctctggttccagcactctcacgctccaccgatccttctggaagagttgatcagtgggcagaaactgtggaagaaaagcttcaacgtctgcactcgcatgaggcctatgaaatgatcgagaatcacctcaccctcattctggggcagcgtcaaggtgacgccactctcgcagccataagtaagctccgtgttggccaggtctatgctgcatctgtgatgtacggttatttcctgaagagagttgaccagaggttccagctcgagaagacgatgaacggcctcccttgggggtcagaagagcaagacagcgctttgaatcaagttatgatgaccgacttgatgccttcagctcagacttctagctctcatccagagatgggctcgtggaccgcgcctgccttcagcacaggagggcccagcctatctatcgagccttgcagctctatgt

SEQ ID NO: 53921 - DNA, 643 bp, Zea mays
  misc_feature: Ceres CLONE 1476823-F
  misc_feature (291)..(291): n is a, c, t, g, unknown, or other
  misc_feature (357)..(357): n is a, c, t, g, unknown, or other
  misc_feature (382)..(382): n is a, c, t, g, unknown, or other
  misc_feature (383)..(383): n is a, c, t, g, unknown, or other
  misc_feature (414)..(414): n is a, c, t, g, unknown, or other
  misc_feature (577)..(577): n is a, c, t, g, unknown, or other
aagctggagctccccgcggtggcggccgctctagaactagtggatcccccgggctgcaggaattcgtctcacccctagaaaaagcccccatccactgatccaccacatcccacgccgagcgcgacgccagcagcaggctagctccgctgtccgctccgccgctcactagctagctgctggactgcgcctccctccatcgcgccggcgcgcgcgcctagctagcggagccgccttttcatggtccccgccgtggtcgggacgagatgcctcgcctcgcattcctccgccgcntccctccccgcgaggcttctcgcgcaagcgtgttgtggtggtggtggagtccgggggagccctggngcagtggcgcgggacgaggaggccnngagcagcggcggaatgagcgggcggtcgtcngcgggtgggccgtcgggcgggagtgctacgcgtgcacgcagccccggttgccggcgttcacttcaagacgggcgaacaggtgcactcgccgactgggacgccaagcgggggcctccctcgtgccggtcccaggccaggggcaaggcggggggggggccccggncagcggcaccccggcccggttgctgtttggggccccctcttggaaccccgaaaaaaggccctggaa

SEQ ID NO: 53922 - DNA, 655 bp, Zea mays
  misc_feature: Ceres CLONE 1476830-F
  misc_feature: Encodes the peptide sequence at SEQ ID NO. 53923
  misc_feature (281)..(281): n is a, c, t, g, unknown, or other
  misc_feature (286)..(286): n is a, c, t, g, unknown, or other
  misc_feature (334)..(334): n is a, c, t, g, unknown, or other
  misc_feature (350)..(350): n is a, c, t, g, unknown, or other
  misc_feature (358)..(358): n is a, c, t, g, unknown, or other
  misc_feature (413)..(413): n is a, c, t, g, unknown, or other
  misc_feature (585)..(585): n is a, c, t, g, unknown, or other
  misc_feature (655)..(655): n is a, c, t, g, unknown, or other
ggagctccccgcggtggcggccgctctagaactagtggatcccccgggctgcaggaattcgtctcacccctagaaaacgaccaaggctcgcacacgccgtggccgccccgcgcgctcgcccgccgcgtcgtccctgtccctgatccatccccagtccccagcaggccagcggccacctcccgctcgccgccgcttgtggccggaggaccggaagtacatgggccaggctctgcgccgcgccctcgggcgcgtgaagcccctcccgcgccctcgccgcccgngaggnaaccccacctcccccgctccgcccaggggtcgccggcgcccgctggcngcgcgacgcaggaccngctcgacnggctatctggtgacgaatcacggctccaacagaaagtgcccatggtgtacttgangaacgtgatccaagttacgacgagatgctcaagcacatgtttggggaaatcactacccaacccggaggaaaaccagaaatgggtgaagcttccgttgtccagcgtacaacagggccctcccaaaggtcagaacgtcaaaggccgaacctggggcagggtgggggaaaagcanctaccgtcaggggctcctgaacgtccagaacatccagggaatcatccgactgtaccaaggggaactcacn

SEQ ID NO: 53923 - protein, 55 aa, Zea mays
  misc_feature: Ceres CLONE 1476830-F
  misc_feature (50)..(50): Xaa is any aa, unknown, or other
MLKHMFGEITTQPGGKPEMGEASVVQRTTGPSQRSERQRPNLGQGGGKAXTVRGS

SEQ ID NO: 53924 - DNA, 744 bp, Zea mays
  misc_feature: Ceres CLONE 1476837-F
  misc_feature: Encodes the peptide sequence at SEQ ID NO. 53925
aaagctggagctccccgcggtggcggccgctctagaactagtggatcccccgggctgcaggaattcgtctcacccctagaaaaaactccccaaccataaataacctcacccgctctccctccgccctcttcccatgcaccgcccgctgccgtgcccgccctgccctccaccttctcccggcgcaataaacaagtctaggcgaggcgaggcggcagcggcggcggcggcattgccgacatttccgtgattcttgcgcttgttagttgtgctgtgtatagttgggccggccggcggtggttccgtacagatccttctctgttggagtagtccgcggcgatgggtatcctcgcgctcatcatcggcaaggcgtgcgccagcgggttcgggtcggcgtccacggcggagcatgtcaccgacggcgccgacgccagccgcctcaccgtcgctatcacaggaggagctacgtggcattgctctggagacatccaaagtcttccacctgaaaagaaccccatggtggacatccctgcttgaaaccccagagggctggttcaaaaggcaaaaaagaaccttcctgggaaaaaaaatccccccggccccttattgggtgttcttgaaactataaccccccctccccccaaagttttttcggggtttttttggggcccccccttcaccctcaagaaaaaacccctctttaaaacctccgaaaaaaaaaaaggggcggcactaattttccccccc

SEQ ID NO: 53925 - protein, 65 aa, Zea mays
  misc_feature: Ceres CLONE 1476837-F
MGILALIIGKACASGFGSASTAEHVTDGADASRLTVAITGGATWHCSGDIQSLPPEKNPMVDIPA

SEQ ID NO: 53926 - DNA, 641 bp, Zea mays
  misc_feature: Ceres CLONE 1476844-F
  misc_feature: Translation starting site: 154
  misc_feature (245)..(245): n is a, c, t, g, unknown, or other
  misc_feature (353)..(353): n is a, c, t, g, unknown, or other
  misc_feature (362)..(362): n is a, c, t, g, unknown, or other
  misc_feature (382)..(382): n is a, c, t, g, unknown, or other
ggagctccccgcggtggcggccgctctagactagtggatcccccgggctgcaggaattcgtctcacccctagaaaaactccaaatccaccgaggccatcgcctgggccccggggaaacccctcgcgctcgtggccctgtgagcagccgcagccatggcgcagccgctcgtcgtgaagaagacgacgatctcgacgaggaagatactactcgccattcctggcatagagaaggcgccgtgctgcangaggcccgagtcttccatgaccctcagctcgacgcgcggcgatgctgccaaggtatcacccagctcctgtacctgctcaaccagggtgatacctttaccaagggtgangctacagangtcttctttgcaacgaccangctgttccagtctaaagatgcgggccttaggaggatggtgtacctcatgatcaaggaactctccaccttcagccgatgaggtcatcatagtaacaagctctttgatgaaggacattgatagcaaacctgatattgtacggtgcaaatgctattagagtttctttgtcgtaattattgactcaaccctttctccaccaaatcgagaggtattttaaaccaagcttttgttgacaagaatccttgttgtttcccagtgccc

SEQ ID NO: 53927 - DNA, 598 bp, Zea mays
  misc_feature: Ceres CLONE 1476845-F
  misc_feature: Encodes the peptide sequence at SEQ ID NO. 53928
  misc_feature (252)..(252): n is a, c, t, g, unknown, or other
  misc_feature (256)..(256): n is a, c, t, g, unknown, or other
  misc_feature (264)..(264): n is a, c, t, g, unknown, or other
  misc_feature (265)..(265): n is a, c, t, g, unknown, or other
  misc_feature (277)..(277): n is a, c, t, g, unknown, or other
  misc_feature (283)..(283): n is a, c, t, g, unknown, or other
  misc_feature (298)..(298): n is a, c, t, g, unknown, or other
  misc_feature (301)..(301): n is a, c, t, g, unknown, or other
  misc_feature (302)..(302): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (342)..(342): n is a, c, t, g, unknown, or other
  misc_feature (343)..(343): n is a, c, t, g, unknown, or other
  misc_feature (352)..(352): n is a, c, t, g, unknown, or other
  misc_feature (355)..(355): n is a, c, t, g, unknown, or other
  misc_feature (356)..(356): n is a, c, t, g, unknown, or other
ctccccgcggtggcggccgctctagaactagtggatcccccgggctgcaggaattcgtctcacccctagaaaaagctccactctttcgcattttcgctctccatctatgctaccccccctcgccctcgtgccgtgaccagcgaagcttgcggtcttgcggggtacggagatggcgacggcccgggggatgaccccggctgcggcggacgctgtggaggagctcacgcggctgtaccgggagctgcctccgcncccngccgtggnnagagtggaggcngcggcngcggtgctggcctcngcnngacgcgagggaggagcgcgcctccnnnagatcgccagggnnagagaggcngcnncggtgcaggcacaggacgtgccggccgagctcttcgacgtgctgtgggaggccagcgcaactccgtgcgcctccgctcgctgctgcagcggagggagccgcccacgtcgtcaagctcgagaagcgggtcaagctcttcgacgacctcatcaggagggcgtcgcggggtggttttctcccggtgatggtgctaaggggcgggggggaaccccttccttcaaccttgaaggccaagggggaacc

SEQ ID NO: 53928 - protein, 143 aa, Zea mays
  misc_feature: Ceres CLONE 1476845-F
  misc_feature (28)..(28): Xaa is any aa, unknown, or other
  misc_feature (32)..(32): Xaa is any aa, unknown, or other
  misc_feature (45)..(45): Xaa is any aa, unknown, or other
  misc_feature (53)..(53): Xaa is any aa, unknown, or other
  misc_feature (54)..(54): Xaa is any aa, unknown, or other
  misc_feature (58)..(58): Xaa is any aa, unknown, or other
  misc_feature (63)..(63): Xaa is any aa, unknown, or other
MATARGMTPAAADAVEELTRLYRELPPXPAVXRVEAAAAVLASAXREGGARLXXIARXREAAXVQAQDVPAELFDVLWEASATPCASARCCSGGSRPRRQAREAGQALRRPHQEGVAGWFSPGDGAKGRGGTPSFNLEGQGGT

SEQ ID NO: 53929 - DNA, 696 bp, Zea mays
  misc_feature: Ceres CLONE 1476853-F
  misc_feature: Encodes the peptide sequence at SEQ ID NO. 53930
aacgctggagctccccgcggtggcggccgctctagaactagtggatcccccgggctgcaggaattcgtctcacccctagaaaaaacagccatcacacgcatactgcatacacaacgcagagcatcagaagcagctgcgatctgatcgacatggctgccgccaccatggctatcacctcccgcgctcgtcggcaagccggcggctggcacgagggacgtcttcggcgagggccgcatcaccatgcgcaagaccgccgccaagcccaagccggcggcgtccggcagcccatggtacggtgccgaccgcgtcctgtacctgggcccgctgtccggctcgcccccgagctacctgaccggcgagttccccggcgactacgggtgggacacctcggggctgtctgcggacccggagaccttcgccaagaaccgcgagctggaggtgatccactgccgctgggccatgctcggcgcgctcgggtgcgtgttcccggagctgctcgcccgcaacggcgtcaagttcggcgaggcggggtggttcaaggcgggctcccaaatcttcaacgagggcgggctggactacctcggcaaccccagcctgggtcaccgcgccaaagaaccctggccatctggggcctgcccagggggggcctcaaggggcgcccgtccaaggggaaccccggttcccccggccgccccg

SEQ ID NO: 53930 - protein, 152 aa, Zea mays
  misc_feature: Ceres CLONE 1476853-F
  misc_feature (32)..(145): Pfam Name: Chloroa_b-bind Pfam Description: Chlorophyll A-B binding protein
  misc_feature: SWISSPROT Homolog: EC 2.7.11.1 Non-specific serine/threonine protein kinase
MRKTAAKPKPAASGSPWYGADRVLYLGPLSGSPPSYLTGEFPGDYGWDTSGLSADPETFAKNRELEVIHCRWAMLGALGCVFPELLARNGVKFGEAGWFKAGSQIFNEGGLDYLGNPSLGHRAKEPWPSGACPGGASRGARPRGTPVPPAAP

SEQ ID NO: 53931 - DNA, 693 bp, Zea mays
  misc_feature: Ceres CLONE 1476855-F
  misc_feature: Translation starting site: 565
  misc_feature (693)..(693): n is a, c, t, g, unknown, or other
agagctggagctccccgcggtggcggccgctctagaactagtggatcccccgggctgcaggaattcgtctcacccctagaaaaaattttttcgtgtcaccttgcgactccgacgagccccaatcccgcgcgccggtgaccatggagttcatcgacccctgggactcccagtcccgcgctcgcgtcgtccattccggcgccaactccacttcgttctcctcctccaccgccaaagcacccctctccctccgccacgccgcatcttgcgccgccgcggccgtcgcacttctcgccgccgcgttctacctcctcccgacctaccagatcctctcctccctcctcatatggatcgcttcgtccctgctcctcgctcctttcgcgcccttgtcggccactggcggcgacatctccccccgccgaggccgcgtcggtccggctccgaaccgggcccaaaaccaagctggaaccaagcccgccccccgccgggggcgttgcccgaacccagtcccgacccccaaaaaacccttaaatccgggacaccccccccgtcaaatcggcccaattaatggatcccgtggaaaaagggaaaaaattcgggtgggaaccctggggaaaccccgggcaaaagggagaaagaacccccccaaagtggcctgcccaaaaactgggggctctcctcccggggcgaatgggn

SEQ ID NO: 53932 - DNA, 649 bp, Zea mays
  misc_feature: Ceres CLONE 1476859-F
  misc_feature: Encodes the peptide sequence at SEQ ID NO. 53933
  misc_feature (208)..(208): n is a, c, t, g, unknown, or other
  misc_feature (209)..(209): n is a, c, t, g, unknown, or other
  misc_feature (281)..(281): n is a, c, t, g, unknown, or other
  misc_feature (297)..(297): n is a, c, t, g, unknown, or other
  misc_feature (344)..(344): n is a, c, t, g, unknown, or other
  misc_feature (351)..(351): n is a, c, t, g, unknown, or other
tccccgcggtggcggccgctctagaactagtggatcccccgggctgcaggaattcgtctcacccctagaaaaacccacctgtgcacacagcgccgtcttctggagcagcgtccgaaagtgtgtggagaacctgcccgatccctcccgccgcctccgacctcaccgtcggcgggctcagcttgttcctggggtctgatcagccatgttnncagaacctgttgatgtgaaaaccatacagcgcttgtctggggcagacaaaaagaagctaagaagaactgccnaggaaaggttccacangcttctgatgctgaccttgatgccatccttcctcccaggctgagatnacagttngctagtacccgaaccatgttcttgtatatggcatagagggagagtccccatgattttcacactgacgcaagagtttatgcgctttggaacgtcccccatctgttgccagcttttacgcttgaaggggggtgaggtttcccgtttcgtgattggtggcgctgatctgatgtttcctgggatcagcatacctccaagagggtttccatccttttgaagctgggccaccctgggcagtaaaaagtccctggtacccctgctgcatttgcggttgggaccccaactttgagtgggtctgaag

SEQ ID NO: 53933 - protein, 45 aa, Zea mays
  misc_feature: Ceres CLONE 1476859-F
  misc_feature (2)..(2): Xaa is any aa, unknown, or other
  misc_feature (3)..(3): Xaa is any aa, unknown, or other
  misc_feature (27)..(27): Xaa is any aa, unknown, or other
  misc_feature (32)..(32): Xaa is any aa, unknown, or other
MXXEPVDVKTIQRLSGADKKKLRRTAXERFHXLLMLTLMPSFLPG

SEQ ID NO: 53934 - DNA, 637 bp, Zea mays
  misc_feature: Ceres CLONE 1476872-F
  misc_feature: Translation starting site: 164
cggccgctctagaactagtggatcccccgggctgcaggaattcgtctcacccctagaaaaacccgccacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaagaatgttgttttggagagcaagtatggctctcctaaaattgtaacgatgggtgtacagttgccagagaggtgagctgggagaccctgtggagaacattggtgctaaattggccagggaagcagcagctaaaaccaatgatctagctgggagagggaaccaccccctctggggccccttggtcagggggctgatcgcttaggggggataagggttggggcagctgggggctaaaccctgtcaaaaatactccggggaaacaaaaaa

SEQ ID NO: 53935 - DNA, 640 bp, Zea mays
  misc_feature: Ceres CLONE 1476886-F
  misc_feature (347)..(347): n is a, c, t, g, unknown, or other
  misc_feature (521)..(521): n is a, c, t, g, unknown, or other
  misc_feature (538)..(538): n is a, c, t, g, unknown, or other
  misc_feature (542)..(542): n is a, c, t, g, unknown, or other
  misc_feature (544)..(544): n is a, c, t, g, unknown, or other
  misc_feature (545)..(545): n is a, c, t, g, unknown, or other
ctccccgcggtggcggccgctctagaactagtggatcccccgggctgcaggaattcgtctcacccctagaaaaacccgccccaccaaacactcccgcagacccacccgtccccgtccgtccacagccagctccgcctcccatccagcgcccgtccacagccaccacagttccagtgagatcgagcgaggtaagcttagatctgagcgatttctctcgcgcgtcgcaggtaaagttcactcgacttcgactctctcatcctcttctgttcttcctggttccgtcttcttcctcgagcagacagcgagagacccgtggccttttagatcccgggcttcagatctgctgnttcttcttcgggtttggtctagttctagcagtgtactactactagtcgttagggtggtagcccaagagaggtctttttccacacctcccttgcgcaagtgagtcctgtcctgagcggatctacccaccactgccatctgttttttactgtggctggtgggttcccgcagtttcnttcgttgggtctggttngctngnngggggaaaaccaaaaaacaaaaaaaccgtctagatggctgctgctatagatctgtcaggggaggagctgatgagagcactcgagccttttatcgg

SEQ ID NO: 53936 - DNA, 700 bp, Zea mays
  misc_feature: Ceres CLONE 1476888-F
  misc_feature: Encodes the peptide sequence at SEQ ID NO. 53937
aaagctggagctccccgcggtggcggccgctctagaactagtggatcccccgggctgcaggaattcgtctcacccctagaaaaaacttctgtacccaatcagaagagcggcggcgcgggcggacaaggagcaggcggaggaggagttgtgccaagccacaatgggtatctcgcgtgactcgatgcacaagcgccgagccaccggtggaaagcagaaggcctggaggaagaagcgaaagtatgagcttggtcgccagccagccaacaccaagttgtcaagcaataagacggtgaggagggtccgtgttcggggaggtaatgtgaaatggagggctcttcgccttgatactggtaactactcatggggaagtgaagctgttacccgcaagacccgtatcctcgacgtggtctacaatgcatcaaacaatgagcttgtgaggacacaaatccttgtgaagagtgccatttgtgcagttgatgctgccccatttcagcagtggtacctcactcactattgagttgacatgtgtaggaagaaaaaacccctgctgcaaagaaggaaatgcttgaggacaaaagttgaggctccccctggggaaaccaaaaaaccccccttgtcccagaacctttgaaaccccaggagggacctccccttgcccccacatttggaacaatttggcaggaccgttttttgctttttt

SEQ ID NO: 53937 - protein, 118 aa, Zea mays
  misc_feature: Ceres CLONE 1476888-F
  misc_feature (1)..(119): Pfam Name: Ribosomal_S8e Pfam Description: Ribosomal protein S8e
MGISRDSMHKRRATGGKQKAWRKKRKYELGRQPANTKLSSNKTVRRVRVRGGNVKWRALRLDTGNYSWGSEAVTRKTRILDVVYNASNNELVRTQILVKSAICAVDAAPFQQWYLTHY

SEQ ID NO: 53938 - DNA, 697 bp, Zea mays
  misc_feature: Ceres CLONE 1476892-F
  misc_feature: Encodes the peptide sequence at SEQ ID NO. 53939
  misc_feature (546)..(546): n is a, c, t, g, unknown, or other
agagctggagctccccgcggtggcggccgctctagaactagtggatcccccgggctgcaggaattcgtctcacccctagaaaaaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcagacgccgtcgtacctgaccggcgagttccccggcgactacgggtgggacaccgcgggcctctcggccgacccggagacattcgcgcgcaaccgggagctgggagtgatccactcccggtgggcgatgctggccgcgctgggctgcgtgttcccggagatcctggccaagaaacggcgtcagttcggcgaagcggtgtggttcaaggcngcgcgcaaacctctcggaaggcgggctggactacctgggggaccccaaccctggtgcagcccaaagcatcttgcccattggggcttgccaggggggctcatgggcttcttccagggttaccggttggcgggggcccgcttgggaaagggct

SEQ ID NO: 53939 - protein, 178 aa, Zea mays
  misc_feature: Ceres CLONE 1476892-F
  misc_feature (59)..(178): Pfam Name: Chloroa_b-bind Pfam Description: Chlorophyll A-B binding protein
MAASALHQTTSFLGQALVSRAAGVDAGGRITMRRTVKSVPQSIWYGPDRPKYLGPFSEQTPSYLTGEFPGDYGWDTAGLSADPETFARNRELGVIHSRWAMLAALGCVFPEILAKKRRQFGEAVWFKAARKPLGRRAGLPGGPQPWCSPKHLAHWGLPGGLMGFFQGYRLAGARLGKG

SEQ ID NO: 53940 - DNA, 654 bp, Zea mays
  misc_feature: Ceres CLONE 1476898-F
  misc_feature: Translation starting site: 205
  misc_feature: SWISSPROT Homolog: EC 5.4.2.2 Phosphoglucomutase
  misc_feature (395)..(395): n is a, c, t, g, unknown, or other
  misc_feature (396)..(396): n is a, c, t, g, unknown, or other
  misc_feature (399)..(399): n is a, c, t, g, unknown, or other
  misc_feature (413)..(413): n is a, c, t, g, unknown, or other
aagctggagctccccgcggtggcggccgctctagaactagtggatcccccgggctgcaggaattcgtctcacccctagaaaaacaccaccactccttccctgccctctcactcccgatccctcctccaccaccgcttcctccgcgtcacccctctcgtcgtcgcctcacgaggcgaccagcggcggaccctccgcggcgcaaccatggggctcttcactgtgacgaagaaggccaccacgcccttcgacggccagaagcccggcacctccggcctccgcaagaaggttactgtattccagcagccccattatctgcagaactttgtccaatcaacattcaatgcccttcctgtggatcaagtaacacccccaccaagtggggggggggggggatnnccnctatttctcaaaanatcccccccaaatcataacaaaaatggctgctgccaatggagtaagacgtgtttgggttggacaaaacaggctcatgtctactcctgctggatctgctgtcatccgagaaagagttggggcagatggatcaaaggctactggcgccttcatcttgacggcgagccataacccgggggggcgctaagggggactccgggatcaagacaccatgggaaatggggggcccgctccggaagccgg

SEQ ID NO: 53941 - DNA, 685 bp, Zea mays
  misc_feature: Ceres CLONE 1476903-F
  misc_feature: Encodes the peptide sequence at SEQ ID NO. 53942
aaagctggagctccccgcggtggcggccgctctagaactagtggatcccccgggctgcaggaattcgtctcacccctagaaaaagcgaccccaggtcagtcgggactacccgctgagtttaagcatataaataagcggaggagaagaaacttacgaggattcccctagtaacggcgagcgaaccgggagcagcccagcttgagaatcgggcggcctcgccgcccgaattgtagtctggagaggcgtcctcagcgacggaccgggcccaagttctctggaaagggacgcctgggagggtgagagccccgtccggcccagaccctgtcgcaccacgaggcgccgtcaacgagtcgggttgtttgggaatgcagcccaaatcgggcggtaaactccgtccaaggctaaatacaggcgaggctgcttcgcaacggtgccgcggcttcggacagggctctcgcgacgcgatcggccatggcggcgtctctgcgggcctcgtcctccctccgctcgcgcctcctctcgttctcctcggggtgttctctgtgtccgtggcgtctcctcctctcctcacctgtccactcggacgccccccaccagaccgaaaccctcgctttcgacgagatccagctgtcgccggagaagccggctaccgccactgccttcgtcctgcacggcctcctcggtt

SEQ ID NO: 53942 - protein, 71 aa, Zea mays
  misc_feature: Ceres CLONE 1476903-F
MAASLRASSSLRSRLLSFSSGCSLCPWRLLLSSPVHSDAPHQTETLAFDEIQLSPEKPATATAFVLHGLLG

SEQ ID NO: 53943 - DNA, 697 bp, Zea mays
  misc_feature: Ceres CLONE 1476904-F
  misc_feature: Encodes the peptide sequence at SEQ ID NO. 53944
tggagctccccgcggtggcggccgctctagaactagtggatcccccgggctgcaggaattcgtctcacccctagaaaaaatcgcagccagcagcctcatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatcgtggagcagtcggtgtcgccgggcggcggcgcgtggctgggcgggcagctgttctcggccatggtggtgcgcaagccggcgcacctgttcctggacgagctgggcgtggcgtacgacgaggccgaggactacgtggtcatcaagcacgccgcgctcttcacgtccacggtca

SEQ ID NO: 53944 - protein, 175 aa, Zea mays
  misc_feature: Ceres CLONE 1476904-F
  misc_feature (64)..(175): Pfam Name: Thi4 Pfam Description: Thi4 family
MATAAASSLLKSSFAGSRLPAATRTTPASLVVATGPRGAGAGPICASMSMSSSNPPYDLTSFRFSPIKESIVSREMTRRYMTDMITYADTDVVIVGAGSAGLSCAYELSKDPAVSIAIVEQSVSPGGGAWLGGQLFSAMVVRKPAHLFLDELGVAYDEAEDYVVIKHAALFTSTV

SEQ ID NO: 53945 - DNA, 658 bp, Zea mays
  misc_feature: Ceres CLONE 1476907-F
  misc_feature: Encodes the peptide sequence at SEQ ID NO. 53946
  misc_feature (400)..(400): n is a, c, t, g, unknown, or other
  misc_feature (477)..(477): n is a, c, t, g, unknown, or other
  misc_feature (658)..(658): n is a, c, t, g, unknown, or other
aaagctggagctccccgcggtggcggccgctctagaactagtggatcccccgggctgcaggaattcgtctcacccctagaaaaagtccccagatccgccccgcccgacgcgagatgctcgtccaggaccgcgcgtccccgcacgcggccgccgcaggccagaagccgtcctcgtcccctcgcggcgcgccgggggcggaccgccggcacccgcggcccttcgccaagaacctcgacttcgccacatgggcgtccgagcactcctccaagctcctgctcctcctcctcgcgatcgcatccgccgccgccgtcttcctcctgcgcggcgcggcccccgacgccgccgcgctgctctgcctcgaccgctccgcccgctcgcgctcgggcgcccccgccagctncccgtaccggacgtcgcctggtccaaggtccgcctctcgcgatcgctgcgggtagccccttcgcgtcattccgggcnggagcgtggatcgtggtcgctgtctcgtccccacctaccgcggcgctggccgcgctcgcccgcgtcaagggctgcagctcctcgccgtcggcgattccacacgcccggagggtgggagctttaggccgccctcttcctcttcctcgagctgcaggacagctcggataccgctccgtcgacn

SEQ ID NO: 53946 - protein, 113 aa, Zea mays
  misc_feature: Ceres CLONE 1476907-F
  misc_feature (96)..(96): Xaa is any aa, unknown, or other
MLVQDRASPHAAAAGQKPSSSPRGAPGADRRHPRPFAKNLDFATWASEHSSKLLLLLLAIASAAAVFLLRGAAPDAAALLCLDRSARSRSGAPASXPYRTSPGPRSASRDRCG

SEQ ID NO: 53947 - DNA, 654 bp, Zea mays
  misc_feature: Ceres CLONE 1476908-F
  misc_feature: Pfam Name: Ion_trans Pfam Description: Ion transport protein
aagctggagctccccgcggtggcggccgctctagaactagtggatcccccgggctgcaggaattcgtctcacccctagaaaaaatccaagctcaaacttaggggtttttggtcgaggagatctcatcacagatcctaaggaaatcgcaaagcagtacttgagatctgactttgttgttgatttggtggcttctttgcctttaccacagatcattatttggtctgtgataccagctatcaaatattcttcgtctgagcatggcaatgacatgctgcttctggttgctcttttccagtatatcctaagattatacctcatattttccttgaacgataaaatcgtcaaaattactggggtgtttgcaaagactgcttggcatggggctgcctacaacctgctgttatacatgattgctagccatgttttaggagcgttgtggtaccttctatctgttgatcgtcagattgcgtgctggaaaaacttttgcgatgaaactgattgccacactcgatatctatattgtgatgtaaaaccagattcaatgtggaatgggacctcagtcttttctacttgtaatgctaagaacagtaccaaatttgactttggtatgttccagccactgttagcaaacaaaactcctaacgagagcttcct

SEQ ID NO: 53948 - DNA, 740 bp, Zea mays
  misc_feature: Ceres CLONE 1476914-F
  misc_feature: Encodes the peptide sequence at SEQ ID NO. 53949
agagctggagctccccgcggtggcggccgctctagaactagtggatcccccgggctgcaggaattcgtctcacccctagaaaaaaatcttccattcctcctctctccttccctgtgtctctctcctcgcgagctcttcatcccttcttccagcgcggtttggcgatggcggcagcgcaggcgatctcgaaggggagcgtggtgtctccatgcggcaatcgagcggcgccgggcttccttgccaggcggaggggtgccgtggcggcgcggatggcaccgtcagcggcgcggatcggtggcttctggaggaagaacgcgtttcctggcgggaggctaaccctgaggacgaggagatccagggccgcgtcaccgacgcagatgaacatgacccttgcgcttggggaaatcgatgaccgtggtgggagaaggggtttgcagccccacttgcgtgagatcgagtccgccccaaaaccttgtcgattgcttgaaccaaagccgtgggaagggtttgttgtctttaaaattcttttttctcgggttggcggggtttgccgggtttttccccccaaattttgccatttggggaaagaaaatcccaaagggcgtgtttttgaaagggaaaaaacgagggaccaccattttttgggcccacccttttaggtccttttccccccccttttaaaaattcccgggggggaacagggggcaaacctcttgagttcttttggacacccccccaac

SEQ ID NO: 53949 - protein, 164 aa, Zea mays
  misc_feature: Ceres CLONE 1476914-F
MAAAQAISKGSVVSPCGNRAAPGFLARRRGAVAARMAPSAARIGGFWRKNAFPGGRLTLRTRRSRAASPTQMNMTLALGEIDDRGGRRGLQPHLREIESAPKPCRLLEPKPWEGFVVFKILFSRVGGVCRVFPPKFCHLGKENPKGRVFEREKTRDHHFLGPPF

SEQ ID NO: 53950 - DNA, 700 bp, Zea mays
  misc_feature: Ceres CLONE 1476925-F
  misc_feature: Translation starting site: 173
  misc_feature: SWISSPROT Homolog: EC 5.2.1.8 Peptidylprolyl isomerase
aagctggagctccccgcggtggcggccgctctagaactagtggatcccccgggctgcaggaattcgtctcacccctagaaaaaggcagaaccgcagaagtgcagcagaacgatcggatctagcagaattctctcaacctcatcggcggcggcgaagagcgtgcggatcggagatggagacaagcgggtggaggaggagagcggcggcgcgggcctcctggagccccgccacggtgtacctgtggctcgcgctcgccgcagcagcactgacgctcgcccaggctaagaaggacctaacggaggttacccacaaggtctacttcgatgtcgagattgacggcaagcccgcaggtcggattgtcatggggctttttgggaagactgttcctaagacagcagagaacttccgagctctttgcacaggagagaaaggaattggcaagagtggcaaagctctccactacaagggaagtacattccacagaatcattcccagcttcatgctccaaggaggtgacttcactcttggggatgggagggggtggtgaatctatctatggcatgaagtttgctgatgagaacttcaagatcaagcacactggaccaggccttctgtccatggccaatgctgggagagatacaaacggatctcagtttttcatcaccaccgtgacaacaagctggttggacgggaagcatgt

SEQ ID NO: 53951 - DNA, 1890 bp, Zea mays
  misc_feature: Ceres CLONE 1476928
  misc_feature: Encodes the peptide sequence at SEQ ID NO. 53952
acggaacacacagctcgtgcaggcagattccagatatacgcgcgcgcgaaagacacacggtgaccagggggtcgactgcgcgtacaacgccttggcgtcgttgccacgcccacggccgggccaccggcacggtgtcgccgcgcgcttttccgtcttctattccacgcagtaggcggaaagactctgcccgcagcctcaccctgcactgcagccagcgacggcgcgagtccttgcgtgcgtctcccgccctcccaccctctcgccttgctttcctcagcgccttcgatctctctctcccctcgccactggtagccatatttggtggcagcgagcaccgcgcagcgcgtcggcatggggatcaggaggcggcaggacgctgcagccatcttggggctcctgaagctcttcctcttccgcttggcggcgtcgcagtcgttcatcggggtcaactacgggacgatcgcggacaacctgccgccgccggcgtcgacggccagcctcctcatgtcgacgtccatcgccaagctccgcctgtacgagccacagccggacctggtcgcggcgctcgcgggctccaacatctccatcctgctgggcatacccaacggcgccgtcccgaacctcgcgtcctccccggccgccgccgcgtcctgggccgccgccaacatccccaccacgcttcccgtctcctccatctccgtcggaaacgagctgctcaactccggcgaccccacgctcgcgccccagctcctccccgccatgcagaacctgctcgccgcgctcccggctggctcgaccaccaagatctccaccgtgcactccatggccgtgctgtcggcgtcggacccgccgtcctccggcgcgttccacccggacctcgccggcagcctggacccggtgctggacttcctgcaccagaacggcgcgccgttcatgatcaacccgtacccctacttcgcgtacgcctccgacacgcggccggagacgctggccttctgcctgttccagcccaacgcgggccgcgtcgacgccgtgtcagggctcacctacaccaacatgttcgacgcgcagctggacgctatccgcgcagcgctggacgccaaggggtacagcgacgtggagatcgtcatcgccgagaccgggtggccgtacaagggtgacgccgacgaggccggcgccacggtggacaacgccaaggcctacaacagcaacctcgtggcgcacctcaagtcccaggtcggcacgccgcggacgccaggcaagtcggtggacacgtacatcttcgcgctctacgacgaggacctcaaggggggcccggagtccgagcgctccttcgggctgtacaagactgacctgacggcgaactacgacgtcgggctcgcaaaagacaatggcacggcggccccgaccagcttgactccggttccggcacagggcacgccgcagccgagcaaagggacgatgccgacggggtactgcgagaccacgtccgccgtgcccggcaccacgcaaggccaacagttgccgcagagcagctcgtgctacattcccggcggagctgagtcgcggcacgccacatggcagcttgttttattgggtgttttgatgtgcttggtcaaggtagccggcatctagttacaacatctgtgtgcgacggaacgagtacagggttcgctctccacagttgtgcgtatggattcaccactgtaatagaattcacgaaagctgctaggcacgatcgaatgttgagccacacggttgcactgctttggcctccacagctccacttgcaactccttttatgaatgatagcacaaataaaatttccgaagccaaaaaaaaaaaaaaaaaaaaaaaaaaaaaaaaaaaaattaaaaaaaaaaaaaaaaa

SEQ ID NO: 53952 - protein, 427 aa, Zea mays
  misc_feature: Ceres CLONE 1476928
  misc_feature (30)..(343): Pfam Name: Glyco_hydro_17 Pfam Description: Glycosyl hydrolases family 17
  misc_feature: SWISSPROT Homolog: EC 3.2.1.39 Glucan endo-1,3-beta-D-glucosidase
MGIRRRQDAAAILGLLKLFLFRLAASQSFIGVNYGTIADNLPPPASTASLLMSTSIAKLRLYEPQPDLVAALAGSNISILLGIPNGAVPNLASSPAAAASWAAANIPTTLPVSSISVGNELLNSGDPTLAPQLLPAMQNLLAALPAGSTTKISTVHSMAVLSASDPPSSGAFHPDLAGSLDPVLDFLHQNGAPFMINPYPYFAYASDTRPETLAFCLFQPNAGRVDAVSGLTYTNMFDAQLDAIRAALDAKGYSDVEIVIAETGWPYKGDADEAGATVDNAKAYNSNLVAHLKSQVGTPRTPGKSVDTYIFALYDEDLKGGPESERSFGLYKTDLTANYDVGLAKDNGTAAPTSLTPVPAQGTPQPSKGTMPTGYCETTSAVPGTTQGQQLPQSSSCYIPGGAESRHATWQLVLLGVLMCLVKVAGI

SEQ ID NO: 53953 - DNA, 662 bp, Zea mays
  misc_feature: Ceres CLONE 1476932-F
  misc_feature: Encodes the peptide sequence at SEQ ID NO. 53954
  misc_feature (222)..(222): n is a, c, t, g, unknown, or other
  misc_feature (267)..(267): n is a, c, t, g, unknown, or other
  misc_feature (365)..(365): n is a, c, t, g, unknown, or other
ctccccgcggtggcggccgctctagaatagtggatcccccgggctgcaggaattcgtctcacccctagaaaaaaccgactcacactcacacagcaaataccccacaaggccactccaaagagctagtagtggaaccgaagatgttcgggaacatcggaaagatccccatcatcggcgacctgacgggcagcaacaagaatgcgcaccctcaggggcacgtgntgctcgtgcgcaagaccgtgctcggcttggacgtcaccagcatcngcggcttcctcctcgacggcgtcggcgaagttctcggccgcggcgtcacctgccagcttatcagctccacggtcgtggaccctaacacggcaaccgcnggaagttggcgcccaggccaacctggaacatggttcttaacccccccccttttttgcaggaaaacctttccggtcaccttccctgggagggggaaaaaggggttccccgggccctttttttaaaaaaacccccccctcggtttttcctaaaaaattcccctaaaaagggccccgggcaggaacctttttttttccccaaatttggtgtctcccgcgcgaaaaaagccttaaacacgtttttttttttaaaaaaattgtttccctcccgaggagggggggggggtgtaaacccccacg

SEQ ID NO: 53954 - protein, 115 aa, Zea mays
  misc_feature: Ceres CLONE 1476932-F
  misc_feature: SWISSPROT Homolog: EC 1.13.11.12 Lipoxygenase
  misc_feature (28)..(28): Xaa is any aa, unknown, or other
  misc_feature (43)..(43): Xaa is any aa, unknown, or other
MFGNIGKIPIIGDLTGSNKNAHPQGHVXLVRKTVLGLDVTSIXGFLLDGVGEVLGRGVTCQLISSTVVDPNTATAGSWRPGQPGTWFLTPPLFCRKTFPVTFPGRGKKGFPGPFF

SEQ ID NO: 53955 - DNA, 707 bp, Zea mays
  misc_feature: Ceres CLONE 1476935-F
  misc_feature: Encodes the peptide sequence at SEQ ID NO. 53956
aaagctggagctccccgcggtggcggccgctctagaactagtggatcccccgggctgcaggaattcgtctcacccctagaaaaaatgccattcaagcgttctacggctccaatttctctgacttctccctgagcctttgcggccggctggagctggacggtccccgggcagcgcaggcagccggactgcgggagtcacctccatggcctcggctgctactgcaaccctccccaaggttcagttgaggccaagatgcaacagctactttcaggtgaccggtcaagtccatgcccacaccaaaacatgcgttgcctgcaagtgtccgacccatatccacgggttgcttgtttcagctggaggaaggaggacattcctgccggtgtctgcagttggatcaggtcagggctcatcggtcactgaggccgacaggaagagcgatttgtcgctggagaacgtcaagacgtccgttgtatcccgcgacgatgaaaagattaatgtacgagtgcagttgcctggaagggcgacgcaaaaggtgtttgatgaggctctgacgttcttggcccgtgatgcggccaccgtttcctgtttttaggaatccaaaggagggaaaacatcaaatttaccccgcagcatcctgctgaaaatgctttggcagaaccgggtcaacaaaattgttcttcaggaaaatctggaccccccccctgaaa

SEQ ID NO: 53956 - protein, 129 aa, Zea mays
  misc_feature: Ceres CLONE 1476935-F
MASAATATLPKVQLRPRCNSYFQVTGQVHAHTKTCVACKCPTHIHGLLVSAGGRRTFLPVSAVGSGQGSSVTEADRKSDLSLENVKTSVVSRDDEKINVRVQLPGRATQKVFDEALTFLARDAATVSCF

SEQ ID NO: 53957 - DNA, 691 bp, Zea mays
  misc_feature: Ceres CLONE 1476936-F
  misc_feature: Encodes the peptide sequence at SEQ ID NO. 53958
aaagctggagctccccgcggtggcggccgctctagaactagtggatcccccgggctgcaggaattcgtctcacccctagaaaaaaggacgacgaccggtcccattccccccgccccaacttgtcaggactcaagaggctcccctcctccctcgccgcggaacacgcgcgccgtcgtcgccagcccgggttcatttctccgttccttggtgcggaggtagccgagcgctccggccatggcgttctatcggggcctcaccgcagtctcgagactgcgatcacgcatggcgcaggaggccaccacgctggggggtgtgaggtggctgcagatgcatagcgcgtccgatctcgatcttaagtcccagttgcaggaattgattccggaacaacaggatcgcttagagaagctcaagtcagagcatggaaagacccagcttggaaacataactgtggatatggtcctaggtggaatgagcaggatgactggtatgctttggcgaacatccctacttgatccagaggacggtattcgtcttaggggcctctcaatgcaagaatggcaaaaagtgctgccaacagcatttaaagccggcgaacctttgcctgagggtctcccttgggcttcttttgaccgggaatgtcccatctaaagaacaagttgatggcttaacaagggattggcttgccccctag

SEQ ID NO: 53958 - protein, 137 aa, Zea mays
  misc_feature: Ceres CLONE 1476936-F
  misc_feature: SWISSPROT Homolog: EC 2.3.3.1 Citrate (Si)-synthase
MAFYRGLTAVSRLRSRMAQEATTLGGVRWLQMHSASDLDLKSQLQELIPEQQDRLEKLKSEHGKTQLGNITVDMVLGGMSRMTGMLWRTSLLDPEDGIRLRGLSMQEWQKVLPTAFKAGEPLPEGLPWASFDRECPI

SEQ ID NO: 53959 - DNA, 686 bp, Zea mays
  misc_feature: Ceres CLONE 1476938-F
aaagctggagctccccgcggtggcggccgctctagactagtggatcccccgggctgcaggaattcgtctcacccctagaaaaatcccttcactccccatgtccatctttcgcaccccgacacaaaatgctaagtcgtctctcggatcaaggtgatgagcgagaagcaacatgtcgtgtgaagcattgctcattgacgacctgttttgccatgtcgactgatgggccctctacgcctgctgcatcatacgttgctacggacgctgctggtctcggtccgactactttgccgagattcatcctgactacgtgtgctggaattacttgagacttcgatctctctgaaactcttgtccccactggtcattttgcttgacctcctaggtatatgcagatccaatgtcaagctgacaatcccatcccagaacagagagtcgcttgatcttgtctctcgagtagactggcatgtccttgattatcttgatctgttatgatccaatgactccattgcaatgccttatggtggtgcagaggctctgttatcacctgatcctacatggactactcagtgtgtgccttggcctgatgaatcactgcctccaagatgtggagctgaatctatgcatccattcctctgatatgtggcgatgaccactttcttcgtattttggcatcctaactactacgt

SEQ ID NO: 53960 - DNA, 709 bp, Zea mays
  misc_feature: Ceres CLONE 1476945-F
  misc_feature: Encodes the peptide sequence at SEQ ID NO. 53961
aagctggagctccccgcggtggcggccgctctagaactagtggatcccccgggctgcaggaattcgtctcacccctagaaaaaagctcattaccacctccgcctccgcgatcgaagctcctcacaaaccgttatcgtcgccatggcagccgccgcgcctgcaagctccgtgaaggaagtgctgccatctcccctgacctccgcctccgagccccctcccctcttcgatggcaccaccaggctgtacgttgcctatcattgcccgtacgcgcagcgcgcttggattgccaggaactacaagggtttgcaggacaagattaagatagtcgccatcgatcttgctgacaggccaacatggtacaaggagaaggtttatccagaaaacaaggtgccttctctggagcacaaacaccaggtgaaaggtgagagtttggatctggtcaagtacattgacagcaactttgaaagcccatcgttgctcccagaggatcttcaaaaaaacagttccgctgaagagctgcttgcatatactgatgcatttacaaagcaataaacttttggaaaatcctcaaggaaaaagttcctgaggaaacttgccctgcctttggaaaaaaaaaaaaaagccctccgggaaaattaaccaggggcccatcccccttgggccaattcaatccgggggaacattgcctttggtcccttccccggaaggg

SEQ ID NO: 53961 - protein, 136 aa, Zea mays
  misc_feature: Ceres CLONE 1476945-F
  misc_feature: SWISSPROT Homolog: EC 2.5.1.18 Glutathione transferase
MAAAAPASSVKEVLPSPLTSASEPPPLFDGTTRLYVAYHCPYAQRAWIARNYKGLQDKIKIVAIDLADRPTWYKEKVYPENKVPSLEHKHQVKGESLDLVKYIDSNFESPSLLPEDLQKNSSAEELLAYTDAFTKQ

SEQ ID NO: 53962 - DNA, 661 bp, Zea mays
  misc_feature: Ceres CLONE 1476946-F
  misc_feature: Encodes the peptide sequence at SEQ ID NO. 53963
aaactggagctccccgcggtggcggccgctctagaactagtggatcccccgggctgcaggaattcgtctcacccctagaaaaagagcgtctcagggacgggttgactctttctggccgcatcagcggccggctattcttcttgtccggctatccgttccaggacttcggattaagaggcgacgagatgttgcggcgatgcgtctcggcgttggcccgcggcgccgtccagatcgcacggttgatactatgaaggcacgattccaatggttgggtaacattttctcttcaataagggacactgacagccaaaggtgctcaagtacgtgtgctaattcctgtgctaccgatccagatgttttatcgagagaaacatcgtcatcagaaatgcttgttaattcatttgggaggttcccacattacttgaggatctcctttgaccaacgcttgtacctgaggtgcccagtctgtatgcctgcttaaggatttaaactacccccaagtcagagcttctggtccatgaataaaataattcgaatcccgaactttttttttacctccggggggaaaaagatccgacttaagtgggggaaaaccccccccaccaaaaaaatttgagaaaatattttttttcccccttttcaggtgtgaagggcctgggaa

SEQ ID NO: 53963 - protein, 94 aa, Zea mays
  misc_feature: Ceres CLONE 1476946-F
MRLGVGPRRRPDRTVDTMKARFQWLGNIFSSIRDTDSQRCSSTCANSCATDPDVLSRETSSSEMLVNSFGRFPHYLRISFDQRLYLRCPVCMPA

SEQ ID NO: 53964 - DNA, 682 bp, Zea mays
  misc_feature: Ceres CLONE 1476948-F
  misc_feature: Encodes the peptide sequence at SEQ ID NO. 53965
aaagctggagctccccgcggtggcggccgctcttgcaacagtggatcccccgggctgcaggtattcgtctcacccctagaaaaaaactggcaaccaccacactacaactcgacaccgagaaaagcgcagcaaagcaacgcaaagcccacgccgctacagtgctacagcgagcgagcctcttgcctgccgctacgagccaacgactcgaacgcatacactccaatggcagcgacggtgatggcctccatgagcccactcgcctccgccacccccggcgcgcgtcgcgctttccctgtacggctgctgctccaggcatctgcgctcgcgccgcgccggcgcgccttggccgtgaccgtgagggcccagagcgacgacgcccaggccgagccaaaggaggaggcggcggcggccaccaccccggcgccaacgtccaaggcggcggcggcggcgagccccgggctgtgggacgcgctggcgttcagtggcccggctcccgagcgcatcaacggccggctcgccatggtgggcttcgtgtcagcgctcgccgtcgaggcggctcgcggcgggggcctactctcgcaggccggcagcgggtacgggcttgcctgtgtcgcggccacggctgccgtgccgtccgtggcctcgctggtgccactgctcaagggagacagcgcctaggcca

SEQ ID NO: 53965 - protein, 151 aa, Zea mays
  misc_feature: Ceres CLONE 1476948-F
MAATVMASMSPLASATPGARRAFPVRLLLQASALAPRRRALAVTVRAQSDDAQAEPKEEAAAATTPAPTSKAAAAASPGLWDALAFSGPAPERINGRLAMVGFVSALAVEAARGGGLLSQAGSGYGLACVAATAAVPSVASLVPLLKGDSA

SEQ ID NO: 53966 - DNA, 825 bp, Zea mays
  misc_feature: Ceres CLONE 1476953-F
  misc_feature: Encodes the peptide sequence at SEQ ID NO. 53967
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (468)..(468): n is a, c, t, g, unknown, or other
  misc_feature (472)..(472): n is a, c, t, g, unknown, or other
gtggggcccatatttggtgggttgtgagtgggttttttnnnnntnnnnnnnccaagctggagctccaccgcggtggcggccgctctagactagtggatcccccgggctgcaggaattcgtctcacccctagaaaaactcccgtcagccactcctctatcggtgacgcacgcaccccccacctctgatctgatctctccccctggatctcgacctccgcctggctgctccgctctgcgtcgctcgccatggcgtcctcgacggggagcttggagcacggggggttcacgttcacgccgccgcccttcatacactcgttcacggagctgctctctggggcagcagccgaattgggtaggagccgccgggccccaatcatcaggagccggcccccgagggggcttttccaccccgggcgccaccagggggggggggggggggggggggcccaaatttaaagtcccnnnaanaccncccaacccccccccattcttggcgggcgggggaatgggcccccctccttcctaactttctcaatcccccgcccgggggttttaagccccccgcggaaggttggtggggattcccccccggttccttgggtccccttttttcccctcaaaaattttttttggggggcggcccccaccacccgcgggggccatttccgcggggggcaaaaagggttcccagcctggggaaagcgaaggccgcccacaaaccttgaattccgcgtctctcaatccctccaacaaaaaaacaaacaggcccggggggtgtgggggtttcttcaaacaccccctttttataagaggattttcttcccg

SEQ ID NO: 53967 - protein, 69 aa, Zea mays
  misc_feature: Ceres CLONE 1476953-F
MASSTGSLEHGGFTFTPPPFIHSFTELLSGAAAELGRSRRAPIIRSRPPRGLFHPGRHQGGGGGGGAQI

SEQ ID NO: 53968 - DNA, 712 bp, Zea mays
  misc_feature: Ceres CLONE 1476959-F
  misc_feature: Encodes the peptide sequence at SEQ ID NO. 53969
  misc_feature (416)..(416): n is a, c, t, g, unknown, or other
  misc_feature (417)..(417): n is a, c, t, g, unknown, or other
aaagctggagctccccgcggtggcggccgctctagaactagtggatcccccgggctgcaggaattcgtctcacccctagaaaaaccattcgcaccaccgccgcgccgcccaaatcacagccaccgccgccatgtccgcctccagccgccctctcgtctccgtgaaagccctggagggcgacatggtcacggacgcccccggcatcgccttgccgcccgtcttcggtgcgccgatccgcccggacgtggtccgcttcacccacaagctgctgtcctgcaacaagcgccagccttacgcagtctcccgccgcgctggccaccagacgtcggccgagtcctggggtacgggccgcgctgtgtcccgtatcccccgcgtccccggcggcggcacccaccgcgccggccagggagcattcnnccacatgtgcccgcggcgacgcatgttcccgccaccaagatttggcgcaagtggacccgccgcgtcaagttaacctccgccggttcccctccccttggggttcgccgcccccgcgtcccggcccttgtcaagggcgggggccccgaattaaaccggtcccaaaaagccccgggcattccccactccggggaaccttcaaaaaaacccccggggctaaaaatcccaaggggggcgggccctcccccaccccaaaaaggcagggcccctcgggtctcccccccgaaggaaaaaacac

SEQ ID NO: 53969 - protein, 119 aa, Zea mays
  misc_feature: Ceres CLONE 1476959-F
  misc_feature (96)..(96): Xaa is any aa, unknown, or other
MSASSRPLVSVKALEGDMVTDAPGIALPPVFGAPIRPDVVRFTHKLLSCNKRQPYAVSRRAGHQTSAESWGTGRAVSRIPRVPGGGTHRAGQGAFXHMCPRRRMFPPPRFGASGPAASS

SEQ ID NO: 53970 - DNA, 682 bp, Zea mays
  misc_feature: Ceres CLONE 1476979-F
  misc_feature: Encodes the peptide sequence at SEQ ID NO. 53971
aagctggagctccccgcggtggcggccgctctagaactagtggatcccccgggctgcaggaattcgtctcacccctagaaaaagctcgtgccagcgcccagcaggccattctgctcgccttactccctcacagaacccagtaaaatattgccagtcccgccgtcgagatggccccacgccgcctgctcgtcctcgccgtcctcgccctcgcggccaccgccgccgcggccaactccggcttcgcggactccaacccgatccgccctgtcaccgaccgcgcggcctccgcgctcgagtccacggtcttcgccgcgctcggccgcacccgcgacgcgcttcgcttcgcacgcttcgccgtcaggtacggcaagagctacgagagcgcggcggaggtccataagcggttcaagatcttctccgagagcctccagctggtccgctccaccaaccgcaaaggcctctcctaccgcctcggcatcaaccgcttcgcggacatgagctgggaggagttccgtgcgacccggctcggcgcagcccagaactgctccgccacgcttaccggcaaccaccggatgcgcgccgccgccgttgcgctgccggagacgaaagactggagggaggatgggattgtgagcccagtgaacagcagggccactgtggatcatgctggaccttcagcact

SEQ ID NO: 53971 - protein, 171 aa, Zea mays
  misc_feature: Ceres CLONE 1476979-F
  misc_feature (59)..(115): Pfam Name: Inhibitor_I29 Pfam Description: Cathepsin propeptide inhibitor domain (I29)
  misc_feature: SWISSPROT Homolog: EC 3.4.22.16 Cathepsin H
MAPRRLLVLAVLALAATAAAANSGFADSNPIRPVTDRAASALESTVFAALGRTRDALRFARFAVRYGKSYESAAEVHKRFKIFSESLQLVRSTNRKGLSYRLGINRFADMSWEEFRATRLGAAQNCSATLTGNHRMRAAAVALPETKDWREDGIVSPVNSRATVDHAGPSA

SEQ ID NO: 53972 - DNA, 712 bp, Zea mays
  misc_feature: Ceres CLONE 1476980-F
  misc_feature: Translation starting site: 382
  misc_feature (313)..(313): n is a, c, t, g, unknown, or other
  misc_feature (345)..(345): n is a, c, t, g, unknown, or other
  misc_feature (346)..(346): n is a, c, t, g, unknown, or other
  misc_feature (395)..(395): n is a, c, t, g, unknown, or other
  misc_feature (406)..(406): n is a, c, t, g, unknown, or other
  misc_feature (407)..(407): n is a, c, t, g, unknown, or other
atagctggagctccccgcggtggcggccgctctagaactagtggatcccccgggctgcaggaattcgtctcacccctagaaaaagcaaaccctgctccaactccgattcgtcactccaccctcgtcgcgccgccgccgccgccgccgcctgccgcgtccccggccagcctcgcggcccggtggtctgctagccacagcggagagaccaggagtcatggtgatccctccaccagcaagggcagctagagtcacccgtttcctcaagccctacctattgaggatgcatttctcaaacaagtatgtatctgctcangtcgtccacacccccacagcaactgttgcatnngtctgcagctcgcaggagaagctgttgagaccaacatggagtccaccgntgacgtcccanncactgcaaaaattgaaaagtgctcggcaaccccctgccctcaagggaatccctgcgggtccctcccctgaaaaaggacaaaaaccccctgggaaagggaggccccttttattttcctccaaaaaactgggaccaattgtgtggttttcgggtggaaaaaaagggggcttttttttgggggggggggggggtgtttcttttttgttgttattaaaaaaggggggggggttgttttgtttattatatgtgcgggaatttttccctcaaaaaaaaagttttttttgcccaaaaaaaaaaaaaaaaacg

SEQ ID NO: 53973 - DNA, 673 bp, Zea mays
  misc_feature: Ceres CLONE 1476981-F
  misc_feature: Encodes the peptide sequence at SEQ ID NO. 53974
  misc_feature (447)..(447): n is a, c, t, g, unknown, or other
aaagctggagctccccgcggtggcggccgctctagaactagtggatcccccgggctgcaggaattcgtctcacccctagaaaaagagccacggagagcaaaggcagcacactcagctatccagcaaaagagatcgagaggcaggagtcatggccaccgtcagcgccgccgtggtgaccaccatcgttgcccgcgccgcgatcgccaggcccaatgctctagggctgcctgcgctgagggcgaggagcgagagggtgcggtgcaactacgccaaggacgcggccccagtcagcaccaagggcgcaggcgcgtctctgctcaccgcaacgagcgcggtgaccgcctcgacagtgcccgctctggcgctcgtggacgaccgcatgtccacggagggcaccgggctgagcctctggctcagcaacaacctgctggggtggatcctcctggntgtcttcagcctcatctggtcgctctacaccatctacacgtctgacctcgacgaggacgatgagtccagtgcctctcactctagatgcacctcctctccctgtaatgatctgactgtaaacgatgtagctgtcatcggtgtaaattttgacatggctattagcatctaagatcctccctctcctgttaaaaaaaaaaaaaaaacgaggcgctcgatgtccctattg

SEQ ID NO: 53974 - protein, 155 aa, Zea mays
  misc_feature: Ceres CLONE 1476981-F
  misc_feature (1)..(126): Pfam Name: PsbW Pfam Description: Photosystem II reaction centre W protein, PsbW
  misc_feature (100)..(100): Xaa is any aa, unknown, or other
MATVSAAVVTTIVARAAIARPNALGLPALRARSERVRCNYAKDAAPVSTKGAGASLLTATSAVTASTVPALALVDDRMSTEGTGLSLWLSNNLLGWILLXVFSLIWSLYTIYTSDLDEDDESSASHSRCTSSPCNDLTVNDVAVIGVNFDMAISI

SEQ ID NO: 53975 - DNA, 679 bp, Zea mays
  misc_feature: Ceres CLONE 1476986-F
  misc_feature: Encodes the peptide sequence at SEQ ID NO. 53976
  misc_feature (560)..(560): n is a, c, t, g, unknown, or other
  misc_feature (604)..(604): n is a, c, t, g, unknown, or other
atagctggagctccccgcggtggcggccgctctagaactagtggatcccccgggctgcaggaattcgtctcacccctagaaaaagcattattatatatggatcggattgcttgctctcagcagccacacagtattgctcatggctgcttgtgttccgacggtggatgcggaggaagcatgcgccctcctcagctcttccacacaccactatctggatgtcaggatgtgggaggattttgacaagggccatgtcgccggtgctcggaatgttccctactacctctccgtcactccgcatgggaaggagaagaatccccagtttgtggaacaggtttccgcgctctacgccaaggaccaaaacttgattgtgggttgccgctctggcatccggtccaaactcgccactgcagacctcgtcaacgcgggcttcaccaacgtgaggaacctacaaggcggatacctttccttgctccgaagcgcaaactagctagcttcctgcttatttgttcgcatgcttgtaataagtgagtcaacatatgcttgaaagatctgttcatgangaagcagcatcaactccatcatgaaaaatgattaatgacactgncaatgtgcatacccaacaaaaaaaaaaaaaaaaacgagacgctcgaggtaccccattcgccctatagtgagtcgt

SEQ ID NO: 53976 - protein, 115 aa, Zea mays
  misc_feature: Ceres CLONE 1476986-F
  misc_feature (9)..(113): Pfam Name: Rhodanese Pfam Description: Rhodanese-like domain
  misc_feature: SWISSPROT Homolog: EC 2.8.1.1 Thiosulfate sulfurtransferase
MAACVPTVDAEEACALLSSSTHHYLDVRMWEDFDKGHVAGARNVPYYLSVTPHGKEKNPQFVEQVSALYAKDQNLIVGCRSGIRSKLATADLVNAGFTNVRNLQGGYLSLLRSAN

SEQ ID NO: 53977 - DNA, 709 bp, Zea mays
  misc_feature: Ceres CLONE 1476992-F
  misc_feature: Encodes the peptide sequence at SEQ ID NO. 53978
atagctggagctccccgcggtggcggccgctctagaactagtggatcccccgggctgcaggaattcgtctcacccctagaaaaaggcttttgcttgacttgcttcctcctctcccgtcgggcactcgggctcgtctgactgcgcccgggcgccgaatctccagacgggatcatgccccccatctgacgccacctgcgccggagcctacggctaccgcccgcctctgcctccgatctatatgaaacattggagaaccgtgactgagcaaaataagtactggtatttcatcttctgtctcggtatgccaatgatgcggaaactcgatccctgtggaggtacaggacaaagagtatcggatggccgtactactggtcgttggaggttgaggatcacagggcaagttgcagttggactagaacatttcccgtgtggttatctggcacgtgaccggggacgtccccctcagatgtgtgcgctaaaggaaatttagttgcggtgggctcaaaaccactttgagcctttgccgtggagagaattccaacgctattaaaccccctcgaaagggcatccccagggggggttcacactttgtttgcccttggaatgtttttttccctttggggttctatacaaaaaaaaggagacccttccctagagaataggcaagtttcctaccccacaataggccttgtggcgtttattccccacc

SEQ ID NO: 53978 - protein, 83 aa, Zea mays
  misc_feature: Ceres CLONE 1476992-F
MKHWRTVTEQNKYWYFIFCLGMPMMRKLDPCGGTGQRVSDGRTTGRWRLRITGQVAVGLEHFPCGYLARDRGRPPQMCALKEI

SEQ ID NO: 53979 - DNA, 672 bp, Zea mays
  misc_feature: Ceres CLONE 1476995-F
  misc_feature: Encodes the peptide sequence at SEQ ID NO. 53980
  misc_feature (546)..(546): n is a, c, t, g, unknown, or other
  misc_feature (547)..(547): n is a, c, t, g, unknown, or other
  misc_feature (563)..(563): n is a, c, t, g, unknown, or other
aaagctggagctccccgcggtggcggccgctctagaactagtggatcccccgggctgcaggaattcgtctcacccctagaaaaaatccgcgccagtccaaccaagtcagcacccgcgcgcggcaaggagttcacgcccatggcgagcaccaacatggcgtcggccacctcgcggttcatgctggccgcgggcgtgcccactgccagtagcggcagcggccgcgtcagcttcgcctcggcgcccaaccggcttggcaggaggcttgtggtccgggccgatgaggagttcccggcagagccggcgcccacggcggaaggggagggcgccgtggccaccaagcccaaggccgagaagccgccgccgatcgggcccaagaggggcgccaaggtgaagatcctgaggcgggagtcctactggtacaacgggatcggcaacgtcgtcaccgtcgatcaggatcctaacacccgttacccggtggtggtgcggttcaacaaggtgaactacgccggcgtgtctaccaacaactacgccttggacgagatcctnncgagtgaatgagtgangccagtctgctaaagaccccatgctcctgtgtgatttgtagttgtgaagtgaggctgctgcctagctgctagcgtcacaacatcaatcttgtaatagcttaatctcaca

SEQ ID NO: 53980 - protein, 139 aa, Zea mays
  misc_feature: Ceres CLONE 1476995-F
  misc_feature (78)..(139): Pfam Name: PSI_PsaE Pfam Description: Photosystem I reaction centre subunit IV / PsaE
  misc_feature (137)..(137): Xaa is any aa, unknown, or other
MASTNMASATSRFMLAAGVPTASSGSGRVSFASAPNRLGRRLVVRADEEFPAEPAPTAEGEGAVATKPKAEKPPPIGPKRGAKVKILRRESYWYNGIGNVVTVDQDPNTRYPVVVRFNKVNYAGVSTNNYALDEILXSE

SEQ ID NO: 53981 - DNA, 571 bp, Zea mays
  misc_feature: Ceres CLONE 1476996-F
  misc_feature: Encodes the peptide sequence at SEQ ID NO. 53982
  misc_feature (429)..(429): n is a, c, t, g, unknown, or other
tggagctccccgcggtggcggccgctctagaactagtggatcccccgggctgcaggaattcgtctcacccctagaaaaaacgttctcgcgcgggatctaattccaaacagcactgcccttgcttctaccgttccccaagtgcgctccctctctcgccatccatctcgtgcacgactgggcaaccgttgccgctgtcgaggtgcccaggtcttcatcggtccctcgtcagttcttctccggcccttcgccgccgacaagctcccccagctactgaagagacaggagcaaagagttaacaggagatgaatgcccctgaccgttatgagcgtttcgtcgtgccagagggcaccaagaaagtgtcctatgagagggatacaaagattgtgaatgctgcatcattcactgtcgaacgcgaggatcacactgtangcaatatcctccgcatgcagttgcacagagaccccaatgttctctttgcccggtataagctccctcaccccactcaggtacagaatcattgttaagaacaacacaacgaggccatccttccccaaaccagggcttaaaccca

SEQ ID NO: 53982 - protein, 73 aa, Zea mays
  misc_feature: Ceres CLONE 1476996-F
  misc_feature: SWISSPROT Homolog: EC 2.7.7.6 DNA-directed RNA polymerase
  misc_feature (43)..(43): Xaa is any aa, unknown, or other
MNAPDRYERFVVPEGTKKVSYERDTKIVNAASFTVEREDHTVXNILRMQLHRDPNVLFARYKLPHPTQVQNHC

SEQ ID NO: 53983 - DNA, 646 bp, Zea mays
  misc_feature: Ceres CLONE 1477015-F
  misc_feature: Encodes the peptide sequence at SEQ ID NO. 53984
aagctggagctccccgcggtggcggccgctctagaactagtggatcccccgggctgcaggaattcgtctcacccctagaaaaatcatcagcttccttccacattcgtctcgagatctcgccccgtcgccatggacgcgatcgacagcgtggtggatcccctccgcgacttcgccaaggacagcgtccgcctcgtcaagcgctgccacaagcccgaccgcaaggagttcaccaaggtggcggcgcggacggcgatcgggttcgtcgtcatgggcttcgtcggcttcttcgttaagctcatcttcatccccatcaacaacatcatcgtcggttccggctaggcttacaggagtacagggcgactagcatgggagtagtgcaatacttttgggagcaatagataacgaggatcctggcctttcgaatagtattgttaatgaaatttttcgtgcggctgtgtttctgatgtaagcgttgtactgagtagaccttctggataccggattctgagtagaccttcgtatccttgatggatcagccaatctcggaaagaaagtttcgtattatgctgtccagataaaagaatacaaccgagacgctcgaggtacccaattccccatatagggagtcggattacgcacgctcacg

SEQ ID NO: 53984 - protein, 69 aa, Zea mays
  misc_feature: Ceres CLONE 1477015-F
  misc_feature (10)..(66): Pfam Name: SecE Pfam Description: SecE/Sec61-gamma subunits of protein translocation complex
MDAIDSVVDPLRDFAKDSVRLVKRCHKPDRKEFTKVAARTAIGFVVMGFVGFFVKLIFIPINNIIVGSG

SEQ ID NO: 53985 - DNA, 658 bp, Zea mays
  misc_feature: Ceres CLONE 1477026-F
  misc_feature: Encodes the peptide sequence at SEQ ID NO. 53986
ctggagctccccgcggtggcggccgctctagaactagtggatcccccgggctgcaggaattcgtctcacccctagaaaaagcctcgcgcacccggttccgcgtgcctttccccacctactctcgcggctctcgccagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaaggccaaggcacagaagggcgcgattgggggctcgggtctgaagaaaagtggaaagaaatgagactggtcacccgtctccaatacctagaggatgataaggcagctgtctatctgtgttgcgcttcactaagtgtgattgtaacagtggtacctcttgtgttctgtgttccgcgatgttgcagttggttgcttgatcgaaagatgtttcaacctcccatctgctagctatgatacagatggtcccctgataataatgatgacatattctgtgaaaaaaaaaaaatacacagcaaagcctcaaaacctgatcatcagagaaacgaaaaggaagaggtgagcgtgggaa

SEQ ID NO: 53986 - protein, 62 aa, Zea mays; identical to SEQ ID NO: 5990
  misc_feature: Ceres CLONE 1477026-F
  misc_feature (1)..(62): Pfam Name: TMA7 Pfam Description: Translation machinery associated TMA7

SEQ ID NO: 53987 - DNA, 640 bp, Zea mays
  misc_feature: Ceres CLONE 1477031-F
  misc_feature: Encodes the peptide sequence at SEQ ID NO. 53988
  misc_feature (449)..(449): n is a, c, t, g, unknown, or other
  misc_feature (452)..(452): n is a, c, t, g, unknown, or other
  misc_feature (455)..(455): n is a, c, t, g, unknown, or other
  misc_feature (456)..(456): n is a, c, t, g, unknown, or other
  misc_feature (460)..(460): n is a, c, t, g, unknown, or other
  misc_feature (463)..(463): n is a, c, t, g, unknown, or other
  misc_feature (466)..(466): n is a, c, t, g, unknown, or other
  misc_feature (503)..(503): n is a, c, t, g, unknown, or other
  misc_feature (526)..(526): n is a, c, t, g, unknown, or other
  misc_feature (529)..(529): n is a, c, t, g, unknown, or other
aaagctggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaagtcccgcggcttcggcttcgtcaccttctccacggggagagcgatgcggaacgccatcgagggcatgaacgggcaggagctggacggcccgcacatcaccgtcaacgaggcccagtccccgcgcgnccntgnnagcngcngcngtgggtacggtggtggcccgtggaagcgggcgctacngcggtggcgggccccctgatgcngcngcggctacggggttgcgggcgcggctacgtggcggcggcggctacgtgggttggtggcggcggtacggcggtgggaaccggggggggggtccgggaaatcccacgggactt

SEQ ID NO: 53988 - protein, 112 aa, Zea mays
  misc_feature: Ceres CLONE 1477031-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (89)..(89): Xaa is any aa, unknown, or other
  misc_feature (90)..(90): Xaa is any aa, unknown, or other
  misc_feature (91)..(91): Xaa is any aa, unknown, or other
  misc_feature (93)..(93): Xaa is any aa, unknown, or other
  misc_feature (94)..(94): Xaa is any aa, unknown, or other
  misc_feature (95)..(95): Xaa is any aa, unknown, or other
  misc_feature (107)..(107): Xaa is any aa, unknown, or other
MAASDVEYRCFVGGLAWATDDHSLHNAFSTYGEVLESKIILDRETQKSRGFGFVTFSTGRAMRNAIEGMNGQELDGPHITVNEAQSPRXXXSXXXGYGGGPWKRALXRWRAP

SEQ ID NO: 53989 - DNA, 761 bp, Zea mays
  misc_feature: Ceres CLONE 1477037-F
aaagctggagctccccgcggtggcggccgctctagaactagtggatcccccgggctgcaggaattcgtctcacccctagaaaaatcttgcgtccggcgtcctctctctctctcgtggcgacgactgggcgacctccccgcccccgccgctctacgccaggtgcccagatcttcgtcgggcccttcgccgaagagcagccaacagcttatgttaaaataagaaaaattgccgggcggataatacaaggcctacaccagaatgaataccctttgtgcgacaggcgaacagctgtctctatctctctctgcagtgttatttggtttattatatgcagttgcaggggagaaaaactaggcctgttcactgcagctagaatctcagccgcaccagatgcagcaggctttcttatacagcactttgcagcttaaccgtttgcagtggcagctgcaccttagctgccagcaaacacttcctaactataaaaattggaaaaaagacctttcccgcttgtctaaatttcaggtggattcttggggcatttaacttggcaaattttttttaattctttacctagggcaagaaaggggtgttttctgtttcctgagaaccaagaaactttgccctaaaaaaccccaattttttttggggtttttcccggtccccttctccccaaaattttaaccccccttggaagaagaagtgtgcccatattaaggcttttaaaaaagggggttcgccgtataaaaattttttttgttggc

SEQ ID NO: 53990 - DNA, 677 bp, Zea mays
  misc_feature: Ceres CLONE 1477039-F
  misc_feature: Encodes the peptide sequence at SEQ ID NO. 53991
atagctggagctccccgcggtggcggccgctctagaactagtggatcccccgggctgcaggaattcgtctcacccctagaaaaaatgaagcttcagaccaccgtcaccgttgctggcctcctcctcttcctcctcctcctggcgctgccttccctccgcgtctccatggctggatcagggttctgcgacggcaagtgcgcggtgaggtgctccaaggcgagccggcacgacgactgcctcaagtactgcgggatctgctgcgccacctgcaactgcgtgccgtccgggaccgcgggcaacaaggacgagtgcccatgctaccgcgacatgaccaccggacacggcaaccgcaccaggcccaaatgcccctgatgatattcattccttcactctgtcttgcatgcgtatgtaatgtataggctgtgcaatgcatgcatacatgatacatgccgtgactctggatcggaggatgcctatgcatgcttttcactagctattattactacgactactactcttcctgtcttcctactgtgtgcaccatagtgagagggactacatgcatggcgatgacatgtcgtgttatgtgcactgactgccgcttgggcaggtcatatttcatgctctgtgtattgcgatacgtacacccttgcctttggatctgctactagatgcag

SEQ ID NO: 53991 - protein, 95 aa, Zea mays
  misc_feature: Ceres CLONE 1477039-F
  misc_feature (7)..(95): Pfam Name: GASA Pfam Description: Gibberellin regulated protein
MKLQTTVTVAGLLLFLLLLALPSLRVSMAGSGFCDGKCAVRCSKASRHDDCLKYCGICCATCNCVPSGTAGNKDECPCYRDMTTGHGNRTRPKCP

SEQ ID NO: 53992 - DNA, 687 bp, Zea mays
  misc_feature: Ceres CLONE 1477042-F
  misc_feature: Encodes the peptide sequence at SEQ ID NO. 53993
  misc_feature (642)..(642): n is a, c, t, g, unknown, or other
atagctggagctccccgcggtggcggccgctctagaactagtggatcccccgggctgcaggaattcgtctcacccctagaaaaactctcgatccggaaacctctcaaaccctagccgcctcctgcaagtttcatagctcaggaatctgcgccatggcgagtgacactgagaccttcgcatttcaggctgagatcaaccagctgctctcactcatcatcgacaccttctactccacaaggagatcttcctccgcgagcttatctcctactcttccgatgcgctggacaagatcaggttcgagagtctcactgacaagaacaagctcgacgtgcagcctgagcttttgatcgaccttgtccctcaccaggccccgaacacactctccatcatcgacagcggcatcggtatgaccaattccgaccttgtaaacaacctcggaacctccacccggcccgggacaaacgaggtattggaagcccttgctgccggcgctgaaatctccatgattgggcatcttggggcgtcgctcttctctgggcctacccgcggcggcgaatctacttggttctggaccaaccagcgccccctttcggagtaaaggatacccgatgggaataccccaaccggggcagggcccgtatnactggtataccggacggaccgggccggggaagaacaaacgctagg

SEQ ID NO: 53993 - protein, 63 aa, Zea mays
  misc_feature: Ceres CLONE 1477042-F
MTNSDLVNNLGTSTRPGTNEVLEALAAGAEISMIGHLGASLFSGPTRGGESTWFWTNQRPLSE

SEQ ID NO: 53994 - DNA, 646 bp, Zea mays
  misc_feature: Ceres CLONE 1477047-F
aagctggagctccccgcggtggcggccgctctagaactagtggatcccccgggctgcaggaattcgtctcacccctagaaaaatctcggctgccagaagcaaagattttggcgccacctgaaagagcaactagagatcgaggaaatcctccaccgaggttgtcgggtcatcggtgaccattccgggggcttcttcatatccccaggaattctctcgaggcctcggtgctctgtgtagatcagtgggtgcgcttcgatttctctccatcgtgggaaatcatcggcgtgctgcacttcttcaacgctggcccctgctctgtccgaaatcccagtcaagagcacgtaccacaggatgaggcgcatggaggatgctgcgatgagttcgtgagagagatctaggccgtcatctcccactcaacttcgggttgctggaccgcgtgctccgtataatgcaattactcattgatgttgcacaccactccgatcatctagtaaagatgtgacattcgctccggcatctccgtgcgctggtactacgacaggtatcaggacctgcaggcatctgacagggaggagctgctgcaacaaggagatgcgtcacgtcagtgaccacaagtttcccctcctctaagtctctttacgcaccc

SEQ ID NO: 53995 - DNA, 680 bp, Zea mays
  misc_feature: Ceres CLONE 1477053-F
  misc_feature: Encodes the peptide sequence at SEQ ID NO. 53996
aagctggagctccccgcggtggcggccgctctagaactagtggatcccccgggctgcaggaattcgtctcacccctagaaaattctcctcagaggatgcgatgcaaagcgccatctatggcatgaacggcaaggagctggacagccgcaaatcaccgtcaacgaagcccggtcccgctgcggccgtggaagccgcggcgatgggtaccgtggtgcacgtggacgcagcccatacggatctggacagcgccgagttcgtcgcgagcgatacgggagtggctgaagcaggctactgtgctccctctggcatacggtggtgatggtgacgactactgaactggcaaccgtggccgccgctacacgtactccccctggaacttggagaactgatcccttggacccgaaaggccaccccatccggctcactactgtgttgtttcccctattgcacatggattatcccagggcgagccatgttccccagttgaccatctgtgcctcatgaactgcaagaacgctcacgggtttgatgtttcctgaaggaccccccccccaaggtccactggaaaacgggcccgaactcagcctgtaaaatgcaggctaaattggccgccggttccccccccccgcgggctttaaacccgaagattaacccttgcccaccccaaatacgggaacccc

SEQ ID NO: 53996 - protein, 72 aa, Zea mays
  misc_feature: Ceres CLONE 1477053-F
MQSAIYGMNGKELDSRKSPSTKPGPAAAVEAAAMGTVVHVDAAHTDLDSAEFVASDTGVAEAGYCAPSGIRW

SEQ ID NO: 53997 - DNA, 658 bp, Zea mays
  misc_feature: Ceres CLONE 1477055-F
  misc_feature: Encodes the peptide sequence at SEQ ID NO. 53998
aaactggagctccccgcggtggcggccgctctagaactagtggatcccccgggctgcaggaattcgtctcacccctagaaaaacatccagccgccgccgccgcacgccgcagttgtcttcggtcttccgtgctcaccttcagagagacaagttgctgctgcggtagtccccaaccatcatcatgcataacgaggagggtaagactgtggacctctacctccccaggaagtgctcggccaccaataggatcatcactgccaaggatcatgcctctgtccagatcaacattggacacttggatgcgaatggcctgtacaatggtcacttcaccacatttgctctctctggctttgtccgtgctcagggtgatgctgacagttcgatgcacaggctgtggcacaagaataatgctgatatcaagcagtatgtctttgcacgtagttccaccgtgtaatggactcttgagggatactgctctagctattgctttagctggagggggggagcgattctgatgtttgactgtccgtttgctggatgaccaggttttaggttgtcatgccatgcttgggtcgcagcaatctgtggcacgatgaatatcatgttgtcgacctattcgtctcacatatttggccgcttactatttactatttacatc

SEQ ID NO: 53998 - protein, 90 aa, Zea mays
  misc_feature: Ceres CLONE 1477055-F
  misc_feature (1)..(81): Pfam Name: Ribosomal_S21e Pfam Description: Ribosomal protein S21e
MHNEEGKTVDLYLPRKCSATNRIITAKDHASVQINIGHLDANGLYNGHFTTFALSGFVRAQGDADSSMHRLWHKNNADIKQYVFARSSTV

SEQ ID NO: 53999 - DNA, 658 bp, Zea mays
  misc_feature: Ceres CLONE 1477058-F
aagctggagctccccgcggtggcggccgctctagaactagtggatcccccgggctgcaggaattcgtctcacccctagaaaaaatggcagcttcatctacttccctgcgttctcggacgtagcagaaaccgcgcgtgcctcggccaacagactccgtaacaaactccactaataatctccggtttgctcggccgtcatatgatcccctcggtgtatataagctgtcgcgccctcgccttgaccccatacaaaatctgagacacagagagatagcaagaagggagtgcgaaggagaagtcagccgcctctgccctctaattcgacgcggcgtaagcaagaccgaggggagagaggagaaggagacccctgcgctagcagtactcgttctggcgcaggaacactagtcgggtggcgagccattctattccctgcggcgcctggaccttggagcgaggtcacgagtcatctgaagagcaagttggtacctggaatctcaagtgccaggtcaagagcaggtaccacaggatgaggcgcgtggaggatgctgtgatgagttcgtgagtggtctaggtcgtcgtctcccagtcaactttgggttgctggaccgttgtctccttataatgtaattacttatttattttgtatagaactcctgtta

SEQ ID NO: 54000 - DNA, 757 bp, Zea mays
  misc_feature: Ceres CLONE 1477063-F
  misc_feature: Encodes the peptide sequence at SEQ ID NO. 54001
  misc_feature (27)..(27): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (36)..(36): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
agaagagaataaagtggcggggggttnctannnntntatggccccccnnntcaaagctggactccccgcggtggcggccgctctagaatagtggatcccccgggctgcaggaattcgtctcacccctagaaaaagaacctccgacagacataatggctgtatcagactacttggtatctggcctcggcggcgcctcccatggccagacgagctgcgttatcggcaggttcatgctcggtaaacgtgggccggcgacgaaccccctgatgagcaggaacaggcggaggaatgttgggatcacttgcatgacgttaccccgggactggctgcagatggacgtgagcgtcatcggctttcgggtcctgggttggatgggggcgttcaaggtgccggggatcctccgccaactgcttacggggcgtcttggttctccagaatcggccaggagctggaccaacttacccaccccccccccccaacaccccccaatactggctttggcttagtgaatggcctctggggcgggttaatcggggttaacttcctgcaaagttgggattcaagggcccccaccaaggtccaacttcctaaaaataaatgcgggctagggatacatttgaaacccctttacctggggggctaaagggtggcattgggggtttcgccttggaataaatcaatcccctataatctaaaccacctctttggtcgtttataagagggcttgccgaaattttttgaacccacattggtaaag

SEQ ID NO: 54001 - protein, 117 aa, Zea mays
  misc_feature: Ceres CLONE 1477063-F
MAVSDYLVSGLGGASHGQTSCVIGRFMLGKRGPATNPLMSRNRRRNVGITCMTLPRDWLQMDVSVIGFRVLGWMGAFKVPGILRQLLTGRLGSPESARSWTNLPTPPPQHPPILALA

SEQ ID NO: 54002 - DNA, 680 bp, Zea mays
  misc_feature: Ceres CLONE 1477071-F
  misc_feature: Translation starting site: 154
atagctggagctccccgcggtggcggccgctctagaactagtggatcccccgggctgcaggaattcgtctcacccctagaaaacagccgtcatcgcttcacgtccgctacataccggcgaggagacgaaaggagggagttttgagaagcataaatggctcctaaagccgctcctgtcaagaagggtgatgccaaggcccaggccttgaaggtggccaaggctgtgaagtctggggcaggcaagaagaagaccaagaagattcgcacatctgtaacatttcaccagcccaagaagcctgaagaaggccagggacccgaaagtacccaagaatcagcactactggaagaaaacagcttgatcagtaccaaaatccctcagtaccccctcaccacagaaatctgcatgaagaagattgaagatacaacactctggtctttattgttgacctcaaggcagacaagaaaagatcaggctgccgtcaaaagatgtttgactttcagccaaggaagtcacaccctgatccggctgatgggaaaaaaaaagctttttgaaattgaaccccaatttcaatgcccttgattggcccaacaaattggctccccctaaattaaaggcacctggttccaactctttgcccatagtctagaaaacccacaaaatttttttgggaacaaaaattt

SEQ ID NO: 54003 - DNA, 731 bp, Zea mays
  misc_feature: Ceres CLONE 1477072-F
  misc_feature: Encodes the peptide sequence at SEQ ID NO. 54004
  misc_feature (355)..(355): n is a, c, t, g, unknown, or other
  misc_feature (421)..(421): n is a, c, t, g, unknown, or other
aaagctggagctccccgcggtggcggccgctctagaactagtggatcccccgggctgcaggaattcgtctcacccctagaaaaaacgccgtcaccccgctcaccatctgctgcctccgccgcggcgttcccctcaaccacagccgccgcctcctcgccgtagccgccgcagcgccagaatcgcccgcgcctacccccgcgccatcccagttgccgcttcccccggttcctcctcgcaagggctacttcccgaagcgtggcgagacagtcgtcctgctctgcgatggtccgccgcctccgccgtggcgcctttgccgaggccgccaagctcaggaccctcgagccacaccacgacngcatcgaggcgccctgcccccctcgcgctgactgcggcggctgcaagaccaagtctctcgccaacnccgcgcagatccgcccacagcatcaccagggttcgcgacttgctcgtgaccttttgcaaagtttgatcccaagcccctgaaagctcggagccggattgaaatcttaaaccccaccggggagtgggaaggagtatttcgggtcagggaccaaatggaattttcttttgggaacaaaaaaatggggtcaaaaaaaaataaaaggaaaagggtggggggggggggggggaaaccggaaaacaaaaaaaaccggggggataccccttgggaaccacccccccacgggttttttcaaaaggggtgtccttgtggg

SEQ ID NO: 54004 - protein, 72 aa, Zea mays
  misc_feature: Ceres CLONE 1477072-F
  misc_feature (25)..(25): Xaa is any aa, unknown, or other
  misc_feature (47)..(47): Xaa is any aa, unknown, or other
MVRRLRRGAFAEAAKLRTLEPHHDXIEAPCPPRADCGGCKTKSLANXAQIRPQHHQGSRLARDLLQSLIPSP

SEQ ID NO: 54005 - DNA, 706 bp, Zea mays
  misc_feature: Ceres CLONE 1477074-F
  misc_feature: Encodes the peptide sequence at SEQ ID NO. 54006
agagctggagctccccgcggtggcggccgctctagaactagtggatcccccgggctgcaggaattcgtctcacccctagaaaaacgtccagcaagcgctactgctccaccacagccactactgtgcttgcttgcccctttcccttcccttctcgcaccagaagagaagcgagacggcgttcacgctggcatatgcccgtgtctgccgccgggctacgcctctaggggctgctccagtgccggccgaccgccatggctgggctcaaggagatcactaatgaagtcgtccatctggacaacatccgcatccaggaggtgttcgagcacctgaaatgcgcccgctaggggctgatctccaacgagggccaggactgcctccagatcatcagccccaacacgctcgagtagaacaacgaaccctagatcctcaggttcatcgggttcatgtggaacccgctgtcgtgtgtcatggatgtggccgccgtcatgatcatcgccctcgccaacggcagttgcaagcccccctactgggaggacttcttcagcatcatcgggctcctggtcatgaactccaccatctccttcatcgaggagaacaatgccggccacaccggcgtccccgcttatgggccaaaccttgatctcccagaccaaagttcttaacacatgggccaaaagggtccaacaaagacgcctcctatttttgg

SEQ ID NO: 54006 - protein, 72 aa, Zea mays
  misc_feature: Ceres CLONE 1477074-F
  misc_feature: SWISSPROT Homolog: EC 3.6.3.6 Proton-exporting ATPase
MWNPLSCVMDVAAVMIIALANGSCKPPYWEDFFSIIGLLVMNSTISFIEENNAGHTGVPAYGPNLDLPDQSS

SEQ ID NO: 54007 - DNA, 674 bp, Zea mays
  misc_feature: Ceres CLONE 1477076-F
atagctggagctccccgcggtggcggccgctctagaactagtggatcccccgggctgcaggaattcgtctcacccctagaaaaaatcggtcacggatcctagcttaatgcaagcacatgctatgctccaggcatcgtcgcgacagagtgagtgagtttcatgacaacaacgatggcttccctgatcgccgcgtagcccagcggatttactgcacacgccaaggaaccagcgcccaagctcatctagacagcgacgactgcctgagccacaaacatcggacggtttaaaaaggctaatcagaacccccgggaaaccaaattgatggtgactagcaccgaaccggcggctgctgccacccagtaacgtacggcacctgagcagtgtcatggagcttctttgcatgcatgattggatccatgccacgttaggaatctagtccgtccattcttgcatcttcaatgtgacacggcatgtgctctccctcatgcgggaggatgccacatgaacacttcaagtttcacgtttttgactttccctaagaaccactacagaaagttgaatgctcgaaggctcccactaccccctataatgggccgaaattgccgggagatccctggcccgttttttttgaaacgccaatgacagtggaaaacccaagagggaaccccgccctc

SEQ ID NO: 54008 - DNA, 677 bp, Zea mays
  misc_feature: Ceres CLONE 1477082-F
  misc_feature: Encodes the peptide sequence at SEQ ID NO. 54009
  misc_feature (566)..(566): n is a, c, t, g, unknown, or other
agagctggagctccccgcggtggcggccgctctagaactagtggatcccccgggctgcaggaattcgtctcacccctagaaaaagtccatccgtatttccgtcacaactcacaacccgagccccccaaacccgaagcagcaggagctcccctgaccttgctccgcctccgatcaaggaaaaggaagatgagctactacggccagcagccccccgtcggcgtcccgccgcagcaaggtgcggcgccggctcttcccgccctcgatccatctgctttattatctccgtccgaacctttgtgttccttcgctcgctttccgtggtagggatatttaataaggctaattatcttattaatatttgggttgtggatcttgatttctccaggctacccggggaaggacggctacccgccagcggggtacccgccggccggctaccccccgccggcgcagggctacccgccgcagggctactcgcagcagggttacccacagcagggctacccgccgcagtacgcgcagcccgcttcacagcagcagcagagcagcgggccttccttcatggnaagatggtatgttcttcatctcccccggccctccactcatgtgccgctcttcaaatttctccccggattaaatcaaaaaaggcgggggttacccggcaaaactcgtcaggg

SEQ ID NO: 54009 - protein, 38 aa, Zea mays
  misc_feature: Ceres CLONE 1477082-F
  misc_feature (2)..(2): Xaa is any aa, unknown, or other
MXRWYVLHLPRPSTHVPLFKFLPGLNQKRRGLPGKTRQ

SEQ ID NO: 54010 - DNA, 648 bp, Zea mays
  misc_feature: Ceres CLONE 1477092-F
  misc_feature: Encodes the peptide sequence at SEQ ID NO. 54011
tggagctccccgcggtggcggccgctctagaactagtggatcccccgggctgcaggaattcgtctcacccctagaaaaaacctccccactcgagccagccagccagccagccagccgcttgggcgccatctctctagagcttcgtaccctcgaagagagatccggcgcggcccaataaacacccggctcactacagactcgcagatggccggcctcaggatgaagttcgtcgccgtcaccgccatggccgccgcgctcgtggcgtccgccgcagccgccgaggcccccgccccggctcccgcgtccgacgccgcggccgccgtacccctcgccgcggcctccctcgccgccgccgccttcggctacctcttctgctagatccgcgctggatacgtggttcctgctccaaaatatgattcgtctggtctggcgcgcgtgagtccagctcgcgtgtcgtgcgtgtctctgtgtgaggtgtccgcgggcgtgtgtatgtatggactcagccgcggcggccgatgaagtctgcgcgtggtggtgttggtacgtgcttccacgcgacactgttttgtgcggcaatcatgtactaccctgctgcgttttctggttgtcaaggagatgattcacttgattccttttcaagaaaaa

SEQ ID NO: 54011 - protein, 57 aa, Zea mays
  misc_feature: Ceres CLONE 1477092-F
MAGLRMKFVAVTAMAAALVASAAAAEAPAPAPASDAAAAVPLAAASLAAAAFGYLFC

SEQ ID NO: 54012 - DNA, 652 bp, Zea mays
  misc_feature: Ceres CLONE 1477100-F
ggagctccccgcggtggcggccgctctagaactagtggatcccccgggctgcaggaattcgtctcacccctagaaaaagccggacctcttgtctccttgctgggtgaggtacggtttcccttcctttttgcgtcgacgcgcggaccaaccacgacagcggcggcacacctgggataccaaatgctcaggccggccgcctgggctccacgggactaggggctgcgccgcgcaccaggtactgccgtggcactgctgtggctcgtggaggctggccttcgagcagctcgtcgtcgctcggtctctcttgctgcgactcgtcgtctgcatcatcgggctgatcatgtcgaccatcgtaccacctgctacctctgcgcgacgggctgctgctggtgccctctgcaatcgtcaagcgacggctcatgtgatgatgtaggtcactactccatcctgtgcaagctgaccctgcttgctgctgcgtcgatgatacataggtctggctttactcggacagttgctgtactgcactgtcctgctcgttctcatgaacgcggctcgctcgaccagatcatcggctacatcctacgtctgcattgttatatcagactcagtagcctcgatcgcgccgccgggcggcaggtgcctgctggtggta

SEQ ID NO: 54013 - DNA, 656 bp, Zea mays
  misc_feature: Ceres CLONE 1477103-F
  misc_feature: Encodes the peptide sequence at SEQ ID NO. 54014
  misc_feature (554)..(554): n is a, c, t, g, unknown, or other
  misc_feature (555)..(555): n is a, c, t, g, unknown, or other
  misc_feature (628)..(628): n is a, c, t, g, unknown, or other
ctggagctccccgcggtggcggccgctctagaactagtggatcccccgggctgcaggaattcgtctcacccctagaaaaagtctcgctccaaaccaaagccatcggaggagcaactggacgaccatggcctcgccgctgctcaagtcacactctcagctcgccgccgccgccgccctgcactccgtgaggagagccgaccgctgccctgcgacactacacctgggcaagttccatgaccacgggctcaggtccggccgttctaagagatccggttcagcgagggtgggcgccttcccgtcgctggacgtggtgccgctgatggtgacgatggtggagcacgtggacatgtcgcgggactacgtcgtgaccaagtccatctggcatctcagcgacgtagccctcaagagcgtctataccttctacgccatgttcaccgtctggagagtctgcttcttcgcgtccatgaaggatcccttctacgacagcgagacgtacaggagcccaggtggcgacaggaccgtgcactggtactacgacaggcaagaggacctgnnagcgtctgcgagggaggagctgctgcgggaagagctgctcgaggagattgagcagagggttggggcctcaggntagctgaggaagcgagcatggacgagca

SEQ ID NO: 54014 - protein, 168 aa, Zea mays
  misc_feature: Ceres CLONE 1477103-F
  misc_feature (144)..(144): Xaa is any aa, unknown, or other
MASPLLKSHSQLAAAAALHSVRRADRCPATLHLGKFHDHGLRSGRSKRSGSARVGAFPSLDVVPLMVTMVEHVDMSRDYVVTKSIWHLSDVALKSVYTFYAMFTVWRVCFFASMKDPFYDSETYRSPGGDRTVHWYYDRQEDLXASAREELLREELLEEIEQRVGASG

SEQ ID NO: 54015 - DNA, 533 bp, Zea mays
  misc_feature: Ceres CLONE 1477107
  misc_feature: Encodes the peptide sequence at SEQ ID NO. 54016
tcggctcactcactctcgctcgacctatgttcttgagctggttgatgagatagcaactggatcaaagttgtactctcttgcctccccgtgacaataatgaatcgccctctgcgtgcgatttatgttgatcttgtggtagttcccccaactgtcaccatgcagaacgaggagggtaagactgtggacctctatgtccccaggaagtgctcggccacaaacaggatcatcactgccaaagaccatgcctctgtccagatcaacattggccacttggatgcgaatggcctgtatgatggtcacttcacaacgtttgctctctctgggtttgtccgtgctcaaggcgacgcagacagctccttggacaggctgtggcagaagaagaaggctgatatcaagcagtagattttacatctagtttaccaagaattggacactgccttagctatgttttgaattcatgtcactatatgcaatgttgtgatttcagctggtaccttaaatctgaagatttagtatcaaaaaaaaaaaaaaaa

SEQ ID NO: 54016 - protein, 101 aa, Zea mays
  misc_feature: Ceres CLONE 1477107
  misc_feature (21)..(101): Pfam Name: Ribosomal_S21e Pfam Description: Ribosomal protein S21e
MNRPLRAIYVDLVVVPPTVTMQNEEGKTVDLYVPRKCSATNRIITAKDHASVQINIGHLDANGLYDGHFTTFALSGFVRAQGDADSSLDRLWQKKKADIKQ

SEQ ID NO: 54017 - DNA, 710 bp, Zea mays
  misc_feature: Ceres CLONE 1477111-F
ctagaactagtggatcccccgggctgcaggaattcgtctcacccctagaaaaagaccacgagatcggagcttctttttctttgctcggcgcttgccgcaccagctgccgttatgtctgcagggaagcacctcgcgggtgtgatcatgaacatgtacgacgagagatagtttgacgatcagttggagcagatactgatgctccaggagccgatcggccctgacttcgtatccaaagtcgtcacgctcttctgtcgggacggctagtgcatcatcaggaaatctggccatactgctggagaacctcaacgtgcattttgacagggtagacgcctttgtgcaatagtgcaaaaccaagtcatgaaaaatattggtggttcagaatgttaacaccaccttccccctcacttgattgaaattcggttcggcaaaattagccaaagattggctgccttcaaggaccttggagaacaatgaggattaaatttctattaccttgcgtgggaaacttttccagacctatggcatcagttttggagatgtaaggttaaatgggtttatttcccccaaaaattggaaccaaccttggtggaaattggaaccttctatgtgtaggaatgattgaatcccatctttttaaagtttcccgcaagtttttcatgaattggagcttctttcagtttgggtcttcgggggaaaagtcttgtaaatcc

SEQ ID NO: 54018 - DNA, 786 bp, Zea mays
  misc_feature: Ceres CLONE 1477112-F
  misc_feature: Encodes the peptide sequence at SEQ ID NO. 54019
ccccgcccccccccccattccctccccccctcgaaagtcgaccccgcccaaaaattcgcactcccctcggtggcggccgctctagaactagtggatcccccgggctgcaggaattcgtctcacccctagaaaagacgacgagctcggagcttcttcttccctgctcggtgctcgccgcaacagctgccgccatgtctgccgcgaaccagctcgccgctctggtcagcaacatgtacgccacgggtttgcttgacgatcagttccagcagctccagctgctccaggaccccagcgcccctgacttcgtctccgaggtcgtcacgctcttctgtcaggacggcgagcggatcatcgaagagctggccaaactgctggagaagcccaacgtggattttgacagggttgacgcctttgtgcatgagctcaaccgaagcagtgcaaatattggtggctcagaaggttaggaacacttccattcacctcccacgatttctggcagcagaagagcagaaaatgggtgcctccaggtactgggagaccaaggaggattaagcttcctatgcagccgcgttgggcaagtttccagactcttgcttccaccttggagcgtccaggtccaatgggcttttccccccccaacaaggtaaaaccaagcctgggtgggaagtggaacccttccgggcttaggaaagacggtttggccctcttcttaaatttttccagataatttcctggaatgacgcccccccccaattggggccccctcggggaaagcccgggtcacat

SEQ ID NO: 54019 - protein, 90 aa, Zea mays
  misc_feature: Ceres CLONE 1477112-F
MSAANQLAALVSNMYATGLLDDQFQQLQLLQDPSAPDFVSEVVTLFCQDGERIIEELAKLLEKPNVDFDRVDAFVHELNRSSANIGGSEG

SEQ ID NO: 54020 - DNA, 676 bp, Zea mays
  misc_feature: Ceres CLONE 1477120-F
  misc_feature: Encodes the peptide sequence at SEQ ID NO. 54021
aaagctggagctccccgcggtggcggccgctctagaactagtggatcccccgggctgcaggaattcgtctcacccctagaaaaaaaaaagacgccgtcgccgctcttgttgtttccgatcccaaaccccaaacacgctccaccggcacctccgctcccacaccacaccgatggcccgcacgaagcagacggcgcgcaagtccaccggaggcaaggcgccgcggaagcagctggcgaccaaggcagcgcgcaagtcggccccggcaaccggcggcgtgaagaagccgcaccgcttccgcccgggcaccgtggcgctccgcgagatccgcaagtaccagaagagcacggagctgctcatccgcaagctccccttccagcgcctggtccgcgagatcgcgcaggacttcaagaccgacctccgcttccagtcctccgccgtcgccgcgctgcaggaggccgcggaggcctacctcgtcggcctcttcgaggacaccaacctctgcgccatccacgccaagcgcgtcaccatcatgcccaaggacattcagctcgcccgccgcatccgcggggagcgcgcttaggcgtttacggttgattgtcactactgtagatgtttaggctatgttctcgccatgtcctaggtctgctttagtcttatttgtttttctggtttcacc

SEQ ID NO: 54021 - protein, 136 aa, Zea mays; identical to SEQ ID NO: 6923
  misc_feature: Ceres CLONE 1477120-F
  misc_feature (58)..(132): Pfam Name: Histone Pfam Description: Core histone H2A/H2B/H3/H4

SEQ ID NO: 54022 - DNA, 660 bp, Zea mays
  misc_feature: Ceres CLONE 1477121-F
  misc_feature: Encodes the peptide sequence at SEQ ID NO. 54023
ctggagctccccgcggtggcggccgctctagaactagtggatcccccgggctgcaggaattcgtctcacccctagaaaaaatgcagcatcctcttgctcagtacaatggacattatcatctgtcaggtccttcggagccaacaatgcctagcattttcgatgttttttctcccaataatggagtcctcttaacagatgatccagccaactacttggacccagccatgcagttccctttctcatgattggtcaccaattttcatggagctcgctgttgctacaactctatccaccctgaacgtcaaggaagtcattgatgtcatgcctgggctcatgaaatcgtctgttgctcttctgaaccaagccgaccttggctggtatttcttggaagcacggtgcttggaacaatctgcatcgactgctgtatgctcccaactggttgagctaacggccaatctcggctcactctgctgaggagatcatagcctgtaaatctttgattatgctattacttgtgtgtatcgcaacctgattaccattgtcttgtgttttgagttttgacatatgcaaaccataataatgtcgtaatatggaactcgtttatcatgtttattcaaaaaaaaaaaaaaaaacgagacgctcgaggtacccatttcgccc

SEQ ID NO: 54023 - protein, 80 aa, Zea mays
  misc_feature: Ceres CLONE 1477121-F
GAPRGGGRSRTSGSPGLQEFVSPLEKMQHPLAQYNGHYHLSGPSEPTMPSIFDVFSPNNGVLLTDDPANYLDPAMQFPFS

SEQ ID NO: 54024 - DNA, 683 bp, Zea mays
  misc_feature: Ceres CLONE 1477125-F
  misc_feature: Encodes the peptide sequence at SEQ ID NO. 54025
  misc_feature (379)..(379): n is a, c, t, g, unknown, or other
caaagctggagctccccgcggtggcggccgctctagaactagtggatcccccgggctgcaggaattcgtctcacccctagaaaaagactcactcacttagccactcttcttcctcctgatcaatccgctctccagcacttgttcggaagaaaaagaaggtagaacacgctaacgagacaacaaggatcatggggcgcgggcgcggccacctcctgctgccggcagcagccgcctgcctgtgggcgctgtcgtgcgcgctgctgctgcgcgcgtcccctcaccgcgctggcgccggcgccggcgggctgctgagggtcgggctcagcaggcgcggcggcgggctcgaccagcgcgcgctggcggcgggaaaggtcaccanccaccatgaggcaagccgtctcggggcctccccccccggcgacgtccctctcgtcaactacctcaacacccagtactacagggtcgtcggcatcggcacgccgcccgaaaacttcaccgtcatcttcgacaccagcagctccaacctctggggtcccctcctccagatgctactcttcgagtgcctgctacctgcaccacagaaacaagtcgggcaagtcctaacaccgccaaaggcggacggccaaaacctgcaagatcacctacggcttccggctcgaatcaccggggttctacaaccaaca

SEQ ID NO: 54025 - protein, 165 aa, Zea mays
  misc_feature: Ceres CLONE 1477125-F
  misc_feature: SWISSPROT Homolog: EC 3.4.23.1 Pepsin A
  misc_feature (64)..(64): Xaa is any aa, unknown, or other
MGRGRGHLLLPAAAACLWALSCALLLRASPHRAGAGAGGLLRVGLSRRGGGLDQRALAAGKVTXHHEASRLGASPPGDVPLVNYLNTQYYRVVGIGTPPENFTVIFDTSSSNLWGPLLQMLLFECLLPAPQKQVGQVLTPPKADGQNLQDHLRLPARITGVLQPT

SEQ ID NO: 54026 - DNA, 695 bp, Zea mays
  misc_feature: Ceres CLONE 1477135-F
  misc_feature: Encodes the peptide sequence at SEQ ID NO. 54027
cagagctggagctccccgcggtggcggccgctctagaactagtggatcccccgggctgcaggaattcgtctcacccctagaaaaagagggcagctccggagccgcacgggcgcgagcgaggcaggcagtggctcctcccccctcctttcgatatcagctcatcgattcgtcctatcacacacatatcattaccgctcctcttcctctcctatgcttgtcctctaactcattggcagaagagaaaaaaaaagtccttgttgagttgttgtatcgggttctggtggtgactgttactggggtttccttgtccggttcttgattcgcgcaaggacagatttgccgtcctctcgggttccgccgtgcggtgctgaatcctccttccctgttcccttcccttaggtttggatcggggatagggatggaagtggacagaaagaagaatttgcagattggatccaaggggaaggaggttcagagcaagaatccgaggcgggaggagccgctggcatcgtcggaggtggacatggatgagccagacgctcctgagagcgggggcatgattgttgatggcaacaatggctgctccagagggagccccttgcagcccatgggatcccaagaattccaggggctgtgcggtcaagccaaccttcggtgaagttcaaacttccggggaggagctgggacttggacct

SEQ ID NO: 54027 - protein, 79 aa, Zea mays
  misc_feature: Ceres CLONE 1477135-F
MEVDRKKNLQIGSKGKEVQSKNPRREEPLASSEVDMDEPDAPESGGMIVDGNNGCSRGSPLQPMGSQEFQGLCGQANLR

SEQ ID NO: 54028 - DNA, 515 bp, Zea mays
  misc_feature: Ceres CLONE 1477136-F
  misc_feature: Encodes the peptide sequence at SEQ ID NO. 54029
  misc_feature (193)..(193): n is a, c, t, g, unknown, or other
  misc_feature (194)..(194): n is a, c, t, g, unknown, or other
  misc_feature (206)..(206): n is a, c, t, g, unknown, or other
  misc_feature (207)..(207): n is a, c, t, g, unknown, or other
  misc_feature (218)..(218): n is a, c, t, g, unknown, or other
aaagctggagctccccgcggtggcggccgctctagaactagtggatcccccgggctgcaggaattcgtctcacccctagaaaaaagggtccacttcgctcgcaaccttccccagccatggcgaccgcgacgcggaggctgctccccgcgctcctcaagaccctagctccagccggcgcgcgcggcctctccanncgagaaggctgnntttggtgaaanccgccgtcgtcggcagcaacacggtaagttggatgccggaaaccccgagccagaaattcccccatgggactgatcaacagggtcctcgaatcaagggttaagggcccctttgccctccttgaaaaggggtttcgaaaagggttggattggccccccaattgaaaacttcgccctggtctgggaggccctaatgggggaaaaacggggggccccctttttttcaatttcccccccctaaattgggaaaaaattcccccctccccccccaaaaaaattttgtggaagtttttttccccc

SEQ ID NO: 54029 - protein, 32 aa, Zea mays
  misc_feature: Ceres CLONE 1477136-F
  misc_feature (26)..(26): Xaa is any aa, unknown, or other
  misc_feature (30)..(30): Xaa is any aa, unknown, or other
  misc_feature (31)..(31): Xaa is any aa, unknown, or other
MATATRRLLPALLKTLAPAGARGLSXREGXXW

SEQ ID NO: 54030 - DNA, 718 bp, Zea mays
  misc_feature: Ceres CLONE 1477141-F
  misc_feature: Translation starting site: 557
  misc_feature: Pfam Name: DAHP_synth_2 Pfam Description: Class-II DAHP synthetase family
  misc_feature: SWISSPROT Homolog: EC 2.5.1.54 3-deoxy-7-phosphoheptulonate synthase
  misc_feature (674)..(674): n is a, c, t, g, unknown, or other
  misc_feature (718)..(718): n is a, c, t, g, unknown, or other
aaactggagctcaccgcggtggcggccgctctagaactagtggatcccccgggctgcaggaattcgtctcacccctagaaaaaagaggagagagtcgctctgcactgcacgactcctcccccatctaccactacctgtctacctacccagcccatcgactgcccctcgcaacgcaatggcgctcgccaccaactccgccgctgccgcagcagctgccgtatccggcggcgcggcatcccagccgcaccgcgcggccacgttcctcccgctgaagaggcgcaccatctccgccatccacgccgccgacccgtctaagaacaacgggcccgccgtccccgcggccgccgccgctaagtcatctgcctctgcggtggccacgccggagaagaatccggcggcgccggtaaagaagcccccccccaccactggaaaacgaagaaggcgctgcagctcccagagtacccaaaccaggaggagctggacacggtgctcaagaccatcgagacgttcccgccggtggtgttcgcccggagaggcgcgtcacctcgaggagcgcatggccgaagccgccttggcccgcgccttcatcctccagggcggcgactgcgcccaagagcttcaaggaattccccgccaagcaacatccgtgaaccccttccggtatcctgcttcanaaagggcccccgtgcttacgtgtcggaggcacagttgcccgccn

SEQ ID NO: 54031 - DNA, 627 bp, Zea mays
  misc_feature: Ceres CLONE 1477143-F
  misc_feature: Encodes the peptide sequence at SEQ ID NO. 54032
  misc_feature (627)..(627): n is a, c, t, g, unknown, or other
aagctggagctccccgcggtggcggccgctctagaactagtggatcccccgggctgcaggaattcgtctcacccctagaaaaaaaacccgacacatccaggcgtacagccctccgcctcgtgaaggcaaagcacgcgcaaagccaccacagcgtcgtcctcttcgtctccagtccaagcaagcgaagagcacccctcgagatctctccctccccgcgccgccatggacgcagttgactcggtagtcgacccgctccgggagttcgccaaggacagcatccgcctcgtcaagcgctgccacaagccggaccgcaaggagttcaccaaggtcgccgcgcggactgcgatcggcttcgtcgtcatgggattcgtcggcttctttgtcaagctcatcttcatccctatcaacaacatcatcgtcggctccggctgatccgttcacctcaggctagtggctgcaggagtggacaatggcgtcactaccttggaggcagcaccgttttcagctctgatttccgcaaagcaattcctttaggacttgtgttgttaaagggcaactcccttatctttttctctcttgaggtcgtgtggtagatctggaactcttttgtacctgtgccgaatagtn

SEQ ID NO: 54032 - protein, 69 aa, Zea mays; identical to SEQ ID NO: 51077
  misc_feature: Ceres CLONE 1477143-F
  misc_feature (10)..(66): Pfam Name: SecE Pfam Description: SecE/Sec61-gamma subunits of protein translocation complex

SEQ ID NO: 54033 - DNA, 708 bp, Zea mays
  misc_feature: Ceres CLONE 1477144-F
  misc_feature: Encodes the peptide sequence at SEQ ID NO. 54034
  misc_feature (383)..(383): n is a, c, t, g, unknown, or other
  misc_feature (413)..(413): n is a, c, t, g, unknown, or other
aagctggagctccccgcggtggcggccgctctagaactagtggatcccccgggctgcaggaattcgtctcacccctagaaaaaacgaccagcggtcagccccctttcggcctttccctcccatatactcgccgtcggccagcggatctaatcggggcgggcgcgatggctgggcagaaccagcggctcaacgtcgtgccgacggtgacgatgctcggcgtcatgaaggctcggctcgtcggcgcgacccgcggccacgcgctgctgaagaagaagtccgacgcgctgacggtccagttccgcgccatcctcaagaagatcgtcgccgccaaggagtcgatgggcgagacgatgcgcgcctcctccttcttccctcgcgaggcnagtacgtcgctggcgaacgcgtcggccacntcatcctcaagtccgttcggcgcggatccggtcggggtcgctcccacaagaagacgtggccgggggcaggttcccaagttaccccatttttcaacccccccgggcctccgggggcccttcaaaggtcccaaacctaagggtcttggcccgggggggaaaaaggtcccccttccccttccccacaataaagggcaaaagggggttttcaagatttccatcttttaaacccttctctcctttcttgggggggttttaaaacccccccccgccgggaaaaacgtttaaagaaaactcc

SEQ ID NO: 54034 - protein, 157 aa, Zea mays
  misc_feature: Ceres CLONE 1477144-F
  misc_feature: SWISSPROT Homolog: EC 3.6.3.14 H(+)-transporting two-sector ATPase
MAGQNQRLNVVPTVTMLGVMKARLVGATRGHALLKKKSDALTVQFRAILKKIVAAKESMGETMRASSFFPREASTSLANASATSSSSPFGADPVGVAPTRRRGRGQVPKLPHFSTPPGLRGPFKGPKPKGLGPGGKKVPLPLPHNKGQKGVFKISIF

SEQ ID NO: 54035 - DNA, 531 bp, Zea mays
  misc_feature: Ceres CLONE 1477145-F
  misc_feature: Encodes the peptide sequence at SEQ ID NO. 54036
  misc_feature (300)..(300): n is a, c, t, g, unknown, or other
  misc_feature (374)..(374): n is a, c, t, g, unknown, or other
catagctggagctccccgcggtggcggccgctctagaactagtggatcccccgggctgcaggaattcgtctcacccctagaaaaaacagcagcttcctttcctccggcgatggcgaagaatcccaaagatgccgctccggaggaggagatgcccgccgcggccgaggaacaggcagcgcctgccgcgacggtgaaggtgctcttcttcgcccgcgcgcgggacctaacgggcgtggcggattccgcggtggaggtgccgccggggagcaccgtgggggagtgcctcgcgcgggtcctaanccagttccccaagctgaagagatccggggctcctcgtgctcccgcttcaccaggaattaggcggcccctttggncccgggccccaaaggaaaaatttcttgattccccccaaaggggggggaattttttacccacccccattgggggggggggtataaaaaatttaaaacccccccggggggggaaaaaaaaagggggggaggggcccctccccccccctggggggaggta

SEQ ID NO: 54036 - protein, 140 aa, Zea mays
  misc_feature: Ceres CLONE 1477145-F
  misc_feature (64)..(64): Xaa is any aa, unknown, or other
  misc_feature (89)..(89): Xaa is any aa, unknown, or other
MAKNPKDAAPEEEMPAAAEEQAAPAATVKVLFFARARDLTGVADSAVEVPPGSTVGECLARVLXQFPKLKRSGAPRAPASPGIRRPLWXRAPKEKFLDSPQRGGNFLPTPIGGGGIKNLKPPRGGKKKGGEGPLPPPGGR

SEQ ID NO: 54037 - DNA, 692 bp, Zea mays
  misc_feature: Ceres CLONE 1477148-F
  misc_feature: Encodes the peptide sequence at SEQ ID NO. 54038
atagctggagctccccgcggtggcggccgctctagaactagtggatcccccgggctgcaggaattcgtctcacccctagaaaaatctactcccatttctctgcacgcagctcagtctcgtccatccagtgctgtagaattttctttggtctgttggcaaggcagccatgaaaccccctcagctgccggcaggggagggggcctcctgggctcacgaggtcaagcaggccctccgtgagaaactccggcgctcctacggcgccggagctgcctccgccacaccggaggccaggccggccggcgaaccaagccgtggcgctgagtgccgcggctcggcggccgaagaccccataaggagagtcatgctcctggctccctgggggcgcacataaaaacacaaaacccgccgggccaagatctgggcatgcaaaccttgcatgcgcctgtctttggtcagtccaaatctgcaacaacccaactggtaaaaaaaaactggaaccctggtcttggaaaaccttggaagcttggcgcctgcttgccacccataaaaaaaattgaaaccccttggaaaaacttggtttaactaacctccgggaagaaaaaaaaattaccaatacgggggcaatagaacgggggggggaaccaaaaattaaataaccaggggcaccgctggccccctggacccccggggtc

SEQ ID NO: 54038 - protein, 74 aa, Zea mays
  misc_feature: Ceres CLONE 1477148-F
MKPPQLPAGEGASWAHEVKQALREKLRRSYGAGAASATPEARPAGEPSRGAECRGSAAEDPIRRVMLLAPWGRT

SEQ ID NO: 54039 - DNA, 695 bp, Zea mays
  misc_feature: Ceres CLONE 1477150-F
  misc_feature: Encodes the peptide sequence at SEQ ID NO. 54040
  misc_feature (312)..(312): n is a, c, t, g, unknown, or other
  misc_feature (414)..(414): n is a, c, t, g, unknown, or other
  misc_feature (415)..(415): n is a, c, t, g, unknown, or other
  misc_feature (432)..(432): n is a, c, t, g, unknown, or other
  misc_feature (433)..(433): n is a, c, t, g, unknown, or other
aaactggagctccccgcggtggcggccgctctagaactagtggatcccccgggctgcaggaattcgtctcacccctagaaaaaaaaaccctaagaaacccaccctccctccagtctcctcgacccccgccgccgccgccgccatcacaacccagagcaccccctccccaccccaccctgtcccgatggctgcggacgccgccgctgcggcgatgtccgcgacttccctctgcgacgatctcgagcccgccaccgtgcgcacccgcatccgcgatgtcctggccgcaggtgccgcgcgtgccggggaaccccntcttggtcggggggtggttccggacgggccgggagcagggaagggctctttcgccttcttggagtcacaaagggtcctgcgttgccaggtttaagaaattannaaacccccggggtcccnnaaaggggcctaaccgccccggaacctcctcctttttaaggggggattaaggacccccccaaggggcccaagaaaaactttaacttaaaggcccccccctgttttttagggtgggaaaggtaaaaaccccctttattacccttttcccagggggaggggggaaaaacctccccctcacaaaaaattcaggggccctgtttttttttttttttttctccgccacaaaaaacatatgtggggggcgttgtttcataataaaaacg

SEQ ID NO: 54040 - protein, 73 aa, Zea mays
  misc_feature: Ceres CLONE 1477150-F
  misc_feature (43)..(43): Xaa is any aa, unknown, or other
MAADAAAAAMSATSLCDDLEPATVRTRIRDVLAAGAARAGEPXLGRGVVPDGPGAGKGSFAFLESQRVLRCQV

SEQ ID NO: 54041 - DNA, 639 bp, Zea mays
  misc_feature: Ceres CLONE 1477153-F
  misc_feature: Encodes the peptide sequence at SEQ ID NO. 54042
  misc_feature (473)..(473): n is a, c, t, g, unknown, or other
tggagctcaccgcggtggcggccgctctagaactagtggatcccccgggctgcaggaattcgtctcacccctagaaaaatcttatcccaaacacaacccacactactaccctacccgtccgcctctatcgaaagcgcagcatcagcgagcatgtacgcctgacaccgcactcctggcgggcacggtggtgcctcctgcctgcggaccagtctccagcgaggcacgcccgccattactccgatctgcttctccccgctccacggcggcggacgcgcagacctgggcgtggagtgctcttcgcgcacgcataagaatgtgaccaagcaccacatgaagacgcgaccatgtaagacacagacgtgttacatcaagcgccgccgcacgcattacccgccgtgtgcgacactccctccggaatggacgatagtcgccatcagcgcacgctggacatggatgaagctgacgccactggnatcctccgctactctagtcctcgaggtgcccagcacaccgactgaagtctccccattttgtccccaaaattggtcaccttgacctccacagaagctggttttacttggagaattattagacaaaacaatggctgcccagattttttgataataaataacaaccttg

SEQ ID NO: 54042 - protein, 74 aa, Zea mays
  misc_feature: Ceres CLONE 1477153-F
  misc_feature (48)..(48): Xaa is any aa, unknown, or other
MKTRPCKTQTCYIKRRRTHYPPCATLPPEWTIVAISARWTWMKLTPLXSSATLVLEVPSTPTEVSPFCPQNWSP

SEQ ID NO: 54043 - DNA, 704 bp, Zea mays
  misc_feature: Ceres CLONE 1477154-F
  misc_feature: Translation starting site: 379
  misc_feature: Pfam Name: APC8 Pfam Description: Anaphase promoting complex subunit 8 / Cdc23
aaagctggagctccccgcggtggcggccgctctagaactagtggatcccccgggctgcaggaattcgtctcacccctagaaaaactcgtccgcgacctccgcagggtggctgttgcacttgcacctgcaccgtagtggggattccagcttccaccactgcccccgtccccgtcccggcgccggcagtagctcggaggccggaaccacgctcggtggtcggtggcgtgtcgtacgtcagcacgcccatcccgacgacgacgcgttcgattcaggcggcgacaaatacctgctggccaagacctatttcgactgccgggagtaccgccgcgccgagcacgtgctgcagaaccaggtcgggcgtaaggctgtgttcctgcgatgctacgccttctgcatgagtgcatgtctggagagaagcggaaagaggcagagatgatagagtttgaagggtcattgggcaagagtaatgctgttaatcaggaactagttgctttggagaaagagctctcaacacaccgaagaactggctctattgattcgtttggactctacttgtatggcattgtcctacatgaataaggatgtgaaggtctaactagaacgatcttggtagaacctgtcaatagctatccttggaactggaatgcttggtcagagctacaaactttatgcagcagcagtgacattttaaaaaaaataaatct

SEQ ID NO: 54044 - DNA, 707 bp, Zea mays
  misc_feature: Ceres CLONE 1477160-F
  misc_feature: Encodes the peptide sequence at SEQ ID NO. 54045
  misc_feature (453)..(453): n is a, c, t, g, unknown, or other
aaagctggagctccccgcggtggcggccgctctagaactagtggatcccccgggctgcaggaattcgtctcacccctagaaaaaaacttggccccaaatcgtggagtggaaaccctactcgtccccttccgcagccggtactcaaccccaaccctatcctgtccgccgccgtcgcccggcgcctcctcccccacctagaaacccagaggctctaatcctagttctttctgtgcagtcgccgcccaattcccccacccaattcccactctccgctcgacagatccatacatgatgggagaggccaaggagaacgacgtttatgaggaggagctcctggactacgaggaggacgacgacaagacggtcgatggctccgctgctaagcccaccggagaggtcgcaaagaagggctacgtcggggatcacagttccggtttcagagacttcctgctncagccagagctgctccgtgctatccaggaatgtggttttgagcatctttccgaagtacactttcttcttttgagcagaacatggaaaccttttcatttaccatggattcggaagggtaaacttttacctccctgggtggctgcccccaattctttttggttccccatcagggcaacacaaagggaatccttccagccattccttggaagggaggcatcttgccaagctaaatctggggagggggaaaaactgtg

SEQ ID NO: 54045 - protein, 139 aa, Zea mays
  misc_feature: Ceres CLONE 1477160-F
MMGEAKENDVYEEELLDYEEDDDKTVDGSAAKPTGEVAKKGYVGDHSSGFRDFLLQPELLRAIQECGFEHLSEVHFLLLSRTWKPFHLPWIRKGKLLPPWVAAPNSFWFPIRATQRESFQPFLGREASCQAKSGEGEKL

SEQ ID NO: 54046 - DNA, 783 bp, Zea mays
  misc_feature: Ceres CLONE 1477165-F
  misc_feature: Encodes the peptide sequence at SEQ ID NO. 54047
aaagctggagctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccatggtaaccgcaccacgccctcgtacgtcgccttcaccgactccgagcgcctcatcggagatgcggccaagaaaccaggtcgccatgaaaccccatcaacaccgtctttgatgccaagcggtctcatcggccaggaggttcaacgccccccctccccccaaagtgatatccaggttgggggcccttcaagggccatttcttggccctgggtgaaaagccaaatgattggtttttcacaccccaaggttggagggaaaaacccattttgccgcttaaaaagattctccccctttgggttctttttccaaaaagcggggaaaattctttagaacctaacttttggaaccccaaacaaaaaaggttgggggcccccaacccctcgccttctttaaagaggcccaaaagggcgggcgccccaaaaaaatgcgggggggaattatggtgcccattatggggggggagggaaaaaaacaaaagacaccaagtgtgttcctttcccgcagtggggt

SEQ ID NO: 54047 - protein, 144 aa, Zea mays
  misc_feature: Ceres CLONE 1477165-F
MAGKGDGPAIGIDLGTTYSCVGVWQHDRVEIIANDHGNRTTPSYVAFTDSERLIGDAAKKPGRHETPSTPSLMPSGLIGQEVQRPPSPQSDIQVGGPSRAISWPWVKSQMIGFSHPKVGGKNPFCRLKRFSPFGFFFQKAGKIL

SEQ ID NO: 54048 - DNA, 696 bp, Zea mays
  misc_feature: Ceres CLONE 1477166-F
  misc_feature: Encodes the peptide sequence at SEQ ID NO. 54049
aagctggagctccccgcggtggcggccgctctagaactagtggatcccccgggctgcaggaattcgtctcacccctagaaaaaatctcttccagtcttcctacacccctgtcggcgcgttctccgcatcccggtgagcggtgttctccgatttggggggcgtcccttgcacgctccggtctgctgctcctccgccctccggagtcctgtccaacggagcgcgctacggcacagatcgaccgccgtccatccctttcccagctctccagtgcctccgccgccgcgtccggtgagcacgtctcgaccggtttccagataactgcataaggccgagctcatgcaaagcaaaatggtgctatgccagggcgtatctgttggaaatgctcagttgctagcttttcctggtagatcatcaagccttaagagcacccagtttcttgttaaaacgaatcattttcctgcaagagctctacgtgttggtactgattctattcatcatgccatgcctacatcatccccaagggaaaattctgtcaggggaatcccatcactatcaagacagcacaatcagcatccaaggtccggttagttgtcaggcatcctcactggcatctttcagctaccctgagctgacatccaaacccagatggtgggtggagaactctagcctgtgtgccgtacttggctgcactgcaca

SEQ ID NO: 54049 - protein, 79 aa, Zea mays
  misc_feature: Ceres CLONE 1477166-F
MVLCQGVSVGNAQLLAFPGRSSSLKSTQFLVKTNHFPARALRVGTDSIHHAMPTSSPRENSVRGIPSLSRQHNQHPRSG

SEQ ID NO: 54050 - DNA, 725 bp, Zea mays
  misc_feature: Ceres CLONE 1477167-F
  misc_feature: Encodes the peptide sequence at SEQ ID NO. 54051
tacccgcggtggcggccgctctagaactagtggatcccccgggctgcaggaattcgtctcacccctagaaaaaatcccaatctcgcgagggcaagcagcagggtctgcggcggctgccgccgtcaccgccccttccttcgacgcaccagcgccagcccgcgccgtggccagaaggaggttcttcaccgagcgcgcctcactactaaaggtcactagcaccgccgccagtgcgacggatgcggctgccatgcttgccggcggtgccctgtctcatgaagtgctgcttggtccatgcgacgcgaggctcaccttcaagccaagccatctcatcgacgaggccggcgaaaccatcttatttgttaacaatgtgttgcttcccgcacaatgactttttctattgttcccccccccccccaacggtcgttcaacccccctaataacttccccggaagagcaccaccaagcggtaaggggaaaacctaaatccaaaaaacttcaccgtgccagggaacctaattccttccactgctaacccgcatccaagaatctgcgatgggtccataataatccacgtcaaacgcacttagataaaccattgacccgtcattcgccgggaacgactcacctggatggcctatgtgttatagcaaagtcccgacataaccgtactagccccccccccgggaattacctggtcttaagcaaaaaaatctatttccctacca

SEQ ID NO: 54051 - protein, 128 aa, Zea mays
  misc_feature: Ceres CLONE 1477167-F
TRGGGRSRTSGSPGLQEFVSPLEKIPISRGQAAGSAAAAAVTAPSFDAPAPARAVARRRFFTERASLLKVTSTAASATDAAAMLAGGALSHEVLLGPCDARLTFKPSHLIDEAGETILFVNNVLLPAQ

SEQ ID NO: 54052 - DNA, 716 bp, Zea mays
  misc_feature: Ceres CLONE 1477594-F
  misc_feature (203)..(203): n is a, c, t, g, unknown, or other
aaactggagctccccgcggtggcggccgctctagaactagtggatcccccgggctgcaggaattcgtctcacccctagaaaaaagccgccgccggcctccaactctaaccccgttgcttccggctcccgcagcgtcgccgaccttcacagccggttccttcctccgccaccatggggaagacacgtggtatgggagctggccncaggctcaagaccccccgcaggaacagaagtgggttgacaaagcatacaagaaggagccctttgggaatggacggaaaaaacctttttcctggataatcctcccccaagggcttctttcttggaaaagatgggttttgagggcaaaccgcccaatttgggttttccccccccccccgggggggggggggggtgggggattccaaacaaaaattccccccccccccccccggagggtggggggggctaaaatcccgcccggaggaaaaccggcgccccctctccgtccccccgcttttgggcaccaaggggctaggcgccccgggagaacctttccccggggggaggggtctcacggggttgcaagagggccctctggtgggcacccctcttccgaccgccctcgagagcaacacgagccgagcaccccaggttcttaagtgactccttctcacagatgtaaagtggggccggatagccgcgtgtgtgtttttatctgtcccttgcagccgccc

SEQ ID NO: 54053 - DNA, 676 bp, Zea mays
  misc_feature: Ceres CLONE 1477596-F
  misc_feature: Encodes the peptide sequence at SEQ ID NO. 54054
  misc_feature (339)..(339): n is a, c, t, g, unknown, or other
aagctggagctccccgcggtggcggccgctctagaactagtggatcccccgggctgcaggaattcgtctcacccctagaaaaagcccctcgtcagcggattagatagggggcaggcagcagaggttcccggctccttcgcggcgctgcttatctcccgctcccggctcccctcctcccccgcgccgcgatgaacacagccatggccaccacctccttatccctccaaggccgcccatcccacgctcccactaggaagctctcctccccgttcctcggagcccccgcgtcctttctccggccgctggctcccacgcccgccgccggcccctcctcgaggnggacgcttgctgtcagggccatggcgccctcccagccgggaggggcagccaagaaagtggtgggccttataaagctggcgctcgatgccggcaaagcgacgcctgcgccgcccgtcggcccggcgctcggtgccaaggagtcacatcatggcgttctgcaagggagtacatgccagacggccgaacagcccggctacatcatccccgtcgagatcaccgtgtttgatgataagagctttaccttcgtcttggagaccccctcgggcttcagtcctgctactcaaggctgcaggtgtcaaaaaaggttcaaaagagccccaccggctgaaggggggaa

SEQ ID NO: 54054 - protein, 105 aa, Zea mays
  misc_feature: Ceres CLONE 1477596-F
  misc_feature (16)..(73): Pfam Name: Ribosomal_L11_N Pfam Description: Ribosomal protein L11, N-terminal domain
MAPSQPGGAAKKVVGLIKLALDAGKATPAPPVGPALGAKESHHGVLQGSTCQTAEQPGYIIPVEITVFDDKSFTFVLETPSGFSPATQGCRCQKRFKRAPPAEGG

SEQ ID NO: 54055 - DNA, 682 bp, Zea mays
  misc_feature: Ceres CLONE 1477612-F
  misc_feature (295)..(295): n is a, c, t, g, unknown, or other
ggagctccccgcggtggcggccgctctagaactagtggatcccccgggctgcaggaattcgtctcacccctagaaaaatttagctactttgtaaatagatttcacaaaaaaagtgttgggtactcacagactctaaaattcagagtctccatattcaaaagcgccacctaaataggattttttcagattagagaggctttcagcagcatggacgacttttactccttcaggtctgggctttttggcgccgccaggccagacattttgttgcaggtcgatgctgttgctggtcccngacaaagcatgcaggggtagccatgtcccaccgcccgaaagcacgcaggccccagcgtggatacatcccatgaggcaacgcgcttgagaggctttccagtttggtcgtgcatgtaatttggcagtgtctgatgccctcaccaccgtgagcagacgttctgaataatgggaggctagcacccgggtctcctgctgctcaggggggtactgggggttcatggggcctaggggctaaacttccaaaccttaaagacgacggtggggaaaacccggagaaaaaaaaaattcttggcccccctgccgggttgggtttttggggggggcgggaggaaagccacttttcaaggatgccctaacctggactgggcttccaagaacttttaactgg

SEQ ID NO: 54056 - DNA, 665 bp, Zea mays
  misc_feature: Ceres CLONE 1477616-F
  misc_feature: Encodes the peptide sequence at SEQ ID NO. 54057
  misc_feature (130)..(130): n is a, c, t, g, unknown, or other
  misc_feature (136)..(136): n is a, c, t, g, unknown, or other
  misc_feature (153)..(153): n is a, c, t, g, unknown, or other
  misc_feature (178)..(178): n is a, c, t, g, unknown, or other
  misc_feature (208)..(208): n is a, c, t, g, unknown, or other
  misc_feature (218)..(218): n is a, c, t, g, unknown, or other
  misc_feature (353)..(353): n is a, c, t, g, unknown, or other
  misc_feature (617)..(617): n is a, c, t, g, unknown, or other
aagctggagtccccgcggtggcggccgctctagaactagtggatcccccgggctgcaggattcgtctcacccctagaaaaactgcgactgtgagcttcgttcgttcagttcatccgtgttcttgtttgcnaggtcnagagagagaggatgtcntgctgcggaggcaactgtgggtgcngctccggctgcaagtgcggcaaccgctgcngagggtccancaagatgtacccggacatggctgagcaggtgaccaccaccacccaggctctcatcatgggtgtcgcaccatccagggggcacgccgagggcgggttcgagcggcccgcggagctgaaaacggcgggtgcagtgcngctggcactgccagtgcgacccctgcactggcggcagtgagctaggtgctccaccctgcaggccggccgaggaaactacctaatattatagctaaataagtatagcgcgtcgctgtgtgtgttccagtcagtcaatcatttagttgcgtgcatggctggcatgctctgattctaaatgatgatgatcgctgatggcggcttcgtgttcttgtatccctcccctgccccctccggggcttctggaggaaagcaagggggttgggnttggggtggggggggggcaccaccgggagcagggttaaccatttggcc

SEQ ID NO: 54057 - protein, 81 aa, Zea mays
  misc_feature: Ceres CLONE 1477616-F
  misc_feature (1)..(68): Pfam Name: Metallothio_2 Pfam Description: Metallothionein
  misc_feature (11)..(11): Xaa is any aa, unknown, or other
  misc_feature (21)..(21): Xaa is any aa, unknown, or other
  misc_feature (24)..(24): Xaa is any aa, unknown, or other
  misc_feature (69)..(69): Xaa is any aa, unknown, or other
MSCCGGNCGCXSGCKCGNRCXGSXKMYPDMAEQVTTTTQALIMGVAPSRGHAEGGFERPAELKTAGAVXLALPVRPLHWRQ

SEQ ID NO: 54058 - DNA, 659 bp, Zea mays
  misc_feature: Ceres CLONE 1477617-F
  misc_feature: Encodes the peptide sequence at SEQ ID NO. 54059
  misc_feature (261)..(261): n is a, c, t, g, unknown, or other
  misc_feature (269)..(269): n is a, c, t, g, unknown, or other
  misc_feature (270)..(270): n is a, c, t, g, unknown, or other
  misc_feature (371)..(371): n is a, c, t, g, unknown, or other
  misc_feature (400)..(400): n is a, c, t, g, unknown, or other
aaactggagctccccgcggtggcggccgctctagaactagtggatcccccgggctgcaggaattcgtctcacccctagaaaaaggatcggttccaacaccagccgccgtcatgtcgaagcgaggtaggggaagttcggctgggaacaagttccgcatgtcactgggtctaccggtgggcggccacgtgaactgcgcggaacacacgggcgccaagaacctctacatcatctccgtcaggggcatcaaggggcgcctcaccngcctcccnngtcgctgtgtcggcgacatggtcatggccaccggtaagaagggaaagcccgactcaagaggaagtgatgcccccgtcatctcccgcagcgcaagccgtgcntcacagggacgtgtctactgtacttcaangatatgctggattgattgtgatccccagggtgaaagaaagggtctgcaatccctgacctttcgggaggggggggctcacctttgcctaaggatcccaggccaacaaaccctttctttaaaaacttgttggattgttttaaacctgaaaaaaaccccccccaattggggtttcccgggttttaaagggggccttttacactttaagcgcccctttttgtttgggcccccccttttcggaaggaaaaaaatatttttggtg

SEQ ID NO: 54059 - protein, 183 aa, Zea mays
  misc_feature: Ceres CLONE 1477617-F
  misc_feature (19)..(129): Pfam Name: Ribosomal_L14 Pfam Description: Ribosomal protein L14p/L23e
  misc_feature (51)..(51): Xaa is any aa, unknown, or other
  misc_feature (54)..(54): Xaa is any aa, unknown, or other
  misc_feature (97)..(97): Xaa is any aa, unknown, or other
MSKRGRGSSAGNKFRMSLGLPVGGHVNCAEHTGAKNLYIISVRGIKGRLTXLPXRCVGDMVMATGKKGKPDSRGSDAPVISRSASRASQGRVYCTSXICWIDCDPQGERKGLQSLTFREGGAHLCLRIPGQQTLSLKTCWIVLNLKKTPPNWGFPGFKGGLLHFKRPFLFGPPLFGRKKIFLV

SEQ ID NO: 54060 - DNA, 602 bp, Zea mays
  misc_feature: Ceres CLONE 1477623-F
  misc_feature (257)..(257): n is a, c, t, g, unknown, or other
  misc_feature (322)..(322): n is a, c, t, g, unknown, or other
  misc_feature (335)..(335): n is a, c, t, g, unknown, or other
  misc_feature (381)..(381): n is a, c, t, g, unknown, or other
aagctggagctccccgcggtggcggccgctctagaactagtggatcccccgggctgcaggaattcgtctcacccctagaaaaaaaccctagtctcagagcagccgcatccacaacctgcctctctcgtcccctggcggcgtccgcggcaggatggcggaatctacggcgaggacggtgaaggatgtcaacccgcacgagttcgtcaaggcctactccgcccacctcaagcgctccggcaagatggagctccctgagntggtgacattgtgagactgcgaggtcaggagcttcctcctatgatcctgactgtactactcaggnctgcatccattgncaggagatctacctaagcaaggcatcggtgtgggtggctttcaaanatctacggtggccgccagaggaatggctcccgcccaccacacttctgcaagagcagtggtgcttgtgcacgcaacatcctgcagcagctgcagattatgggcatcatcgatgccgatcccaggggtggacccctcctccacaaccaaggaagggcgtgattctggaccaagtgggctggaagggtcccttgtaaacccttgaacattgtcatcctttggtt

SEQ ID NO: 54061 - DNA, 663 bp, Zea mays
  misc_feature: Ceres CLONE 1477627-F
  misc_feature: Encodes the peptide sequence at SEQ ID NO. 54062
  misc_feature (496)..(496): n is a, c, t, g, unknown, or other
aagctggagctccccgcggtggcggccgctctagaactagtggatcccccgggctgcaggaattcgtctcacccctagaaaaaatcgcatccatccaccacgcaccccaccaacccatacccataccagaggctctctgattttacttctcagcggtagatcggctgagcgagcgagcgagcgaggcacacggagctagctaaacagagcacacggatagaaaagcaagatgtcggacggcacggcgacctgcatcgacatcatcctcgccattatcctgccgccgctcggggtcttcttcaagttcggctgcggggttgagttctggatctgccttatcctcaccttcttcggctacctccccggcatcatctacgccgtctgggccatcaccaagtagccgggcggtgcgttagcatgcaatgcgcgcgcaggttgatctcgtggcgggggacgcggtgtgcacgtgtcttgagatgtgattcctccctccctngattagtgctgctgctcctgctgggtgagtactggtggatccaggcctttttatttcttgaatagtttgcccggctgaagaatcaggaccgcgtgctgggggttgctgctcagctccatgtacttgaaaacccgttcctccctgcagctgctgccccttctctcttt

SEQ ID NO: 54062 - protein, 56 aa, Zea mays; identical to SEQ ID NO: 52841
  misc_feature: Ceres CLONE 1477627-F
  misc_feature (6)..(56): Pfam Name: UPF0057 Pfam Description: Uncharacterized protein family UPF0057

SEQ ID NO: 54063 - DNA, 653 bp, Zea mays
  misc_feature: Ceres CLONE 1477629-F
  misc_feature: Encodes the peptide sequence at SEQ ID NO. 54064
  misc_feature (458)..(458): n is a, c, t, g, unknown, or other
  misc_feature (495)..(495): n is a, c, t, g, unknown, or other
  misc_feature (537)..(537): n is a, c, t, g, unknown, or other
aagctggagctccccgcggtggcggccgctctagaactagtggatcccccgggctgcaggaattcgtctcacccctagaaaaaagctagctggctagcatggccgggaaagagcttacgctgctggggttatgggcgagcccgttcgtgctccgggcgcgcatcgcgctcagcctcaaaggcctcacctacgcttactccgaggagaacctcgacgacaagagcgagcttctcctcagctccaaccccgtgctcaagaaggtgcccgtgctcatccaccacggcaagcccgtctgcgagtcccagatcatcgtgcagtacgtcgacgaggctttcccggccgccacacctaatttccttccatccgacccctacgaccgcgccattgctcgcttctgggcctcctacgtcgacgacaagttctacagcgcgtggatacccgtgttcaggggcaggacngcggaggagatggcggaggcggcgaggcaggccgtcncggcgctggagacgctggagcaggcgttcagggagtgctccnaggggaaggccttctcggaggggacagcgtggggctcgtcgacgtcgtgctcggcggcctttgttggggtggctgtacgccaccgaggccatctggcggggtgaacgccctcgacg

SEQ ID NO: 54064 - protein, 180 aa, Zea mays
  misc_feature: Ceres CLONE 1477629-F
  misc_feature (4)..(77): Pfam Name: GST_N Pfam Description: Glutathione S-transferase, N-terminal domain
  misc_feature: SWISSPROT Homolog: EC 4.4.1.5 Lactoylglutathione lyase
  misc_feature (133)..(133): Xaa is any aa, unknown, or other
  misc_feature (147)..(147): Xaa is any aa, unknown, or other
MAGKELTLLGLWASPFVLRARIALSLKGLTYAYSEENLDDKSELLLSSNPVLKKVPVLIHHGKPVCESQIIVQYVDEAFPAATPNFLPSDPYDRAIARFWASYVDDKFYSAWIPVFRGRTAEEMAEAARQAVXALETLEQAFRECSXGKAFSEGTAWGSSTSCSAAFVGVAVRHRGHLAG

SEQ ID NO: 54065 - DNA, 662 bp, Zea mays
  misc_feature: Ceres CLONE 1477630-F
  misc_feature (272)..(272): n is a, c, t, g, unknown, or other
  misc_feature (358)..(358): n is a, c, t, g, unknown, or other
  misc_feature (488)..(488): n is a, c, t, g, unknown, or other
  misc_feature (537)..(537): n is a, c, t, g, unknown, or other
aagctggagctccccgcggtggcggccgctctagaactagtggatcccccgggctgcaggaattcgtctcacccctagaaaaaatcgccgaggaaccaaagctagagacaaccgctgcgtaaacgaatccatcgccatggcgtctcgtctcgttgcggcggcggcctcctcctcctccctctcctcagcgtcccccctcgctcgcctaatctctcgccgcggccttgccggtgccgcagacggccatgggtctgcgaaggtgcccttgtggnaagatccgttgagcccgagcaagtgggaggaagagcactttgttctagcaagcctctcaatgtgggggggtattttttatggtggnttacagctttttagtggaaagaaggaaacaagactgaggcggcatcaccccaggcataggtggcggagatggagttctacccatatctgtggcctggacacaatgttaaataaagggaatgctttatgtngtgctttcaagttgataattgtggcaacaggagattttgcttttcctangcgatatattgagaagctactcttactcatccccatgaataatctttgctgcagtggaacttcatgtcggcgaaaatgccaaaggtgtacttcttcatgcaattgagaagttgatgttttcctcc

SEQ ID NO: 54066 - DNA, 633 bp, Zea mays
  misc_feature: Ceres CLONE 1477636-F
  misc_feature: Encodes the peptide sequence at SEQ ID NO. 54067
  misc_feature (231)..(231): n is a, c, t, g, unknown, or other
  misc_feature (232)..(232): n is a, c, t, g, unknown, or other
  misc_feature (435)..(435): n is a, c, t, g, unknown, or other
  misc_feature (436)..(436): n is a, c, t, g, unknown, or other
ctccccgcggtggcggccgctctagactagtggatcccccgggctgcaggaattcgtctcacccctagaaaaagaggcccagatagatctttcccccgtcctccctcgccttcgccttcgccggcaggagatttccaccaccaccgccgaaccgccccgaccctcctcccctctcgcgctatggcccagactgttgtgctcaaggttggcatgtcctgtgagggctgtgtnntgagctgtcagcgggtcctcgggcagatggaaagcgtcgagtcctacgacgtagacatcatggaaacagaagtcaccgtgagggcaatgtgacacctgacgccgtccctgcaactgtttccaagactggcaagaaagcctttcgttctggggaggctgaggcccgtgacaaagtaaatccccccacaccttggccggggcccnncccccttgaaaggggttcaaataatcttgaaaagtgcccccgggaaagggcgaaaaaaaaaaaaaaaaaaaggggggagggtgttttttggcggttggggatcccgtgtaaaaaatatattttgaaaaacggggggaacccccgggggttgtggaaattttttttagcggggggggcttattatctggggggggggg

SEQ ID NO: 54067 - protein, 47 aa, Zea mays
  misc_feature: Ceres CLONE 1477636-F
  misc_feature (18)..(18): Xaa is any aa, unknown, or other
MAQTVVLKVGMSCEGCVXSCQRVLGQMESVESYDVDIMETEVTVRAM

SEQ ID NO: 54068 - DNA, 605 bp, Zea mays
  misc_feature: Ceres CLONE 1477638-F
  misc_feature: Encodes the peptide sequence at SEQ ID NO. 54069
  misc_feature (235)..(235): n is a, c, t, g, unknown, or other
ctggagctccccgcggtggcggccgctctagaactagtggatcccccgggctgcaggaattcgtctcacccctagaaaaggacagccccgccgccgcaacatcccgagtcgctcgtcagatcctccagcaacacagcaccttcgccgccgccgccatgggtaaggttcacggatcgctggcccgcgctgggaagtgcgcggccaaacccccagggtgcaaagcaggacaagaagngaagccccgcggccgcgctcacaagcgcatgcaatacaaccgccgcttcgtcaccgccgtttgttggattcggcaagaagcgcggccccaactcatcggaagaggtagatctagctatggctttgtggtttatcccccactagtttcctcactgatgggaacttgcttaaaacttatgctaatatctggatcgatggttccggcaaaactgttaaagaagaaaatatgcctcgtttaatttgaacaaagtgcctgggggggaaaaccctttaagtttgcccgagaaggttgaaaacatttttttggccccgccttgttcccctttttgtttagaaaccggggaaccttttttaaatcaaaaaaaaaaaaa

SEQ ID NO: 54069 - protein, 105 aa, Zea mays
  misc_feature: Ceres CLONE 1477638-F
  misc_feature (3)..(60): Pfam Name: Ribosomal_S30 Pfam Description: Ribosomal protein S30
  misc_feature (27)..(27): Xaa is any aa, unknown, or other
MGKVHGSLARAGKCAAKPPGCKAGQEXKPRGRAHKRMQYNRRFVTAVCWIRQEARPQLIGRGRSSYGFVVYPPLVSSLMGTCLKLMLISGSMVPAKLLKKKICLV

SEQ ID NO: 54070 - DNA, 660 bp, Zea mays
  misc_feature: Ceres CLONE 1477642-F
  misc_feature: Pfam Name: CP12 Pfam Description: CP12 domain
  misc_feature (274)..(274): n is a, c, t, g, unknown, or other
  misc_feature (283)..(283): n is a, c, t, g, unknown, or other
  misc_feature (312)..(312): n is a, c, t, g, unknown, or other
  misc_feature (321)..(321): n is a, c, t, g, unknown, or other
  misc_feature (322)..(322): n is a, c, t, g, unknown, or other
  misc_feature (329)..(329): n is a, c, t, g, unknown, or other
  misc_feature (352)..(352): n is a, c, t, g, unknown, or other
  misc_feature (511)..(511): n is a, c, t, g, unknown, or other
aaagctggagctccccgcggtggcggccgctctagaactagtggatcccccgggctgcaggaattcgtctcacccctagaaaaatctcagtcactgccgtggccgccttgtccgctttctcggctcaaagaagcctcccgcagccgtaccgccagagggtcgtaacgttcatcgtcgtccggccggtgcgcgcgcaccgccggtttgtgggcggtggcggcagctcgccgcccacgccgccggatctcgcaaagaaggtgtccgagagcatcangcaggcccnagagacgtgcgcagatgacccggtgagcngcaagtgcnntggcgcntgggacgaggtggaggagctcancgcggccgccagccacttgcgcgaccggcagaagggcgccgacccgctcgaggagtactgcaaggaccaccccgagacggacgagtgccgcacgtacgaagactgaaccacgcgcgcgcgaggttggatcgctgtcacttgatctagctagcagcttanctcggcgtgatggcgacatgtgtagacatgcattggatcggggtatgatccttcgttgattcagtctggcgttggtgtgaataaaaccgagttttctgttttatataataacatttaggagctcctactgtattccaagggaggggtaa

SEQ ID NO: 54071 - DNA, 647 bp, Zea mays
  misc_feature: Ceres CLONE 1477648-F
  misc_feature: Encodes the peptide sequence at SEQ ID NO. 54072
  misc_feature (477)..(477): n is a, c, t, g, unknown, or other
  misc_feature (507)..(507): n is a, c, t, g, unknown, or other
  misc_feature (582)..(582): n is a, c, t, g, unknown, or other
aagctggagctccccgcggtggcggccgctctagaactagtggatcccccgggctgcaggaattcgtctcacccctagaaaaatctgcagcttcccgcaccgtatcctgcggaagaagtttctaacgggctacatcccaccaccgcacgatgtcggcagcggcgcgagtgctgccgaaggcggtgaccttcgtgacgggcaacgccaagaagctggaggaggtccgcgccatcctcgggtcttccgtcccattccagtcgctcaagctcgacctgcctgaactgcaaggggagccagagtacatatccaaagagaaagcacgaatcgctgcatctcaggtgaatgggcctgtactggtggaggacacctgcctatgttttaatgcgctcaaaggcctaccaggaccctacataaagtggtttcttgagaagattgggcatgaaggtttaaaaatatctgtaaaagcttatgaagatnaatcagcgtttgctatgtgcatcttctctnctcgctctggacctggagaggaaccaatcacatttgttggcaaaactgcggaaagatcgtgcctgctagagcccntatgattttggggtggatcctgtgtccagccagatggttttaacaaacaatgctgagatgccagg

SEQ ID NO: 54072 - protein, 144 aa, Zea mays
  misc_feature: Ceres CLONE 1477648-F
  misc_feature (12)..(144): Pfam Name: Ham1p_like Pfam Description: Ham1 family
  misc_feature: SWISSPROT Homolog: EC 3.6.1.19 Nucleoside-triphosphate diphosphatase
  misc_feature (110)..(110): Xaa is any aa, unknown, or other
  misc_feature (120)..(120): Xaa is any aa, unknown, or other
MSAAARVLPKAVTFVTGNAKKLEEVRAILGSSVPFQSLKLDLPELQGEPEYISKEKARIAASQVNGPVLVEDTCLCFNALKGLPGPYIKWFLEKIGHEGLKISVKAYEDXSAFAMCIFSXRSGPGEEPITFVGKTAERSCLLEP

SEQ ID NO: 54073 - DNA, 658 bp, Zea mays
  misc_feature: Ceres CLONE 1477656-F
  misc_feature: Encodes the peptide sequence at SEQ ID NO. 54074
aagctggagctccccgcggtggcggccgctctagaactagtggatcccccgggctgcaggaattcgtctcacccctagaaaaaaccctagcttgccgcgccgcctggatcgagcagccgagcgactaagcgaagactcccttttccccgagcacaagagaaccatggcggcggcggcagtatacggcggcttcaaggggaagcttggcgtcgaggatgcccccgagctgcagctcaaccgcatccgcatcacactctcatccaagaacgtcaagaacttggagaaagtttgtgcggatttggtaaagggagccaaggacaagcatttgagggttaagggacctgtcaggatccctactaaggttctccacatcaccactcgcaagtccccttgcggtgaaggaaacaacacatgggatcggtttgagttccgcatttcacagagggtgattgacctaatcagctcccctgatgtggtgaagcagatcacctccatcacaattgagcccgggtgtgagggtgaggtgaccattgccgacgtgtaaggacgtgaagttcagcaatgtcatcgacaatcttttttcttgtgctccctgtgtgctcgcaagagagattttgagttattattagcatacaagacttcctcccccctaaaaaaa

SEQ ID NO: 54074 - protein, 126 aa, Zea mays
  misc_feature: Ceres CLONE 1477656-F
  misc_feature (26)..(121): Pfam Name: Ribosomal_S10 Pfam Description: Ribosomal protein S10p/S20e
MAAAAVYGGFKGKLGVEDAPELQLNRIRITLSSKNVKNLEKVCADLVKGAKDKHLRVKGPVRIPTKVLHITTRKSPCGEGNNTWDRFEFRISQRVIDLISSPDVVKQITSITIEPGCEGEVTIADV

SEQ ID NO: 54075 - DNA, 668 bp, Zea mays
  misc_feature: Ceres CLONE 1477658-F
  misc_feature: Translation starting site: 209
  misc_feature (262)..(262): n is a, c, t, g, unknown, or other
  misc_feature (396)..(396): n is a, c, t, g, unknown, or other
  misc_feature (433)..(433): n is a, c, t, g, unknown, or other
aagctggagctccccgcggtggcggccgctctagaactagtggatcccccgggctgcaggaattcgtctcacccctagaaaaatccgccttcgcctccaaccgcgtgcgctccacgcctcctccaggaaagcgagagcttctgcataagaacaacaaatcaaaagcttgatcagctcggtgccaacaaaacctcaacaaccaagtttcatgtctgatctcgacgtccagcttccatctgcctttgatccgtttgctgaggcnaatgctgaggactctggtgctggtcctggaacgaaggattatgtgcatgtgcgcatccagcagcgcaacggcagaaagagtctgactacagtccagggtctgaagaaggagttcagctataaacagatcctcanggatctgaagaaggatttctgctgcatggtactgtangtcaggacccagagctaggccaggtcattcagctccaaggtgatcagcgcaagaatggtgctactttccctagtcaggctgggattgcaaaaaaggagaactcaagattcccggtttctaagggacttgtaaaggcttgggccctatatttggggcctccccatttgggggagcttaaccctccaaggtggcaagccattgcttttcttatataaaaaaaaagggggtatttcgt

SEQ ID NO: 54076 - DNA, 672 bp, Zea mays
  misc_feature: Ceres CLONE 1477668-F
  misc_feature: Encodes the peptide sequence at SEQ ID NO. 54077
aaagctggagctccccgcggtggcggccgctctagaactagtggatcccccgggctgcaggaattcgtctcacccctagaaaaaagtggcacagtgcacacactcgtctcatcggagaaaagtagatccgggttagggttttagacggcgatgggtgcggcgggcgacgagaaggctgcgatggctgcgtccgctgcagccgcgggggccggtgccgccgagggcgagggcgcggtggactccaaggaccttcagcagcagagcaaggcgctcgacaagctcactgatcatgtcgaggaccggcagctcgattcatcccgtgtccaatcccgcatggcggcacttgcttcatcccaggaggctgactggaacgcgatgaggctgagggagaaagaattggctgctgtcaagatcaaccctgccgatgtcgaaattatcgctagtgagcttgagctggacaaaaagatcgcggagagaaccctccgtgagcacaagggtgatgccgtgggctgcggttcgattcctgctggcctagttccgagatttccgtccccagcatcacatgtttccccttcagttccacacaagagggggatgatgtgaacccactattcccttttatcgggggggccggttttgggaagtttgcctataaaacctatgttgccaaaa

SEQ ID NO: 54077 - protein, 150 aa, Zea mays
  misc_feature: Ceres CLONE 1477668-F
MGAAGDEKAAMAASAAAAGAGAAEGEGAVDSKDLQQQSKALDKLTDHVEDRQLDSSRVQSRMAALASSQEADWNAMRLREKELAAVKINPADVEIIASELELDKKIAERTLREHKGDAVGCGSIPAGLVPRFPSPASHVSPSVPHKRGMM

SEQ ID NO: 54078 - DNA, 655 bp, Zea mays
  misc_feature: Ceres CLONE 1477673-F
  misc_feature: Translation starting site: 174
  misc_feature (359)..(359): n is a, c, t, g, unknown, or other
  misc_feature (393)..(393): n is a, c, t, g, unknown, or other
  misc_feature (467)..(467): n is a, c, t, g, unknown, or other
  misc_feature (469)..(469): n is a, c, t, g, unknown, or other
  misc_feature (502)..(502): n is a, c, t, g, unknown, or other
tggagctccccgcggtggcggccgctctagaactagtggatcccccgggctgcaggaattcgtctcacccctagaaaaaaaaagctccccaacgaagtgcgagcgacccacgtccacacgacacgaaccaccaccaccaaccagcagccgcaccacgcacccagcgcaaagcgatggcgtcgctcaccatgatggcgtccttcgccgccgtggcggtggccgcgccctcgcgccgcggcaccttcgccgtggtcaggtccgccaaggtcgaccgctgcccagagccccgcacgctagcagcaaccgaggccaggcccgcccgcgacggacgccgcgccgtcatgctcgcggctgctgcngcggccgtggcagccatcgggcggcgcggcgccnccatggcggccccaagaacgggacccccgaggcgaagagaagtacgcggccatctgcgtcaccatgcccaccgncnagggtctgcacaactgaccaccccgctttgcanctgcaggggccgggggtggtataataattagtgtacgtgccacggtgttgttttccctaattgtgggttcgagctttaaatgcatgcctgacgggaggcctctttaattgcttttctacgccctccgaactgtaaaaatatcaagtcccctgc

SEQ ID NO: 54079 - DNA, 668 bp, Zea mays
  misc_feature: Ceres CLONE 1477884-F
  misc_feature: Encodes the peptide sequence at SEQ ID NO. 54080
  misc_feature (216)..(216): n is a, c, t, g, unknown, or other
  misc_feature (221)..(221): n is a, c, t, g, unknown, or other
  misc_feature (224)..(224): n is a, c, t, g, unknown, or other
  misc_feature (226)..(226): n is a, c, t, g, unknown, or other
  misc_feature (227)..(227): n is a, c, t, g, unknown, or other
  misc_feature (239)..(239): n is a, c, t, g, unknown, or other
  misc_feature (240)..(240): n is a, c, t, g, unknown, or other
tggagctccccgcggtggcggccgctctagaactagtggatcccccgggctgcaggaattcgtctcacccctagaaaaaatcacacagcgccaccgcgtggttcgttaggaaaggaaatcgattcccccgcatccgatctcttcggtgctagagaaatataggccgccgcctcctcctcattcggtgaaaggtgggcggttagggttgggagattnctctntgnannctcacgacacgnnagcagccaggaaatttcgtttcggaaggggggcccggccctttggggggggttttttgggggccctttttgccgccgcgccccagaaaaagaaaaaagagagggggttgttttcccatttttcttgtccctcccttatatgttttcccccccccggtgaagatcccacgtactactacgctgatgattatgtcgccaaaaaaaccgaaaccgtttaggcggccataacgttcagacagatgacacttaaaaccacacccccccgcccgacttggtgtgatcctggcctattccagatacctccccctgacatacactcgtgagtccacgcccaattcaggcggacggtttgtacggtactcctattatttgcttcgtcgcccgccttttattttaaaacgtgggcaccgcgcttgctggcgcgcgtgg

SEQ ID NO: 54080 - protein, 35 aa, Zea mays
  misc_feature: Ceres CLONE 1477884-F
GAPRGGGRSRTSGSPGLQEFVSPLEKITQRHRVVR

SEQ ID NO: 54081 - DNA, 649 bp, Zea mays
  misc_feature: Ceres CLONE 1477885-F
  misc_feature: Translation starting site: 153
  misc_feature (518)..(518): n is a, c, t, g, unknown, or other
  misc_feature (583)..(583): n is a, c, t, g, unknown, or other
aagctggagctccccgcggtggcggccgctctagaactagtggaacccccgggctgccggaattcgtctcacccctagaaaaagtccaccctcccctaccccgcgtcctcctcccctacgcctcccagcccagcgacaaaacctaaccctagatgggcgccgtcacctctacggtcgcggcgcgctttccctttttcccgccgagcccgccgtcgtacgggaccgagctactcgcgccgcttccggcccctgccacacccgagcctccggccccggacacatccaagccgccgcctccggccccggccacacccaagccgccgcctccggccccagccacacccaagccgccgcccgcgggggaggagaaggtcggtggcgcggtggtggagctcacgggcgtcccgcggagggttaacccggaggcgcggcggctgcggacgaagcggggcacggaggtgatcgcgatgcacgtgcgccaggcgggggccaagctcacgctgccctacccccacggnaaccgccgccgacatcggccagatagacgagctcttcgtcgaactcagcggccccctcaaggctnacctcgtggggtaggactattcccgggcatggggcaatcctccatggacgcccgtggaccagaacg

SEQ ID NO: 54082 - DNA, 668 bp, Zea mays
  misc_feature: Ceres CLONE 1477888-F
  misc_feature: Encodes the peptide sequence at SEQ ID NO. 54083
ggagctccccgcggtggcggccgctctagaactagtggatcccccgggctgcaggaattcgtctcacccctagaaaaattgcattgtgcattgcattgcataaacctctcgtgggaagtgcaaacaccaaatccgcaatctatctatctatcagccattcaggcctgcaggctgcagctctctccactgcacactagagcgagctgccacagacaaggacacaatgccacccatacccaagagaggcgagcatctcctggtcctcctaattgtcgcatgcgctgccaccgccgccaccgccgccggcaccgtccccttctacccgtccgcggagtccgccgccgccgcgcactgcgacggcacgctgtacccggagctctgcctgtctacactcacggaaatcccggacccacccaaaaagccgctcccggacgtcatctgcgcggccgtgaaccgcaccgaggacgtggtggtcgccacgtccagtaactgctcgtactacctgcaggacaggtccctgtctggcgcgggaccgccctggccatcaaccactgcctggagctgcttgccccccccgatggacgagcttcggcgccagcaccggccaaactgggcccccccccccggccagggggtccaacatcccccgggacgtgtccccagggccg

SEQ ID NO: 54083 - protein, 148 aa, Zea mays
  misc_feature: Ceres CLONE 1477888-F
MPPIPKRGEHLLVLLIVACAATAATAAGTVPFYPSAESAAAAHCDGTLYPELCLSTLTEIPDPPKKPLPDVICAAVNRTEDVVVATSSNCSYYLQDRSLSGAGPPWPSTTAWSCLPPPMDELRRQHRPNWAPPPGQGVQHPPGRVPRA

SEQ ID NO: 54084 - DNA, 646 bp, Zea mays
  misc_feature: Ceres CLONE 1477890-F
  misc_feature: Encodes the peptide sequence at SEQ ID NO. 54085
tggagctccccgcggtggcggccgctctagaactagtggatcccccgggctgcaggaattcgtctcacccctagaaaaaccaccacccatcctcgcttctctcgagtcctcaatccatcctccggctgctccctcccagcgacgaaaccctagcccgtcacctcgacgcctagcccgccaccttgccgctcgtcgctgcaggtttatggcgcctgtgtgatcggatcagcagtccgctccgtctccctcggcccacgcatctgatgttcctctcccgcatcgtactccgcgacctggattccatcgactctccggcctccatggcgtcctcgaagaaggttgtgacccgtgacgagtgggagctgaagctccgcgacgtcaagatccgcaaggaggacatgaaccgcctcgtcatgaacttcctcgtcaccgagggcttcgtcgacgccgccgacaagtttcgcatcgagtccggcacccagcgtattacacgcttctctttctctcttccgctgttgaacttccttgggaattcgtccgaattcctgattttatttctgcagcggagattgacctagcgaccatcactgatcgaatggaggttaagagagcagtacagtcgggtaatgttcaggaggcgatcgaa

SEQ ID NO: 54085 - protein, 104 aa, Zea mays
  misc_feature: Ceres CLONE 1477890-F
  misc_feature (44)..(70): Pfam Name: LisH Pfam Description: LisH
MFLSRIVLRDLDSIDSPASMASSKKVVTRDEWELKLRDVKIRKEDMNRLVMNFLVTEGFVDAADKFRIESGTQRITRFSFSLPLLNFLGNSSEFLILFLQRRLT

SEQ ID NO: 54086 - DNA, 1846 bp, Zea mays
  misc_feature: Ceres CLONE 1477892
  misc_feature: Encodes the peptide sequence at SEQ ID NO. 54087
agtgtggctcaccttccactttcccccacctccaccatcgtgcctcagcatcagcactcgaatgccacgagactgacctctccctcgtcgccgcagccgcgatgcccgcaccgaccgccgagccggcgctcccggcggccttcctctgcgtcccgtccccgctcctctccacgccgctccccggcgctgcactctccgcctcccccgcgccctcctcccaccatgcctccttcctcccgcgcccgcgcggcgggccccgagcgctctccgtcgccatctccgtcccgggccccactttctccgtggcgtcgcggctccatcagatgtggggcgagttcgcgcggttcgtgcggctgcacgggaaccaaatagcgccgctcgggttcgcgtccatgggcctgggtttcggcggcggtggcggggataacgtcggcggtgggggaggagggggtggaggggatgtggatggggtaggcgaggtagaggaggccgcggcgcgggccgaggcgccaaagaaggtgctgatccttatgagcgacacgggcggcggtcaccgcgcgtctgccgaggccatcaaggctgccttcacccaggagttcggcgacgactaccaggtatttgtcactgatctgtggactgaccacactccatggccattcaatcaactgcctaggagctatagttttttggtgaaacatggacccttgtggaagatgacatactatggtactgcaccgcgtgtagtccatcagcctcattttgctgcaacatccacattcatagcaagagaagtggcaaaaggtctaatgaagtaccaaccagatgtaattatcagtgtacaccctttaatgcaacatgtccccctccgaattctaagatcgaaaggtctcttggataagatcccattcgcaactgttatcacggatctcagcacttgtcacccaacatggttccataagcttgtcactagatgttactgtccatcaactgaggtggaaaagagagcactaaaagctggactgaagcccgcacagattaaagtctatggcctccctgtccggccctcttttgtcaaacctgttcgaccgaaggatgagctgcgaagagagttaggcatggatgaagatctgcctgctgttctattaatgggtgggggtgaagggatgggtcctattgaggccactgctaaagcacttggtgattctctgtatgatgaaaacctaggggaacccactggtcaaatacttgtaatttgtgggcgtaataagaagctggtcaatcgattgcaatcaataaattggaaagttccagttcaggtgaaaggctttgttacaaagatggaagaatgtatgggtgcttgtgattgtatcattacaaaggcaggacctggtacaattgcagaggcaatgatccgtggcttaccaattattctaaatgattatattgctggacaggaagctggcaatgtcccctacgttgttgaaaatggatgtgggaagttctcgaaatctccaaaacagattgcgaagatagttgccgactggtttggcccaaggtcagacgaattcagggtaatgtcccagaatgccctcaagctagcacgacctgatgctgtgttcaaaatcgtccacgatctgcacgagctcgtcagggaaaaatgttttgtgccccaatatgcatgtgcaacataaaaggccgtatcctctattttgtgtttgcttaattttttttaaccccatgcggcactagctatagctgattgtgaggattgcgaatattgattgatttgaaacgtttccgtaagagaaatgaaaatgtattgaatgctcaaaaaaaaaaaaaaaaa

SEQ ID NO: 54087 - protein, 529 aa, Zea mays
  misc_feature: Ceres CLONE 1477892
  misc_feature (151)..(319): Pfam Name: MGDG_synth Pfam Description: Monogalactosyldiacylglycerol (MGDG) synthase
  misc_feature (345)..(508): Pfam Name: Glyco_tran_28_C Pfam Description: Glycosyltransferase family 28 C-terminal domain
  misc_feature: SWISSPROT Homolog: EC 2.4.1.227 Undecaprenyldiphospho-muramoylpentapeptide beta-N-acetylglucosaminyltransferase
MPAPTAEPALPAAFLCVPSPLLSTPLPGAALSASPAPSSHHASFLPRPRGGPRALSVAISVPGPTFSVASRLHQMWGEFARFVRLHGNQIAPLGFASMGLGFGGGGGDNVGGGGGGGGGDVDGVGEVEEAAARAEAPKKVLILMSDTGGGHRASAEAIKAAFTQEFGDDYQVFVTDLWTDHTPWPFNQLPRSYSFLVKHGPLWKMTYYGTAPRVVHQPHFAATSTFIAREVAKGLMKYQPDVIISVHPLMQHVPLRILRSKGLLDKIPFATVITDLSTCHPTWFHKLVTRCYCPSTEVEKRALKAGLKPAQIKVYGLPVRPSFVKPVRPKDELRRELGMDEDLPAVLLMGGGEGMGPIEATAKALGDSLYDENLGEPTGQILVICGRNKKLVNRLQSINWKVPVQVKGFVTKMEECMGACDCIITKAGPGTIAEAMIRGLPIILNDYIAGQEAGNVPYVVENGCGKFSKSPKQIAKIVADWFGPRSDEFRVMSQNALKLARPDAVFKIVHDLHELVREKCFVPQYACAT

SEQ ID NO: 54088 - DNA, 661 bp, Zea mays
  misc_feature: Ceres CLONE 1477893-F
  misc_feature (661)..(661): n is a, c, t, g, unknown, or other
gctctagaactagtggatcccccgggctgcaggaattcgtctcacccctagaaaaaatcacctcacctccgccgtcgcctcccctcatccctccaccggcccgtttgaccctctccctggctcgctcgttctcctcctcctccgtacccgtcctagtaggtttagcgctcaacagaaccccaatcaccaccccggcgccccccgagagcagttgccttgccgtttgctgcggttccatatggtgccccccgcgtcggcgtgagggctgcgcgcgctcgtgctgtttatcgggaggagatagatggggcccgccgtccgcagtagcgtcgtgatcagggccactgtggtagggctcgtgctggttggaatcgccctggccccgacgctgggcccccccgctgcggttgctccgggagcaccttccgcttcatcggagcccccgttttcgcctggttcgagggtgtgatgaggatgcccttccctacccggtatcacaaccaatttaggcccctattctttggaatatttcctgggaaccttataagggggagctgggacttttttctgggggccaccaaatgggtcccgtccaagattttcttggaacttttggcgaaatccaaaaaggggatttccggctttcgggaaatggtttagcacn

SEQ ID NO: 54089 - DNA, 664 bp, Zea mays
  misc_feature: Ceres CLONE 1477895-F
  misc_feature: Encodes the peptide sequence at SEQ ID NO. 54090
aagctggagctccccgcggtggcggccgctctagaactagtggatcccccgggctgcaggaattcgtctcacccctagaaaaaatccatctgctctgctccggtccgttccgctccttcctccccctatctagctagccttcccgttcctgcatcgcggcggagatgggcgcctccaccacgccgctcgcgtcggcggcggcgctgcttctgctgctgctcgcgccgctcgccgcggcggcggacagcatgtcgatcgtctcctacggcgagcggagcgaggaggaggcgcggcggatgtacgccgagtggatggcggcgcacggccggacctacaacgccgtcggcgaggaggagcgcaggttctaggtgttcagggacaacctccgctacgtcgacgcccacaacgccgccgccgacgcgggcgtccactccttccgcctcgggctcaaccgcttcgccgacctcaccaacgacgagtaccgcgccacctacctcggcggcaggagcaggccgcaaagggagaggaggctcggtgacaggtacctggccggcgacaacgaggaccttgccgagtccgtcaactggcgggccagggcgccgtcccgaaggtcagggaccagggccgcttgcggaattgcctggctttctcaccatagcgggtg

SEQ ID NO: 54090 - protein, 67 aa, Zea mays
  misc_feature: Ceres CLONE 1477895-F
  misc_feature: SWISSPROT Homolog: EC 3.4.22.14 Actinidain
MGASTTPLASAAALLLLLLAPLAAAADSMSIVSYGERSEEEARRMYAEWMAAHGRTYNAVGEEERRF

SEQ ID NO: 54091 - DNA, 801 bp, Zea mays
  misc_feature: Ceres CLONE 1477902-F
  misc_feature: Encodes the peptide sequence at SEQ ID NO. 54092
  misc_feature (30)..(30): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (47)..(47): n is a, c, t, g, unknown, or other
  misc_feature (50)..(50): n is a, c, t, g, unknown, or other
  misc_feature (318)..(318): n is a, c, t, g, unknown, or other
  misc_feature (471)..(471): n is a, c, t, g, unknown, or other
  misc_feature (478)..(478): n is a, c, t, g, unknown, or other
aatataaatagaaaggaaggaacagacccnaaccaannntatttctnccnaacaaacgagctcaccgcggtggcggccgctctatactagtggatcccccgggctgcaggagttcgtctcacccctagaaaaagattcgctcgctttccctcctcccagctcctgccccgggtccggttctcacgcacgaagcaaagatggcaccaccatccatgtgtcttgcgggaaagggggagcttcccttctcgacacttatttcatgcggtgtcacacaaaggccagtggcagggaccgcttccttgtgagacagggggggcnatgctataaggaacgtactaacacttgcgccgtgggaatatcggaattggactccccacccttgcgggtggtaaacaaacctctcgctagagaagcaaggaatcctcctcctcaaccgaagaccatattaaaggtatgtttggtatattatanaaaacgncctgtcgacagggaagggcgcggtttagctggaaaacgatatctacaaataccctcacacagggcagggccactacataccacgaacatttggacgaccagaagaggcaccacaattccggggtgtgatcttaccctcgggtattccccaaataaaacccgacatcgcaaaatattgataggaataggcaaccatgcgcacgtcgggctgtgtccccaagcggcattccgaagtgcgcctgggttgccttggtctggattaaaccccgcgccagcgagaatttggggcgctccacacaatcgcccctccatttatgcgcccta

SEQ ID NO: 54092 - protein, 35 aa, Zea mays
  misc_feature: Ceres CLONE 1477902-F
MAPPSMCLAGKGELPFSTLISCGVTQRPVAGTASL

SEQ ID NO: 54093 - DNA, 654 bp, Zea mays
  misc_feature: Ceres CLONE 1477907-F
  misc_feature: Encodes the peptide sequence at SEQ ID NO. 54094
  misc_feature (405)..(405): n is a, c, t, g, unknown, or other
ccccgcggtggcggccgctctatatctagtggatcccccgggctgcaggaattcgtctcacccctagaaaaaacccatctccgccgcgcacaccgcccaatcagccaatctcctcctcctcctccgctctcagacgagcagcggttgccatcactctccacttcccacgcccgctgcgggctcgcaggcggcagagaattgtctgtgccgccgggtgggaatttgattcggtcggattcgctgcgccgcgatgccggagcggcaccagtccatcgacgcgcagctgcggctgctggcccccgggaaggtctccgaggacgacaagctcgtcgagtacgacgccctcctcgtcgaccgcttcctcgacatcctccaggacctgcacggcccccacctgcgtgaatnccccccccagtgctacgagctctcggcggagcacgagaacgaccgggatgaggctcggcttggcgagctcgggagcaagctcaccagcctgccgccgggggactccattgtcgtcgccagttccttctcgcacatgctcaacctcgctaacctcgccgagtaagtgcagatcgcgcaccgtcgccggatcaagctaaagcggggagacttctccgaccaagcctccgcgcccacggaatcggaattcgg

SEQ ID NO: 54094 - protein, 105 aa, Zea mays
  misc_feature: Ceres CLONE 1477907-F
  misc_feature: SWISSPROT Homolog: EC 4.1.1.31 Phosphoenolpyruvate carboxylase
  misc_feature (52)..(52): Xaa is any aa, unknown, or other
MPERHQSIDAQLRLLAPGKVSEDDKLVEYDALLVDRFLDILQDLHGPHLREXPPQCYELSAEHENDRDEARLGELGSKLTSLPPGDSIVVASSFSHMLNLANLAE

SEQ ID NO: 54095 - DNA, 679 bp, Zea mays
  misc_feature: Ceres CLONE 1477914-F
  misc_feature: Encodes the peptide sequence at SEQ ID NO. 54096
ccccgcggtggcggccgctctataactagtggatcccccgggctgcaggaattcgtctcacccctagaaaaagtcttatcccctcgcccctcctcccctccgccgctccccccacctcacctcgtcaaccccctccttggatagggttagagttcccccggcacgagcgcgagccatggcctccttcacctgctcccaggtcggcgctgcggcagcgggcggaacctcgcccttcctcggctaccggcggcggagcggccccgggggcgccatcccgtcgagctccctcttcgtgggccggcggttggcggcggtgcggatgcgcgcgccctctcgcggggtccgcgggggctcccgcgcttgcgggtcacggtgccaaaaaggtggtgggggaatgaatcttagggccataaaaaaccctttcccgggcttccccgcctcttgggaggggggtggggcaatacccccaacccccccacacaaacttggatattccccttttgttattctttcctaaccccacctaaatttcccaccacccatctcaacccttccgatctgccggaccaccccgtacacacatattcccccacccctccctccttttttaccaacactctaccacaccataccccctttacccttcattgcgtggctacagcaagcattgtcctttttg

SEQ ID NO: 54096 - protein, 113 aa, Zea mays
  misc_feature: Ceres CLONE 1477914-F
MASFTCSQVGAAAAGGTSPFLGYRRRSGPGGAIPSSSLFVGRRLAAVRMRAPSRGVRGGSRACGSRCQKGGGGMNLRAIKNPFPGFPASWEGGGAIPPTPPHKLGYSPFVILS

SEQ ID NO: 54097 - DNA, 647 bp, Zea mays
  misc_feature: Ceres CLONE 1477923-F
  misc_feature: Encodes the peptide sequence at SEQ ID NO. 54098
tggagctccccgcggtggcggccgctctagaactagtggatcccccgggctgcaggaattcgtctcacccctagaaaaaaagagcagccacttggatccggtgctcagcggaacagctagctatagcctgtagctagcagctagcttcagtcacaggccggacggtcggctcacacacagctagccgccgccgccgctagcttagccaccagtagtccgatctgatctacaggcaaggggcaactagctagctagccgcgcgccggcgccatgatgaacctgaacctgaagcagcctctggtgctgcccgcgcaccacagcaatgtcgtcggctcgcgcctgtcgtcgtcgtcgccctcggcagccgccgccagcaggaggaccggcggcggcgtgtcctcccggtccggctcccggcggcacgtgcggctgccgaggatcagctgcagcgccaccgaggaggtcagcggcgccgtgtcgtccgtcaccgtggagaggatgctcacggtgacggcgtcggtggaggcgtcgccggccatcgggcagatgtacttccagcgcgccgtcgacgacatcggcgacctcctcggcaagacgctgctgctcgagctcgtcagctccgagctcgacgcaaagtcgggcgtgga

SEQ ID NO: 54098 - protein, 125 aa, Zea mays
  misc_feature: Ceres CLONE 1477923-F
  misc_feature: SWISSPROT Homolog: EC 1.13.11.12 Lipoxygenase
MMNLNLKQPLVLPAHHSNVVGSRLSSSSPSAAAASRRTGGGVSSRSGSRRHVRLPRISCSATEEVSGAVSSVTVERMLTVTASVEASPAIGQMYFQRAVDDIGDLLGKTLLLELVSSELDAKSGV

SEQ ID NO: 54099 - DNA, 671 bp, Zea mays
  misc_feature: Ceres CLONE 1477924-F
  misc_feature: Encodes the peptide sequence at SEQ ID NO. 54100
tggagctccccgcggtggcggccgctctagaactagtggatcccccgggctgcaggaattcgtctcacccctagaaaaaagagccgagaccaaggatcctgtctcctgtgcactccggcggccggaccacggcgagtccgggacgtagaagtcgccccgcccctccggatcgtgttgctcgggaaattgcttccgagtagttcccgacgccgcgggcctctaagccgctgcctccgacagtctcgtgagtccttgactcttgagaatcgagggaacgcatttacggacgcaagactggatctgaagaggcgctgacgaattggagggccgcgcaagcctggggatgggaaggctggtcgtcgcggcggcggtggccgtgtgggcgttcccgattgcggctttggtgaactccgtagtgccagagccctacatggatgagatcttccatatttcacaagcacagcagtattgccgtggagatttctggacatgggatcccatgatcaccacccctcctggcctgtattatgtttcactagcatatattgcttctttctttcctgttgcctggatgtttcgggtaccaaaaacatttgatgttctttgctccccagcagctctcaaatcaactaatgttatcctgggcaatggtcttgcgctgttctttattg

SEQ ID NO: 54100 - protein, 109 aa, Zea mays
  misc_feature: Ceres CLONE 1477924-F
MGRLVVAAAVAVWAFPIAALVNSVVPEPYMDEIFHISQAQQYCRGDFWTWDPMITTPPGLYYVSLAYIASFFPVAWMFRVPKTFDVLCSPAALKSTNVILGNGLALFFI

SEQ ID NO: 54101 - DNA, 648 bp, Zea mays
  misc_feature: Ceres CLONE 1477926-F
  misc_feature: Encodes the peptide sequence at SEQ ID NO. 54102
  misc_feature (648)..(648): n is a, c, t, g, unknown, or other
tggagctccccgcggtggcggccgctctagaactagtggatcccccgggctgcaggaattcgtctcacccctagaaaaaatcgctgccttttgatcccttttgtttctggccggcgtgcgtgtgcgtgcatccaggaagctgatcggcgcgcgctacttcaacaagggctacgcggcggcggcaggcgcgctgaacgcgtcgatgaacaccccacgcgacatggacggccacggcacgcacacgctgtccacggcgggcggctcgcccgtgcccggcgcgtcggtgttcgggttcggaaacggcacggcgtccggcggctccccgcgcgcgcgcgtggcggcctaccgcgtgtgtttcccgcccgtgaacggcagcgagtgcttcgacgcggacatcctggcggcgttcgacgccgccatccacgacggcgtgcacgtgctgtcgctctccctgggcggcgacccctccgactacttggacgacggcatcgccatcggatccttccatgccgtccgccgcggcatctccgtcgtctgctccgccggcaactcgggccctgcactcggcaccgcctccaacctcgcgccgtggctcctcaccacgggcgctagcaccagggaccgcgagttcccgtcctacatcgtctn

SEQ ID NO: 54102 - protein, 142 aa, Zea mays
  misc_feature: Ceres CLONE 1477926-F
  misc_feature: SWISSPROT Homolog: EC 3.4.21.25 Cucumisin
MDGHGTHTLSTAGGSPVPGASVFGFGNGTASGGSPRARVAAYRVCFPPVNGSECFDADILAAFDAAIHDGVHVLSLSLGGDPSDYLDDGIAIGSFHAVRRGISVVCSAGNSGPALGTASNLAPWLLTTGASTRDREFPSYIV

SEQ ID NO: 54103 - DNA, 679 bp, Zea mays
  misc_feature: Ceres CLONE 1477934-F
  misc_feature: Encodes the peptide sequence at SEQ ID NO. 54104
ctggagctccccgcggtggcggccgctctagaactagtggatcccccgggctgcaggaattcgtctcacccctagaaaaactggcggagggcacgtctgcctgggcgtcacgaacctcagtacatcagagcagccgaacacgcccgcggcaaccgccgccattctaccccaggtcggacggacccttgccggagacgagcacacgccacagcaggaattatcgggcgtagagcagcgcgaagcgagagatccaatggcggcggcggaggggcagtgggtgctcatggcaacggggcggacgccgaccaacattgcggtgatcaagtactgggggaagcgggacgaggcgctcatcctccccatcaacgacagcatcagcgtaacgctcgaccccgaccatctctccgccaccaccactgtcgccgtcagcccctcattcccttccgaccgcatgtggctcaatggcaaggagatctcgctattaggaggaaggtttcagagctgcctcagagaaatcagaaagcgtgctcgtgactttgaggacaaggagaagggcgtcaagatcaagaaagaggactgggacaagttgcatgttcacatagcctcgtacaacaacttccccactggctgctggtttggcctcttcagctgctggccttgcctgtttcgttttcaccct

SEQ ID NO: 54104 - protein, 142 aa, Zea mays
  misc_feature: Ceres CLONE 1477934-F
  misc_feature: SWISSPROT Homolog: EC 4.1.1.33 Diphosphomevalonate decarboxylase
MAAAEGQWVLMATGRTPTNIAVIKYWGKRDEALILPINDSISVTLDPDHLSATTTVAVSPSFPSDRMWLNGKEISLLGGRFQSCLREIRKRARDFEDKEKGVKIKKEDWDKLHVHIASYNNFPTGCWFGLFSCWPCLFRFHP

SEQ ID NO: 54105 - DNA, 609 bp, Zea mays
  misc_feature: Ceres CLONE 1477940-F
  misc_feature: Encodes the peptide sequence at SEQ ID NO. 54106
  misc_feature (571)..(571): n is a, c, t, g, unknown, or other
ggatcccccgggctgcaggaattcgtctcacccctagaaaaagtcctccctagcaaacctaacgtaccctcttccgcgccgccatgtctgggaggaagaagacgcgggagcccaaggaggagaacgtgacgcttggccccgctgtccgcgagggagaacacgtctttggcgttgcgcacatcttcgcctccttcaacgacactttcatccatgtgacggatctgtctggaagggagacgctcgtccgcatcactggtggcatgaaggttaaagctgatcgtgatgagtcctcgccttatgctgctatgcttgcctcacaggatgtcgcgcaaagatgcaaggagcttggaattactgcattgcacattaacctccgtgctactggtggaaacaagaccaaaacccctggccctggtgctcagtctgctcttagagctcttgcccgatctggcatgaaaataggccgtattgaggatgttactccaggccccacagacagcacaccgcgaaaaggggtggaaaagaggaaggaggctgtaattcccagtcctgacgaggagccctaccaaangaaacagtaaaaggctgtctgcatctaaaaaacagaaa

SEQ ID NO: 54106 - protein, 165 aa, Zea mays
  misc_feature: Ceres CLONE 1477940-F
  misc_feature (29)..(148): Pfam Name: Ribosomal_S11 Pfam Description: Ribosomal protein S11
  misc_feature (163)..(163): Xaa is any aa, unknown, or other
MSGRKKTREPKEENVTLGPAVREGEHVFGVAHIFASFNDTFIHVTDLSGRETLVRITGGMKVKADRDESSPYAAMLASQDVAQRCKELGITALHINLRATGGNKTKTPGPGAQSALRALARSGMKIGRIEDVTPGPTDSTPRKGVEKRKEAVIPSPDEEPYQXKQ

SEQ ID NO: 54107 - DNA, 665 bp, Zea mays
  misc_feature: Ceres CLONE 1477941-F
  misc_feature: Encodes the peptide sequence at SEQ ID NO. 54108
acccgcggtggcggccgctctagaactagtggatcccccgggctgcaggaattcgtctcacccctagaaaaacccccatttccccatcccaccgcccttcctgccccgaccccgagcgctgagccagcgcagcgcccatctccttcttcctcctcctcgttggatcgctgctccttgttcctcgcgcccgatacgccaggtttccttctgcgagcaataattcttggcgcgcgcgcgatctcccaaaggcgtccaaatccatatcgacgccagcggcggaggaggacgagagggaccggaaacggaagcgcgcggccggggcggctgcctacgcaaccgtccgagtgacggacgcggcgcgagcacgagatatactcgtcgaggctcctggaggctatccgcctagtgagcgaggggccctccgacgccgccgccgccgatgaggcccccacgctgagcaaggccgtgcgcgaggcggtcgatcttgcgctagctgtcgcggcgcgcgggcgcacgtactggagacgcgccatgctccggtcccggcgctgccatcgtctccaagccgggaatggagtgcgtcttgaagccaacgcgtatccgcctccaaagcacggtgactacgcggagataggcaccaccgctcttgcgcccctgccaaagaa

SEQ ID NO: 54108 - protein, 44 aa, Zea mays
  misc_feature: Ceres CLONE 1477941-F
MLRSRRCHRLQAGNGVRLEANAYPPPKHGDYAEIGTTALAPLPK

SEQ ID NO: 54109 - DNA, 640 bp, Zea mays
  misc_feature: Ceres CLONE 1477942-F
  misc_feature: Encodes the peptide sequence at SEQ ID NO. 54110
tggcggccgctctagaactagtggatcccccgggctgcaggaattcgtctcacccctagaaaaaatagacacagatagatagctagaacacgagcagaggatggctaggcctaggccgtcggtcgtcgtcctcgcggtggccgtcgccgtggcgtccctcgcgcagcccggcgcggccgacctgaagcaggactactacgcgagcacctgccccaacgtggaggccatcgtgcgcggcgtggtgcagcagcgactgcaggccaccatccgggccgtcggctccaccgtccgcctcttcttccacgactgcttcgtcgagggttgcgacggctcggtgctgatcgaatccacgcccggcaaccaggccgagaaggacgcctccgacaacaagtccctcgcgtccgaaggcttcgacaccgtgcggagcgccaaggccgccgtcgaggccgcctgcccggacacggtctcctgcgccgacgtgctcgccatcgccgctcgggacgccatctccatgagtggcgggcctttcttcccagtggagctgggcaggctggacggcctgatctccaccgccagcagcgtgccaggccagcttcccgaggccaaccagaccatggaccaactgctggcagtcttcaag

SEQ ID NO: 54110 - protein, 180 aa, Zea mays
  misc_feature: Ceres CLONE 1477942-F
  misc_feature (44)..(180): Pfam Name: peroxidase Pfam Description: Peroxidase
  misc_feature: SWISSPROT Homolog: EC 1.11.1.7 Peroxidase
MARPRPSVVVLAVAVAVASLAQPGAADLKQDYYASTCPNVEAIVRGVVQQRLQATIRAVGSTVRLFFHDCFVEGCDGSVLIESTPGNQAEKDASDNKSLASEGFDTVRSAKAAVEAACPDTVSCADVLAIAARDAISMSGGPFFPVELGRLDGLISTASSVPGQLPEANQTMDQLLAVFK

SEQ ID NO: 54111 - DNA, 750 bp, Zea mays
  misc_feature: Ceres CLONE 1477943-F
  misc_feature (30)..(30): n is a, c, t, g, unknown, or other
  misc_feature (31)..(31): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (687)..(687): n is a, c, t, g, unknown, or other
gcggtggggggagtcgattggaaaattgcnnttannntttaaatagctcgcataacagggactccccggggagggggccgctctagaactagaggatcccccgggcctggaggaattcaatccccccctagaaaagagacacttacctgcggtcaccgctcccaagccagtacccacagtcctaccagcagtcgcacgcaagtgtcacgagacaaaacggtcgacatggctcgcacgccatctggcgtagcggacgccgaggcggccgcggtgctgctagctgggaacggctgcgactacctcggaggccgccatcgcctgcgggcaggtgagctccgccatcgcgccctggctctcctacgcccgcggcgcggggtccggcccctccgcagcctgctgtagcagcgacaggaacctcaggagcgccggcaggactggcgccgacaggggcgccgcctgcaactgcctcaagaacgccgccaggggcgacagcggcctcaacgccggcaacgccgccagcaacccctccaagggcgggtgtcagcgtcccctacaccagcctgcactccaccgagctgcctccaggtgagaacaaataacctgaaaccacgacgcgacgacagggccggccggaaacagatagagccaaccagttacggatcggtggaccgctcgggccgggaagcnagcttgatgaaactggtccatgatgggattattctatatctggcgcctaaagcgcggggggaa

SEQ ID NO: 54112 - DNA, 681 bp, Zea mays
  misc_feature: Ceres CLONE 1477946-F
  misc_feature: Encodes the peptide sequence at SEQ ID NO. 54113
  misc_feature (391)..(391): n is a, c, t, g, unknown, or other
tccccgcggtggcggccgctctagaactagtggatcccccgggctgcaggaattcgtctcacccctagaaaaaagccagggcgcagcaccctctatccgttcttcagccggcgcctcccacgtctccagtccgacactccgactcactccccctcccccgccccaacccgtcgcaatggccgccgtctccgcagccccgaggccctcgatgcctccccgactcgccctccgtgcccacctcttctcctccgcctctccgctcccaatgcgcgcgctccccttactccgcagccgcttccgctccttgaccacggcctacgctgtcaagcaggacacggccctctgggaccctgcacccgtctccgccatcagtgctgcccacgacgacggntccgtctccatcatcgccgtcgaactatctgacggcacggacctcgtggactcgtacacaaacccggggcaatagctctggatccgggtacccgggaagaaatttaagcgggggaaatgggtatctcctcccccgccaaaggggggccccgttcaaatttcccggcaaaaagatgccggaaattacggggggggggttttgcccccctcaaaagggaattttgggaaaccctggcccccccgggaaaagggttccccccccaagggagaaatccccccaaaattgccaac

SEQ ID NO: 54113 - protein, 96 aa, Zea mays
  misc_feature: Ceres CLONE 1477946-F
MAAVSAAPRPSMPPRLALRAHLFSSASPLPMRALPLLRSRFRSLTTAYAVKQDTALWDPAPVSAISAAHDDGSVSIIAVELSDGTDLVDSYTNPGQ

SEQ ID NO: 54114 - DNA, 645 bp, Zea mays
  misc_feature: Ceres CLONE 1477950-F
  misc_feature: Encodes the peptide sequence at SEQ ID NO. 54115
  misc_feature (494)..(494): n is a, c, t, g, unknown, or other
acccgcggtggcggccgctctagaactagtggatcccccgggctgcaggaattcgtctcacccctagaaaaaaccagaagctcactcactgctcgttgccggctgcccccgcggccccggccagtccatcccctcgctcgctccccaactccagcaggcagatcagatacatccatccattcgcggaccggaagcaggaaaggaagggttgaactatgagcgccgtggcggtttcgtcgtcgctgaacccggacgcgccgctcttcatcccggcggcgctgctgcaggtggaggacttctcgccgcagtggtgggacctcatcaccaccactgcctggttccgcgaccactggtcccgcgagcgcgcccacctggacgagatggccgagcagatcgacgcggccggcctcctccccgacgacgaggacctcttctacgacgaccagctcgagcagggccccgtcgccgccgcccttaagacagattcggtgctncaggcgctgaacatgacctccccgaaggggcgcggcgacgccccgcggggggtcccgggagaaacccagaacgcccgagaagccgaacaagtacgccgggagccccaagagcaaagctccccgggtgatccaccaaccctccctaggtccc

SEQ ID NO: 54115 - protein, 143 aa, Zea mays
  misc_feature: Ceres CLONE 1477950-F
MSAVAVSSSLNPDAPLFIPAALLQVEDFSPQWWDLITTTAWFRDHWSRERAHLDEMAEQIDAAGLLPDDEDLFYDDQLEQGPVAAALKTDSVLQALNMTSPKGRGDAPRGVPGETQNAREAEQVRREPQEQSSPGDPPTLPRS

SEQ ID NO: 54116 - DNA, 664 bp, Zea mays
  misc_feature: Ceres CLONE 1477956-F
  misc_feature: Encodes the peptide sequence at SEQ ID NO. 54117
  misc_feature (439)..(439): n is a, c, t, g, unknown, or other
  misc_feature (440)..(440): n is a, c, t, g, unknown, or other
  misc_feature (445)..(445): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (528)..(528): n is a, c, t, g, unknown, or other
ggagctccccgcggtggcggccgctctagaactagtggatcccccgggctgcaggaattcgtctcacccctagaaaaaatgcaaagcggcgatgtttcgctgaagatcatatactgtggagtctgttatgcagacgttgcttggacgcggaataagctcaatgattcaaaatatcctttggttcctgggcatgagatagctggagttgtaactcaggttggtgcagatgtcaaaggctttaaagtgggtgaccatgtaggtgttggaacatatgtgaactcttgccgtgattgtgagaactgcaatatctctctagacaaccattgcccaaaagcagtttatactttcaatggcattgatacagatggaactgtcacaaaggggggttactccactcacattgtagtccatgaaaggtattgcttcaaaatacccgatnnggctnaccccctttttggggcgggaaaaaggggggggnnnccccccccccccccccccctgggggggggggggggggggggggggganaaaaaaaaaaacccccggggggggttggttttcccccccccccccgggggggggggggggggggggggggggcgcccccccaaaaaagagataaatataaaccccccccccccccccctgggggcggggggtggga

SEQ ID NO: 54117 - protein, 195 aa, Zea mays
  misc_feature: Ceres CLONE 1477956-F
  misc_feature (3)..(118): Pfam Name: ADH_N Pfam Description: Alcohol dehydrogenase GroES-like domain
  misc_feature: SWISSPROT Homolog: EC 1.1.1.195 Cinnamyl-alcohol dehydrogenase
  misc_feature (121)..(121): Xaa is any aa, unknown, or other
  misc_feature (123)..(123): Xaa is any aa, unknown, or other
  misc_feature (134)..(134): Xaa is any aa, unknown, or other
  misc_feature (150)..(150): Xaa is any aa, unknown, or other
MQSGDVSLKIIYCGVCYADVAWTRNKLNDSKYPLVPGHEIAGVVTQVGADVKGFKVGDHVGVGTYVNSCRDCENCNISLDNHCPKAVYTFNGIDTDGTVTKGGYSTHIVVHERYCFKIPDXAXPLFGAGKRGGXPPPPPPLGGGGGGGGXKKKNPRGGLVFPPPPGGGGGGGGGRPPKKEININPPPPPLGAGGG

SEQ ID NO: 54118 - DNA, 640 bp, Zea mays
  misc_feature: Ceres CLONE 1477957-F
  misc_feature: Encodes the peptide sequence at SEQ ID NO. 54119
ccgctctagaactagtggatcccccgggctgcaggaattcgtctcacccctagaaaaaacaacgagcacctctaagccaaagcaagttgctaggtcctttgaaccagcaactgaagcttcctcgtctcatcatcgagaccagtaagcaacatggcggctaatctcaagtgggctcctgttctagccctcgtcgtcgtcgttgctgccatggttggcaccacgagcgccggcaacatcgcagtgtactggggccagaacggcaacgaaggcagcctggcggacgcctgcaactccgggctctacgcctacgtcaacatcgcgttcctcacaaccttcggcaacggacagaccccagtcctcaacctcgccggacactgcgaccccggctctggcagctgcaccggccagagcagcgacatccagacctgccagtcgctgggcatcaaggtgctcctctccatcggcggcgccagcggcagctacggcctctcctccaccgacgacgccaacagcgtggccgactacctgtgggacaacttcctgggcggcagcggctcgtcccgcccgctcggcgccgccgtgctcgacggcatcgacttcgacatcgagaacggccagtcggcgcactacgatgacctgg

SEQ ID NO: 54119 - protein, 163 aa, Zea mays
  misc_feature: Ceres CLONE 1477957-F
  misc_feature (27)..(162): Pfam Name: Glyco_hydro_18 Pfam Description: Glycosyl hydrolases family 18
  misc_feature: SWISSPROT Homolog: EC 3.2.1.14 Chitinase
MAANLKWAPVLALVVVVAAMVGTTSAGNIAVYWGQNGNEGSLADACNSGLYAYVNIAFLTTFGNGQTPVLNLAGHCDPGSGSCTGQSSDIQTCQSLGIKVLLSIGGASGSYGLSSTDDANSVADYLWDNFLGGSGSSRPLGAAVLDGIDFDIENGQSAHYDDL

SEQ ID NO: 54120 - DNA, 661 bp, Zea mays
  misc_feature: Ceres CLONE 1477961-F
  misc_feature: Encodes the peptide sequence at SEQ ID NO. 54121
cccgcggtgggcggccgctctagaactagtggatcccccgggctgcaggaattcgtctcacccctagaaaaattcttccccgagtcgccgtcgtctgctccgggctgctgttctgcgcctccacaaggctttggcctctgttgtaagttttaagcttcacctccagccatgggtaaggagaagtcccacatcaacattgtggttattggccatgtcgactctggcaagtcaaccaccaccggccacctgatctacaagcttggaggcattgacaagcgtgtgattgagaggttcgagaaggaagccgctgaaatgaacaaacggtccttcaagtacgcttgggtgcttgacaagctcaaggctgagcgtgagagaggtatcaccattgatatcgctctgtggaagtttgagaccaccaagtactactgcactgtcattgatgcccctggacatcgcgacttcatcaagaacatgatcacgggtacctcccaggctgactgtgctgtcctgatcattgactccaccactggtggttttgaggccggtatctctaaggatggccagacccgtgagcatgctctccttgctttcacccttggggtcaagcagatgatttgctgctgcaacaagatggatgcgaccactcccaagtattccaagg

SEQ ID NO: 54121 - protein, 164 aa, Zea mays
  misc_feature: Ceres CLONE 1477961-F
  misc_feature (5)..(161): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSK

SEQ ID NO: 54122 - DNA, 673 bp, Zea mays
  misc_feature: Ceres CLONE 1477963-F
  misc_feature: Encodes the peptide sequence at SEQ ID NO. 54123
  misc_feature (537)..(537): n is a, c, t, g, unknown, or other
  misc_feature (673)..(673): n is a, c, t, g, unknown, or other
tccccgcggtggcggccgctctatacctagtggatcccccgggctgcaggaattcgtctcacccctagaaaaattcctgcctgacgccaaggcctccccatcctcctcttgctatggtgcccagccgagctccctccccttcctgccatggccgacgccactccctgccgcagctcgacgccctcccctgcagcaagccgccatggagctcgccctggccctgcgtttttttttcctgcagctcgccccctgatctgcacgcaggggtttcttccatggcgctctggacaccagccgcttccccctggtggtcgagttccctcctgcatttctgctcgcccaaactccacttccctgttccagccaccttccatggacgccagccctcatctcaaggtcgccctcccatggcgtttgtctctgcgccgttgctgagctcgccctgcccccagccatggacgtcgtcgggccacctgtttcctatcttccatggacgccaatagcagcagcccactccttttgttctccatggatganagcccaagcatctgcgcctcccctaggtttttgtacaatcgcagcagcacgtcggacctttgcaaccccggtgagaccaactgcttgcgctatgtttattccccaccaattcctatatttgattatttactgtgtn

SEQ ID NO: 54123 - protein, 129 aa, Zea mays; identical to SEQ ID NO: 52991
  misc_feature: Ceres CLONE 1477963-F

SEQ ID NO: 54124 - DNA, 644 bp, Zea mays
  misc_feature: Ceres CLONE 1477965-F
  misc_feature: Encodes the peptide sequence at SEQ ID NO. 54125
  misc_feature (470)..(470): n is a, c, t, g, unknown, or other
gctctagaactagtggatcccccgggctgcaggaattcgtctcacccctagaaaaaagcccgatggcgctgctcacaccactgcccattccccttctctcgccgtattgccaacgcgtctcgtctccgtcgcttctggcggccggggcagttatcagacctctcatttgtctttccccccacaatcaccgccaccacgatgcactctacccctctgtccccaatgtgtggccacgccaccggcgccgccgcagggacgcagttgcttccgtcgaccaggaggagtctagtgcctcggaaaccgcagtcgctcccgaggaagacctggggccaccggtatcctctgatgcggctgccgaggacggggtcgcgacttctgcccagccggcggaggcgagcccggaggacctggagaacatccgcgaaattaaaagggtactggagctgctggaagaaagaacagaagacatngaccttttggcggaggtgttaagctttacccttcccgggggtgggaggggcccccccccgagggttttttaaaaaaaaaaaaaaaacaccccggagaaaaggaacccccgggaaaaatctaacagggggagatttttttggtcaaccatttgtggggagaggggaaaaaaacaa

SEQ ID NO: 54125 - protein, 159 aa, Zea mays
  misc_feature: Ceres CLONE 1477965-F
  misc_feature (136)..(136): Xaa is any aa, unknown, or other
MALLTPLPIPLLSPYCQRVSSPSLLAAGAVIRPLICLSPHNHRHHDALYPSVPNVWPRHRRRRRDAVASVDQEESSASETAVAPEEDLGPPVSSDAAAEDGVATSAQPAEASPEDLENIREIKRVLELLEERTEDXDLLAEVLSFTLPGGGRGPPPRVF

SEQ ID NO: 54126 - DNA, 672 bp, Zea mays
  misc_feature: Ceres CLONE 1477969-F
  misc_feature: Encodes the peptide sequence at SEQ ID NO. 54127
aagctggagctccccgcggtggcggccgctctagaactagtggatcccccgggctgcaggaattcgtctcacccctagaaaaagaaaaaaatcgcactgttggaagctcttcgctgtcacccccacccacctccggcgctcttttttagcattttccttgggctctggactccaaaatcccagccttttgtttgcttctctgtctcctgctgattggtgtccccgggtccaggactcttgatttgctcctcgcgggggttcggtcccatggcggcagctgcgctggcaatggcagagcaggtggtggccgagctccgagtgaggtgtgagacgccgccgtcgatgctgcgcgaggtggccgtggagatggcccgcgagatgggcgcggggctggagaaggacggcgggagcagggtcaagatgctcctctcctacgtcgataagctccccacagggagagaggaaggattattctatggattggacctaggaggaacgaatttccgcgtcttgaaagtgcaactaggtgggaatgcgaagcatgtcgttgaccgtgactccagagaagtcggcattccgccacatctgatgtcagggagctcctcggagctttttggtttcattgcttctgaattggccaagtttgttgacgatgatgagaagtgcgctaac

SEQ ID NO: 54127 - protein, 135 aa, Zea mays
  misc_feature: Ceres CLONE 1477969-F
  misc_feature (3)..(135): Pfam Name: Hexokinase_1 Pfam Description: Hexokinase
  misc_feature: SWISSPROT Homolog: EC 2.7.1.1 Hexokinase
MAAAALAMAEQVVAELRVRCETPPSMLREVAVEMAREMGAGLEKDGGSRVKMLLSYVDKLPTGREEGLFYGLDLGGTNFRVLKVQLGGNAKHVVDRDSREVGIPPHLMSGSSSELFGFIASELAKFVDDDEKCAN

SEQ ID NO: 54128 - DNA, 665 bp, Zea mays
  misc_feature: Ceres CLONE 1477976-F
  misc_feature: Encodes the peptide sequence at SEQ ID NO. 54129
  misc_feature (236)..(236): n is a, c, t, g, unknown, or other
  misc_feature (665)..(665): n is a, c, t, g, unknown, or other
aagctggagctccccgcggtggcggccgctctagaactagtggatcccccgggctgcaggaattcgtctcacccctagaaaaaaccgggatctctcccttaccgaggaccgccgcggacgtcgcagcggccgcgcggaccgccgcgtcccggtggttggccaccgcgcgcggcgcccgctctctcgatctcttctcgctgccgcggtggcgcagggcctcggggcggcagttctcnccttcccctttcctcaaggcgcgacctgggcgtcctggatggagtccgccgacggggcggtgtggatgctcatcggtgcgaatgttgctgtctacctggtgtggcgtgtggccgatccaggggtcatggaggagcatttcttgatttcccgggacaatttcaagagtggaccggtgcacacctttgctcacgagtgctttcagccatgcaaagtttaatcccctcttttccaatatgtttgggccccttcttcttgggggagcatattacgaagggggtttggcgcctgcctttcctattgaaatttgtatggtggggggaccactttcctgggatccagatttcctccttgggtggaaaaagggtttttcctcgccctttccggaaaaacggatttattgtagggaaggggaataccttccagggagn

SEQ ID NO: 54129 - protein, 125 aa, Zea mays
  misc_feature: Ceres CLONE 1477976-F
AGAPRGGGRSRTSGSPGLQEFVSPLEKTGISPLPRTAADVAAAARTAASRWLATARGARSLDLFSLPRWRRASGRQFSPSPFLKARPGRPGWSPPTGRCGCSSVRMLLSTWCGVWPIQGSWRSIS

SEQ ID NO: 54130 - DNA, 656 bp, Zea mays
  misc_feature: Ceres CLONE 1477977-F
  misc_feature: SWISSPROT Homolog: EC 5.3.99.6 Allene-oxide cyclase
  misc_feature (315)..(315): n is a, c, t, g, unknown, or other
aagctggagctccccgcggtggcggccgctctagaactagtggatcccccgggctgcaggaattcgtctcacccctagaaaaactttgccttttgcttttgcctggtcgggcctctgcttaaccgctcttcctccccaccacccacccaggtttacaacggcagcctggacaagcggctgggcatcaccgccggcatctgcgtgctcatccagcacgtcccctaccgcaacggcgaccggtacgaggccatctacagcttctacttcggcgactacagccacatctcggtgcagggcgcgtacctgaactactangagtcgtacctggccgtcacgggcggctcaggcgtcttctagggcgcctacgggcaggtcaagctccaccagatcgtcttcaccttcaggatcttctacaccttctacctccggggcatccacgacctgcccagggacctgatctgaacgcctgtcccgccctccacaccgtggaagccacgcccgccgccagggccgccgaagcgcacgccctgctcaacatctacaccactgactcatcaatccagcccaggaacatctctgcctgccgtggctgtccccccctgctcctcactcaatttgtatgtttgaaggggcttaggctccttcaattcatacgc

SEQ ID NO: 54131 - DNA, 655 bp, Zea mays
  misc_feature: Ceres CLONE 1477979-F
  misc_feature: Encodes the peptide sequence at SEQ ID NO. 54132
  misc_feature (221)..(221): n is a, c, t, g, unknown, or other
aaagtggagctccccgcggtggcggccgctctagaactagtggatcccccgggctgcaggaattcgtctcacccctagaaaaaagcagaagccaccgatcggcgtgccgcgtgcgtgaggcgatcggagcatcccgtcccgaggaggaagacaaccggcgacgcggggggacatgggggaagacgccggtgcggatgaaggcggtcgtgtacgcgctgtcncccttccagcaaaaggtaatgccggggctgtggaaggacatcaccaccaagatccaccacaaggtcaccgagaactggatctccgccacgctcctcctcacccccgtcgtcggcacctaccaatacgccatgtggtacaaggagcaggagaagctttcccacagatattaaatgcgctgcccttgacagacagcactcggagttttcatgatgggtttcataatcctcccatgatgatttaacatttgtttgagtcatttcagtttcacgccttttcatcgttccatatgcatatatgggtatccgtgttctgcaaacttatttttgaggcttgctaaatatgtacccttttgtctctggaagttgttaaataaaggcaatttacctccaaaaaaaaaaaaaaaaacgagacgctcgagggtaccaatttcgcg

SEQ ID NO: 54132 - protein, 129 aa, Zea mays
  misc_feature: Ceres CLONE 1477979-F
SGAPRGGGRSRTSGSPGLQEFVSPLEKSRSHRSACRVREAIGASRPEEEDNRRRGGTWGKTPVRMKAVVYALSPFQQKVMPGLWKDITTKIHHKVTENWISATLLLTPVVGTYQYAMWYKEQEKLSHRY

SEQ ID NO: 54133 - DNA, 658 bp, Zea mays
  misc_feature: Ceres CLONE 1478007-F
  misc_feature: Encodes the peptide sequence at SEQ ID NO. 54134
  misc_feature (47)..(47): n is a, c, t, g, unknown, or other
  misc_feature (77)..(77): n is a, c, t, g, unknown, or other
  misc_feature (78)..(78): n is a, c, t, g, unknown, or other
  misc_feature (80)..(80): n is a, c, t, g, unknown, or other
  misc_feature (82)..(82): n is a, c, t, g, unknown, or other
  misc_feature (144)..(144): n is a, c, t, g, unknown, or other
tggagctccccgcggtggcggccgctctagaactagtggatcccccngggctgcaggaattcgtctcacccctagannananaaaaaaaaaaaaaaaaaaaaaaaaaaaaaaaaaaaaaaaaaaaaaaaaaaaaaaattttttngctcttataaaaaaggactatctggggtctgtatgatgaggaagtttcacttaggggtttttttctgatgccaaggaccactgcatgataatgagataggtatatgtgctatggttggtacagcccttgtaaatgctttctttagtgcacctttgtttttgtgcgaaaaaaaaaaaaaaaaacgagacgctcgaggtacccaattcgccctatagggagtcgaattacgcgcgctcactggccgtcgttttacaacgtcgtgactggaaaaaccctggcgttacccaacttaatcgccttgcagcacatccccctttcgccagctggcgtaatagcgaagaggcccgcaccgatcgcccttcccaacagttgcgcaccctgaatggcaaatggaaattgtaagcgttaatattttgtaaaaaatcgcgttaaatttttgttaatcagctcatttttttaacaataggccgaatcgggaaaatcccttatactcaaaagatagaccgagataggt

SEQ ID NO: 54134 - protein, 89 aa, Zea mays
  misc_feature: Ceres CLONE 1478007-F
  misc_feature: SWISSPROT Homolog: EC 3.2.1.23 Beta-galactosidase
MLSLVHLCFCAKKKKKNETLEVPNSPYRESNYARSLAVVLQRRDWKNPGVTQLNRLAAHPPFASWRNSEEARTDRPSQQLRTLNGKWKL

SEQ ID NO: 54135 - DNA, 650 bp, Zea mays
  misc_feature: Ceres CLONE 1478010-F
  misc_feature: Translation starting site: 129
aagctggagctcaccgcggtggcggccgctctagaactagtggatcccccgggctgcaggaattcgtctcacccctagaaaattttatcttctctatcgctactccaagagtacccaatcaccgagccatggccatctcagtcaatgccgtggccgccttgcccgctttctcgggtcatagaaccctcccgcagacgtcctgccagagggtcgtagcgttcatcgtcaatccggccggtgcgagctcaccgccggtttgtgggtgtggctgctacctcggcgcccacgcgctcggatctcgcaaagaaagtgtccgagagcatcacgcaggcccaggagacgtgcgcagatgacccggtgagcggctagtgcatggtcgcgtgagacgaggtggagtactcagcgcggccacatgcacttgcctactgaagaatggcacctacccctcgaggagtctgcaaagacaacccgagaccgacgagtgctcacgtacgacgactgcatctcgagcgcgcgaggttggatcgctgtcactttgatctagctagcagcttagctcggaatgatgaccacctgtgaagacgtcccaatggttcgcggaatgatcacttcgttgatccaccccccgctgggaggggaaataaaacgaa

SEQ ID NO: 54136 - DNA, 648 bp, Zea mays
  misc_feature: Ceres CLONE 1478012-F
  misc_feature: Encodes the peptide sequence at SEQ ID NO. 54137
  misc_feature (365)..(365): n is a, c, t, g, unknown, or other
  misc_feature (648)..(648): n is a, c, t, g, unknown, or other
gctctagaactagtggatcccccgggctgcaggaattcgtctcacccctagaaaaaccccattcacattcggccattctccaccgtccaaccaaccaccggcggcggcacaagggaagcgaagaggaatcaacgcgatgtctgcgaccacggcggcggtgccccttctggcgggcggccgggatgacctacatcggctactccaacatctgcgctgcgctggtacggaactgcctcaaggagccccttcagtccgaggccgcgtcccgcgagaaggtccatttctccatctccaagtggacggatgggcaacaggagaagcccactgtccgcacagaatccgatgaataaagtctggtgccatantggcatagtccttgctacagatgatttgaagtgttgttgcaagttcccggacatgctatttagctggctggattttatagccaatgctagaataataaatacttttttaccaacaattggcttttttcgttgctagttgccccccccccctaccctgaatcagtccatggggaacatcaatggaaatggcttccagtttttgtacaaaacctaaattttggtggggcgctgccccaacagaatttcttatggtcttgggtcccttaaaaaaaaaagaaggaan

SEQ ID NO: 54137 - protein, 115 aa, Zea mays
  misc_feature: Ceres CLONE 1478012-F
  misc_feature (54)..(102): Pfam Name: ATP-synt_Eps Pfam Description: Mitochondrial ATP synthase epsilon chain
SRTSGSPGLQEFVSPLEKPHSHSAILHRPTNHRRRHKGSEEESTRCLRPRRRCPFWRAAGMTYIGYSNICAALVRNCLKEPLQSEAASREKVHFSISKWTDGQQEKPTVRTESDE

SEQ ID NO: 54138 - DNA, 623 bp, Zea mays
  misc_feature: Ceres CLONE 1478016-F
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (393)..(393): n is a, c, t, g, unknown, or other
  misc_feature (417)..(417): n is a, c, t, g, unknown, or other
  misc_feature (418)..(418): n is a, c, t, g, unknown, or other
  misc_feature (434)..(434): n is a, c, t, g, unknown, or other
  misc_feature (458)..(458): n is a, c, t, g, unknown, or other
  misc_feature (470)..(470): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (535)..(535): n is a, c, t, g, unknown, or other
  misc_feature (536)..(536): n is a, c, t, g, unknown, or other
  misc_feature (538)..(538): n is a, c, t, g, unknown, or other
  misc_feature (553)..(553): n is a, c, t, g, unknown, or other
  misc_feature (560)..(560): n is a, c, t, g, unknown, or other
  misc_feature (572)..(572): n is a, c, t, g, unknown, or other
  misc_feature (580)..(580): n is a, c, t, g, unknown, or other
  misc_feature (584)..(584): n is a, c, t, g, unknown, or other
  misc_feature (600)..(600): n is a, c, t, g, unknown, or other
  misc_feature (623)..(623): n is a, c, t, g, unknown, or other
ctccccgcggtggcggccgctctagaactagtggatcccccgggctgcaggaattcgtctcacccctagaaaatacgccatcggtcccctgcccctccccgacgcttccggctttccgtgcgaccgtgcccttttcatcctctcgcagctcgcatgtgaaacagattccacccgttccttcgggtggccggacggatcgaggaaggaggcatgatggcctccgatggccacccgcctgagccggggaagaaggcagatgtcgcctccacggtcgtcggggcctggaagcaaacgatctggggaccaaaccccggcaatttttttnnnnnnnnnnnnnnnnncggggggggggggggggggccggcnnnccccnnnnncnnnnccnnncccccncccgccggccgggcgggggggggnnggggcggggggcgcgngcggccggggggggggggggcggngggcgggggcgnggcgcgggggcgggggcccgggggggggggggtggggggggcggggcgnnnngggcggggggccnngngcgggggggcggggnggggggntggcgggcgggngggcgggngggncgggccggcggcgggngcggcgcgggggggccggcgggn

SEQ ID NO: 54139 - DNA, 666 bp, Zea mays
  misc_feature: Ceres CLONE 1478019-F
  misc_feature (528)..(528): n is a, c, t, g, unknown, or other
ctccccgcggtggcggccgctctataactagtggatcccccgggctgcaggaattcgtctcacccctagaaaaatgagagacagatgcgcttcacccccatccacaagaacaccaaagccacatcccatccatctccacggtgaggcttgagcgatccgaccaaaaaagatcatcccgcgacgcagcgacgcaggtttgttctctgatctctctggatcttctttcagcagcaggtaggcccgacacaattaaaaggtcctgttcaagaggctcttctgttgggtttttttagaatccctcaagagaagcgagttcttgggttaggatttttttctcacctcataacacctctcctaggaggaacagatatccagagaaccttttttctcttctggatccttgccgccttttgacgttcgataggtggctgatttgcaataccctctctctgtttatttcttcgttcttggcacaaacccacctcgtttctctacttttattgaggaacagagctggttttcctgaangaataaaaatatcgagacgctcgaggtacccagttcgccttatagtgacgcgtattacgcgcgctcactggcagtcgttttacaacgtcgtgactggtatacacctggcgttacccaaattaatcggcgtgcaccaca

SEQ ID NO: 54140 - DNA, 654 bp, Zea mays
  misc_feature: Ceres CLONE 1478030-F
  misc_feature: Encodes the peptide sequence at SEQ ID NO. 54141
  misc_feature (528)..(528): n is a, c, t, g, unknown, or other
tggagctccccgcggtggcggccgctctagaactagtggatcccccgggctgcaggaattcgtctcacccctagaaaaaacccgaggcatggaagacacaccgtcgctctcctcgcgtgcgagcgccgccaccgcatcttcccatcgaactccgctgaccccgcatcttcccatacgagctgtgtttctccaagttcgctgctggccatatcgacgtcgtcatcctcgatccagacgagtgtgtgtgctatctccacgggtcttcgacagatttagatatatgaagctaaagtaatgaaggatgattttgtagtatcgtccagcataaggaaagaaaagctgcatttgtgctattgtcagagatggatatttaactttagcaatttgcaacttttaagtaatctgttaaattaaagatgagatcttgcagatttttcttattacctaatggattctctttattagctaattcaatctaatcatgcatattgcagtaaggactatgtatgttgaatcaatgactctggntcaattttaaatatcaaaaaaaaaaaaaaaaacgagacgctcgaggtaccccattcgccctatagtgagtcgtattacgcgcgctcactgggcgtcgttttacaacgtcgtgactggaaaaccctg

SEQ ID NO: 54141 - protein, 68 aa, Zea mays
  misc_feature: Ceres CLONE 1478030-F
MEDTPSLSSRASAATASSHRTPLTPHLPIRAVFLQVRCWPYRRRHPRSRRVCVLSPRVFDRFRYMKLK

SEQ ID NO: 54142 - DNA, 636 bp, Zea mays
  misc_feature: Ceres CLONE 1478036-F
aaagctggagctccccgcggtggcggccgctctagaactagtggatcccccgggctgcaggaattcgtctcacccctagaaaaaaaggaagcgactcatagaatggcagatgccaaatacagctctgtgcacattttcgttaatccctgaacggaatctaggtatgtagacacatggatccatacatctgcgtcggaaaagatcaataaaaggagaatcgtacgatatctttttcgaacctaaaaaaaaaaaaaaaacgagacgctcgaggtacccaattcgccctatagtgagtcgtattacgcgcgctcactcggcgtcgttttacaacgtcgtgactgggaaacgctggcgttaccaacttaatcgcttgcagacatccccctttcgcagctgcgtatagcgatgagcccgcacgatcgccgttccacagttcgcattctgaatggcaatggaattgcagcgttatattttgttaaattcccgttaatttttgtcaatcagctcatttttttaaccataaggcgaatccgcaaatcccctataatcaaaagacaccccgaaatggggtggaatttgttccattttggaaaagaatcccctcttaaagaagtggactccacggacaaagggcaa

SEQ ID NO: 54143 - DNA, 644 bp, Zea mays
  misc_feature: Ceres CLONE 1478037-F
ccccgcggtggcggccgctctagaatagtggatcccccgggctgcaggaattcgtctcacccctagaaaaccccctagaaaaaaccttttcaaaagagcaggtgaactatcattgtgcaattttgctgggagaaactcttgaacttaaatctttttgatatcactagacttcatcaatcatggtggagcctgttattgtcatgcagatgctcgctaagaaatctgcaactgttggttgctcaagggtgattcgcgattttgcacatacggatccgcagttactgctgcctcaggttgctcagcaatgtgctgctggttgggcaccgaagaatccatcaggttgcatcctttttgcccagacgtcgatttctgcatttgaagtggtaaacgttttttttatctgtttcgcatcatgtatatacgtaggcttgagtcattgtgtgctccccattttttggagatataaatgccggtaggagttatgagatgtccacagtcggcccctcccttgttgaatccctttggatgtatcctctctctttcgtacatgcactcactgaaagtcaatgcaaatatctcggtgtttctagtaaaaaaaaaaaaaaaaacgagacgctcgaggtacccaattcgccctaataggg

SEQ ID NO: 54144 - DNA, 643 bp, Zea mays
  misc_feature: Ceres CLONE 1478044-F
  misc_feature: Encodes the peptide sequence at SEQ ID NO. 54145
  misc_feature (253)..(253): n is a, c, t, g, unknown, or other
tccccgcggtggcggccgctctagtactagtggatcccccgggctgcaggaattcctctcacccctagaaaaagagccacggagagcaaaggcagcacactcagctatccagcaaaagagatcgagacgcaggagtcatggccaccgtcagcgccgccgtggtgaccaccatcgttgcccgcgccgcgatcgccaggcccaatgctctagggctgcctgcgctgagggcgaggagcgagagggtgcggtgcanctacgccaaggacgcggccccagtcagcaccaagggcgcaggcgcgtcgctgctcgccgcagcgggcgcggtgaccgcgtcggcggggcccgcgctggcgctcgtggacgagcgcatgtccacggagggcaccgggctgagcctcgggctcagcaacaccctgctggggtggatcctcctgggggtcttcggcctcatctggtccctctacaccatctacacctctgacctcgacgaggacgaggagtccgggtggcctctcgctctagatccaccctctccctgtaatgatcttgatgtaaacatggtggcgggcatcggggtaaatttagacatgggtatttgcatctaagatccatcctctcctggtaataaaggttgggagactac

SEQ ID NO: 54145 - protein, 155 aa, Zea mays
  misc_feature: Ceres CLONE 1478044-F
  misc_feature (1)..(126): Pfam Name: PsbW Pfam Description: Photosystem II reaction centre W protein, PsbW
  misc_feature (39)..(39): Xaa is any aa, unknown, or other
MATVSAAVVTTIVARAAIARPNALGLPALRARSERVRCXYAKDAAPVSTKGAGASLLAAAGAVTASAGPALALVDERMSTEGTGLSLGLSNTLLGWILLGVFGLIWSLYTIYTSDLDEDEESGWPLALDPPSPCNDLDVNMVAGIGVNLDMGICI

SEQ ID NO: 54146 - DNA, 776 bp, Zea mays
  misc_feature: Ceres CLONE 1478045-F
  misc_feature: Encodes the peptide sequence at SEQ ID NO. 54147
  misc_feature (22)..(22): n is a, c, t, g, unknown, or other
  misc_feature (23)..(23): n is a, c, t, g, unknown, or other
  misc_feature (29)..(29): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (448)..(448): n is a, c, t, g, unknown, or other
  misc_feature (458)..(458): n is a, c, t, g, unknown, or other
gttatgggccgcgcgggtcttnnaatctnattacatactggggnnnnnnnnnnnnnnnnnctggagctccacgcggtggcggccgctctagactagtggatcccccgggctgcaggaattcgtctcacccctagaaaaaagattggcggcagcaaagcaacacgcgcctcgatcctcctcgcccctccggcctctcctcccctccctgcacccgcacctgcggagagcgccgcaagctagctgcagaggagcgagacagtagcaggaggaggacgagaggaagaagagatggcgggctgtgatggagccaagtcgtcggcgtccatggaggaagaggcatgcgcggagaagaagtacggagggatcgcacccaagaagcccttgatatccaaggaccacgagcgcgcctacttcgattctgcggactgggtgctgggaaagcaacccncaaacagcancagcagcacgaagacctcacccccccccgagtctctgaaacccaagctgaagagaacgccgcaccaccaggctgccgcctcgtaagccccacctgcgcttccagttggagaagcatgggccaccgcgtccccagcttgctggaaggaaggaaccttcggtcaaaagcccaaaggactggaggaatgcccccaccaaacttccaagcctccggaaaaagatggtttttaagcctgggggccccggaaatgcgtaaagggagacaaaccaaaccgaaggcccggaaaaaagatccccggaaatcccccaaaaaatcgccc

SEQ ID NO: 54147 - protein, 84 aa, Zea mays
  misc_feature: Ceres CLONE 1478045-F
  misc_feature (20)..(84): Pfam Name: Lg106 Pfam Description: Lg106-like protein
  misc_feature (54)..(54): Xaa is any aa, unknown, or other
  misc_feature (57)..(57): Xaa is any aa, unknown, or other
MAGCDGAKSSASMEEEACAEKKYGGIAPKKPLISKDHERAYFDSADWVLGKQPXNSXSSTKTSPPPESLKPKLKRTPHHQAAAS

SEQ ID NO: 54148 - DNA, 638 bp, Zea mays
  misc_feature: Ceres CLONE 1478046-F
  misc_feature: Encodes the peptide sequence at SEQ ID NO. 54149
  misc_feature (412)..(412): n is a, c, t, g, unknown, or other
  misc_feature (413)..(413): n is a, c, t, g, unknown, or other
  misc_feature (522)..(522): n is a, c, t, g, unknown, or other
  misc_feature (538)..(538): n is a, c, t, g, unknown, or other
  misc_feature (582)..(582): n is a, c, t, g, unknown, or other
ggagctccccgcggtggcggccgctctagaactagtggatcccccgggctgcaggaattcgtctcacccctagaaaaaagtcagatccgtgttccgtgtccgcgtccagtgtgtccgctactccgctccccctcagtcctcagttcctcacctagcggtagcgtgcgcgcgggagacgtagatggcggcttcggaggcggcagcggcggcggcaacaccggtgacgccgacagaggggacggtgatcgcgatccacagcctgggaggagtggagcatccagatcgaggaggccaacagcgccaagaagctggtggtgattgacttcactggcacatggtgtcctccgtgccgcgccatggctccaatttttgctgatatggccaagaagtccccaaatgttgttttcctgannagtgatgtggatgaaatgaagaccattgctgagcaattcagcgtagaagccatgccaacattcctgttcatgagggagggcgacgtcaaggacagggtcgttggcgcancaaaggaagagctagncaggaagcttggactacacatggcctcgtagatcagtgatgccngtatgtagtattccgctaaataagaggacgcctcgcctcactctgagaaaactagg

SEQ ID NO: 54149 - protein, 70 aa, Zea mays
  misc_feature: Ceres CLONE 1478046-F
  misc_feature (1)..(67): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
  misc_feature (19)..(19): Xaa is any aa, unknown, or other
  misc_feature (56)..(56): Xaa is any aa, unknown, or other
  misc_feature (61)..(61): Xaa is any aa, unknown, or other
MAPIFADMAKKSPNVVFLXSDVDEMKTIAEQFSVEAMPTFLFMREGDVKDRVVGAXKEELXRKLGLHMAS

SEQ ID NO: 54150 - DNA, 660 bp, Zea mays
  misc_feature: Ceres CLONE 1478050-F
  misc_feature: Encodes the peptide sequence at SEQ ID NO. 54151
ggagctccccgcggtggcggccgctctagaactagtggatcccccgggctgcaggaattcgtctcacccctagaaaaaactcctcctaaccctcgtcgactcatatccagcttcatcgcatagccggcgccatgccgttcagtccaggcccctactatggcgtcagcacccatcgcccttgtggctagggagtgggtctttggcgtcagcgtcgacatcgggagcatgaatgtctcaatcctcaaggtaacaaaacctataaaggatgaagtgcatgatcattactaaggacgacaaggctgctacattttaattcccacatgatggaaggatgttataaattggaagtgcaccccttctccatacgtacaatacaatttcatttatgatttgcggacctgtgtgtaaataccagcaatttttttttgtgttgaaataaattctaatacaatgacgtgaaatcttgaagtgcaaaagcgtgtcgttcgacgaagaagcatcattaagatccgtgacgctggaggtacccaattcgccctatagtgagtctcattacacgcgctcactgccagacggtttaaacgacgtgactggaaaaaccctggcgttacacaacttagtcggcttgcagcatgtccccctttcgctagatggcgtagt

SEQ ID NO: 54151 - protein, 43 aa, Zea mays
  misc_feature: Ceres CLONE 1478050-F
MASAPIALVAREWVFGVSVDIGSMNVSILKVTKPIKDEVHDHY

SEQ ID NO: 54152 - DNA, 664 bp, Zea mays
  misc_feature: Ceres CLONE 1478061-F
  misc_feature (664)..(664): n is a, c, t, g, unknown, or other
tggagctccccgcggtggcggccgctctagactagtggatcccccgggctgcaggaattcgtctcacccctagaaaactacaactactgcgccgacgccaagcgcttcccgcagggcgtgcccgccgagtgcaagctccggtgagggagcgaggtttgttgggacgtcccgtgggcatcaaaacccggcacgatccctagtcgtggaaagtagaaaccaggcatcgattccatcgtcgtcgacggtcttagtagtagctacttattttgcagtgggcgatgaaagaatggtgtcatgtaaatgtagctctagtcgtggcccattctttgatttgttggttcagcagccccggatgtacaagtattgagtttggggctagcaagaaaaataatctttttcgggcaaaaaaaaaaaaaaaacgagacgctcgaggtacccaattcgccctatagggagtcgtattacccccgctcactgggcgtcgttttacaacgtcgtgactgggaaaacccctggggttacccaatttaatcggccttgcagcacatccccctttttcgccaggtgggcgtaatagcgaaagaggcccgcaccgaatcgccccttccccacaagtttgcgcaaccttgaatgggcaatgggaaaattttaacgctgttaattn

SEQ ID NO: 54153 - DNA, 690 bp, Zea mays
  misc_feature: Ceres CLONE 1478068-F
  misc_feature (75)..(75): n is a, c, t, g, unknown, or other
  misc_feature (76)..(76): n is a, c, t, g, unknown, or other
  misc_feature (360)..(360): n is a, c, t, g, unknown, or other
tggagctccccgcggtggcggccgctctagaactagtggatcccccgggctgcaggaattcgtctcacccctagnnaaaaaccgcatccggtcccggcccgggcgcccaatttccgcgaacagcccaccttcccgccagctccgcctcatccgtagccagacaaagccaacgaggcaaccggcaacaacgtgcccccgcggccctggccggcggacgaacgaacgaagcagtcaaaacccccgcaccccaccggggcaccacacgcagcagcgacgcccccgccccgcgtcttctactcttcttcatcttcaccgctcaccaaccatccatcccccagtcctcctcactggtaacccgtntcccatccccacaccaccaccaccaccatcttccggtcttcccctccccacacccggggggatccccatccccgccccccgatggagctggttcccgcgcgccaaggtggggcggctcaaaagcaaccacgacaagttcctgtacccggacgagaacaaggcccacgtgaaccaggaggggggacggggtccttccgcaaaacccgcgggggggccgtgggaacccggcccccaaaaaaaaccgggggggcattcccgccgtgggggaagccgggaaaggtcaaattacccttccccgccctccggggggaaacccttttccctgggggg

SEQ ID NO: 54154 - DNA, 665 bp, Zea mays
  misc_feature: Ceres CLONE 1478077-F
  misc_feature: Translation starting site: 158
  misc_feature: SWISSPROT Homolog: EC 2.7.8.23 Carboxyvinyl-carboxyphosphonate phosphorylmutase
  misc_feature (383)..(383): n is a, c, t, g, unknown, or other
  misc_feature (521)..(521): n is a, c, t, g, unknown, or other
aagctggagctccccgcggtggcggccgctctagaactagtggatcccccgggctgcaggaattcgtctcacccctagaaaaatttccgatcccatccctctccagccaccttcctccgctcgccgtgcttctgcttcctccgccaccaccgccggcatggctgcgcgctgcccctacttcgccgtcgaggagtcctcccgcggcatccgctcgggggagtccccggccgcggcgctccgccggatcctcgcgacgcctggtgcgcaccaggcgccctgctgctacgacgcgctcggcgcgcgcctcgtcgagcgcgcggggtttccgatcgggttcatggggcgtttctgtgtttctgccgcgcgacttggcttgcctgatngtggcctcatttcctatggagaaatggtagatcaagggcgtctcatcaatgaagctgtttcaatcccagtgatgggtgatggaggacatggttacggaaactctatgaatatcaggaggaccataaaaggtatatcantgctggttttgctggaattatgcttgaggatcaggtggcacctaaagcatgtggacatactgagggagggaaatcatatcagggggagagctgtcatgcacataaaagctgctgtaaatgcaagaaagagagtggctctgactt

SEQ ID NO: 54155 - DNA, 657 bp, Zea mays
  misc_feature: Ceres CLONE 1478079-F
  misc_feature: Encodes the peptide sequence at SEQ ID NO. 54156
  misc_feature (313)..(313): n is a, c, t, g, unknown, or other
  misc_feature (391)..(391): n is a, c, t, g, unknown, or other
  misc_feature (560)..(560): n is a, c, t, g, unknown, or other
  misc_feature (567)..(567): n is a, c, t, g, unknown, or other
ggagctccccgcggtggcggccgctctagaactagtggatcccccgggctgcaggaattcgtctcacccctagaaaaagtcatcaatcaaatactcagacaaccatggggcaccagcaggcgcagcacggcaaggacgacaccgaggagctgcttgcagcccaccggcagctgtggtgccatgccctgggctacgtcaagtccatggcgctcaagtgcgccctggacctgcgcatccccgacaccatcgaccgctgcggcgggagcgccaccctgggcgagctgctcgccgccagcgagatcccggcgtcaanccacgactacctccggcgggtcatgcgcacgctgacagccatgcgcatcttcgcggccagccacgacccccgcaaggncgacgacgcggccgccatctcctaccagctgaccccggcgtcccggttgctcgtcagcagcagcagcagcgtcaacgacgccggcgggcgcctcgaaggagaacactactaccccgagcatcctccccaacatcgccaacctgggtcggccccaacaccatctccctgntgttcancatgggcgagtggatagaaggaccagaccgcggctttccctgtccctgtacaagacggtccaccggaaggggatttgggcctcccataaa

SEQ ID NO: 54156 - protein, 159 aa, Zea mays
  misc_feature: Ceres CLONE 1478079-F
  misc_feature (34)..(82): Pfam Name: Dimerisation Pfam Description: Dimerisation domain
  misc_feature: SWISSPROT Homolog: EC 2.1.1.146 (Iso)eugenol O-methyltransferase
  misc_feature (70)..(70): Xaa is any aa, unknown, or other
  misc_feature (96)..(96): Xaa is any aa, unknown, or other
  misc_feature (152)..(152): Xaa is any aa, unknown, or other
  misc_feature (155)..(155): Xaa is any aa, unknown, or other
MGHQQAQHGKDDTEELLAAHRQLWCHALGYVKSMALKCALDLRIPDTIDRCGGSATLGELLAASEIPASXHDYLRRVMRTLTAMRIFAASHDPRKXDDAAAISYQLTPASRLLVSSSSSVNDAGGRLEGEHYYPEHPPQHRQPGSAPTPSPXCSXWASG

SEQ ID NO: 54157 - DNA, 676 bp, Zea mays
  misc_feature: Ceres CLONE 1478080-F
  misc_feature: Translation starting site: 194
  misc_feature: Pfam Name: DUF1223 Pfam Description: Protein of unknown function (DUF1223)
  misc_feature (333)..(333): n is a, c, t, g, unknown, or other
  misc_feature (339)..(339): n is a, c, t, g, unknown, or other
  misc_feature (397)..(397): n is a, c, t, g, unknown, or other
  misc_feature (408)..(408): n is a, c, t, g, unknown, or other
  misc_feature (415)..(415): n is a, c, t, g, unknown, or other
ctggagctccccgcggtggcggccgctctagaactagtggatcccccgggctgcaggaattcgtctcacccctagaaaagacctcacttgatccgctcccttcgccgcgacgacgttcctacgcagctgcggtcgacgcgcgcacggcagctcgctcgctagctgatcacgacagctcgctcggctcgaccgaatggcgccgcggctgctggcgtgcttcgggcgcggcgtcgcggcggccccggacaacgcgactggcgagggccagctgggagcgccccccgctggcccggtgctggtggagctgttcgggtcccaggggtgcggggctcncccgangcggacgccgtggcggcgcggctggcccaggactccgggtccggggaccgccccctcntggtgctggcnttccacntccactactgggactaccgcgggtgggagggaccccttcgcggtcagggcctggaccgtgcgccaaagggctaccggggaggcgcctcccctcgaaacccttcttaacgccgaaggtcgtcctggcggggccccccgcactgggttcgggaccaaacagggacccgcttgggggtgggccgtcccgaaagccccggggttaccccggggccggccaataaagggcccggttccaggggggccgacccccgaaaccgggggg

SEQ ID NO: 54158 - DNA, 654 bp, Zea mays
  misc_feature: Ceres CLONE 1478084-F
  misc_feature: Translation starting site: 324
tggagctccccgcggtggcggccgctctagaactagtggatcccccgggctgcaggaattcgtctcacccctagaaaactctcactcgcctcgacgcgcctctgaaagttcggagccgccggcccgtccgcctccctctccgcctcccgtccccaaggccaatagttttcaagtggcaatggcggaccaggctaaccaaccactgtccttcataagctcgggtggcagttccacctgcgctcgatcatctctgaaggtgtacgggcccgtaacatatgcccatctgtctcatcttatgaaagggagattgccacaagaactacatgacccagagccctttgggcccttcgatgtctgttagcggtggcatcaatgtcccagtgatgcggaccccgctctgtgctaatgctcctgctgagaaagaggccagaccttcatgatcgatttcatgatgggcgggtttcagctgctgtttcaaaactgctgctgctcccatcgagcgtggtgagctgcttatccaaacccagatgagatgattaagtctggtaggttatcaaacccctacaggggaatttgtaactgcttcaaccgtaccattaagggatgagggtttctcctccctgggggaggggtaaccctgctaattgttattcc

SEQ ID NO: 54159 - DNA, 631 bp, Zea mays
  misc_feature: Ceres CLONE 1478086-F
  misc_feature: Encodes the peptide sequence at SEQ ID NO. 54160
  misc_feature (311)..(311): n is a, c, t, g, unknown, or other
  misc_feature (313)..(313): n is a, c, t, g, unknown, or other
  misc_feature (314)..(314): n is a, c, t, g, unknown, or other
gcggtggcggccgctctagaactagtggatcccccgggctgcaggaattcgtctcacccctagaaaaaaaaaaacaacgtgcttgatctccctccgccactccatccatctcctcgctcccagtccccgggaagcatggcgtccgtcaccgcccgcgccccggtagcggcccttcgcccgtcgtcggcatcgctcaagtcgtcgtcggccttccttggcactctagccgccctcggcgcaccgcgtctcccacgaggcgcagcctcaagggcgaggccaagggcgagtggctccccggccttccctccccntnnctactcgacggcagcctgggcgggtgacaatggcttcgacccgttgggcccctgcggagaccccgagaacctgcggtggttcgtgcaggcggagctggtgaacggccggtggggcatgctttgcgtggccgggatgctcatcccgggagtgctgacaaaagccgggctgatcaacgcgccgcagtggtacgacgcccggaagtcggagtacttcgcgtcgtcgtccacgctggttgggggtcgagttcatcctgttccactacgtggagatccgggggggggcaggacatcaagaaccccgggagggtcaaccagga

SEQ ID NO: 54160 - protein, 165 aa, Zea mays
  misc_feature: Ceres CLONE 1478086-F
  misc_feature (57)..(164): Pfam Name: Chloroa_b-bind Pfam Description: Chlorophyll A-B binding protein
  misc_feature (59)..(59): Xaa is any aa, unknown, or other
  misc_feature (60)..(60): Xaa is any aa, unknown, or other
MASVTARAPVAALRPSSASLKSSSAFLGTLAALGAPRLPRGAASRARPRASGSPAFPPXXYSTAAWAGDNGFDPLGPCGDPENLRWFVQAELVNGRWGMLCVAGMLIPGVLTKAGLINAPQWYDARKSEYFASSSTLVGGRVHPVPLRGDPGGGRTSRTPGGSTR

SEQ ID NO: 54161 - DNA, 741 bp, Zea mays
  misc_feature: Ceres CLONE 1478093-F
  misc_feature: Encodes the peptide sequence at SEQ ID NO. 54162
  misc_feature (22)..(22): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (39)..(39): n is a, c, t, g, unknown, or other
  misc_feature (41)..(41): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (429)..(429): n is a, c, t, g, unknown, or other
atatgggccgtggaaggagggngagnnnnnnnnnnnntntnttgcctctggcagaannnnnctcaccgaggtggcggccgctctttactagtggatcccccgggctgcaggatttcgtctcacccctagaaaaaccgctgcctgcatgatattggaaacactccaaacccatatgagcaagctatatctattattggaaggacactttcagcatttgatgaagataatttgattccctgcttcggatttggtgacgcgtcaactcatgatcaggaggtattcagcttttacccagagaaccgcccatgcaatggatttgaagaggcgctagacagatacagagaaatcgttccaactcttcgattagcaggacctacatcttttgcgccgatgattgagacagcaattggaattgttgacagcactggnggacaatatcatgttcttctgataatcgccgatggacaccccacccgaagtgtcgatacacaatctggacagttgagtccacaggagcgggatactattgatgcaatagtaagagcaaagcagtttccccctgtcaattgttcttgtccggggttggtgatgggaccatgggaacattgatgcaccagttttgatgacaaatataccctgcttcgggccattttgaacaatttccaggtttggtgcaattttcacggggaaattattgtcagaaagaagcaatagccaccctggaacaagaaagggagggcc

SEQ ID NO: 54162 - protein, 72 aa, Zea mays
  misc_feature: Ceres CLONE 1478093-F
MIETAIGIVDSTGGQYHVLLIIADGHPTRSVDTQSGQLSPQERDTIDAIVRAKQFPPVNCSCPGLVMGPWEH

SEQ ID NO: 54163 - DNA, 664 bp, Zea mays
  misc_feature: Ceres CLONE 1478094-F
gctccccgcggtggcggccgctctagaactagtggatcccccgggctgcaggaattcgtctcacccctagaaaaaaattctttcgctgcggaaatggaagaggtgccttcgcctcacaccttctggtcgcccattccaatccgatccccggccggacacctaccaccgtccatccccattaatctctgaggctcctcaagatatcatgtctctctcgactatctccccgcctgcgccactgctaataccatgataatgcaaggcggcacctccaataatacctttgccatctgctctctgctgcgatgcaaaacaatacacttgtggaatgcgcactgcccaaggatgacactaacgagatatgcttacacttgatcacatgtccaacgatgtaaacccaacattcttcaacacaagcatcagctcccttggggtgtaactttcttgacctcctgagaagagattgttgaagtcatctggccttcataaaaaaaaagaactggttattggatctcgtatccctaggacattgattactgcacaggtatcttgttgatgctctatgatgctctacctgtatgagcgtagctccgctgatgaagtcaaatgatgcatgtcctgcagattccacttgacaatcgccaccatgacttgctcctaatgc

SEQ ID NO: 54164 - DNA, 817 bp, Zea mays
  misc_feature: Ceres CLONE 1478094-R
  misc_feature: Encodes the peptide sequence at SEQ ID NO. 54165
ttacgattgggtacctcgagcgtctcgttgttttgttttggttacgggttgattttaggatttttttgtttttttgtattgtttgtttttttttgttttgtttgccccagaaatggtcagtgatttattggtgcattgcggtctgaatctggcatcctctaataaatggcccccccccccccgctgttgcgatttgcgaggcaggtcagctgcaatctttttgcagcagccactaaacctgtaccaagtcttcttgcgtgagggcagaggcaggctccgtcagtcacgccggcggcgtacagatcatggaggactttggcggttggaatatgcagtatgcagcagagctatgcctgccaagccgccgggacgacgacgacgacgacgacggcctcctcggtgacttcctaggcggcggcggtttggacctccgttctgaccatggcggcctcaacctgccctcgtcgcaccctgctgtccagaaccttgtgccctgccacggcggcgcgagtctttccgtttccgacgccttcatgggcctggacacggcggatatgctcgctagcgtcaccggcgcactggactgcagcctcctcgacacgtttgcttgcggttcggacgccgtcgtcgtcgccgccgaggagcccgccgcgcagcccaccgcgtcgagcaacgccttctccggatacagcagcaccgcgggcggcaattacggcaacatctcctccggcgaatccaacacgtacggcggcagcggcggatgccatgacaccgatgttgcgtcgacgacctgcgcctcgaagcggaagctggccgg

SEQ ID NO: 54165 - protein, 170 aa, Zea mays
  misc_feature: Ceres CLONE 1478094-R
MEDFGGWNMQYAAELCLPSRRDDDDDDDGLLGDFLGGGGLDLRSDHGGLNLPSSHPAVQNLVPCHGGASLSVSDAFMGLDTADMLASVTGALDCSLLDTFACGSDAVVVAAEEPAAQPTASSNAFSGYSSTAGGNYGNISSGESNTYGGSGGCHDTDVASTTCASKRKLA

SEQ ID NO: 54166 - DNA, 627 bp, Zea mays
  misc_feature: Ceres CLONE 1478095-F
  misc_feature: Encodes the peptide sequence at SEQ ID NO. 54167
  misc_feature (381)..(381): n is a, c, t, g, unknown, or other
  misc_feature (517)..(517): n is a, c, t, g, unknown, or other
  misc_feature (534)..(534): n is a, c, t, g, unknown, or other
  misc_feature (535)..(535): n is a, c, t, g, unknown, or other
  misc_feature (553)..(553): n is a, c, t, g, unknown, or other
  misc_feature (560)..(560): n is a, c, t, g, unknown, or other
  misc_feature (567)..(567): n is a, c, t, g, unknown, or other
  misc_feature (588)..(588): n is a, c, t, g, unknown, or other
  misc_feature (589)..(589): n is a, c, t, g, unknown, or other
  misc_feature (594)..(594): n is a, c, t, g, unknown, or other
  misc_feature (596)..(596): n is a, c, t, g, unknown, or other
ctccccgcggtggcggccgctctagaactagtggatcccccgggctgcaggaattcgtctcacccctagaaaaatccagcctcgagcaccgggacctgccgcgtgcttcttactggcaacttggcaagtggcacggccgcacggatccatctccatcgtcgaggcgaggacgaggaagcagatcgaagcacccaaccacaccacactggtggtgagtggttgctggcgatggcgatggaagcgatgatgagcgggctcaactccggcgtggtgctcagcctgatcgccgtgctgtggacggtggtgtggcagaacctgcagcacctgcagctgcagcagttcttcgcgcggcagctgaaccggcgcgcgcggcggctggcnggcgaatggtgacccgtacctgtcggtcaccatcgccgagtacgagggcgggcggatgaagcgcagcgacgcgtacgaagaggtcaagggcctactcagcgacgccagcgcccacggcgtgcgccacctccggggncgagtcccgcaaggacnngcgacagctcgtgctcancatgtcngacggcnaagaagtggaagacgacttcnnaggcncnagggtctggtggtgggcctactccaagcagg

SEQ ID NO: 54167 - protein, 52 aa, Zea mays
  misc_feature: Ceres CLONE 1478095-F
MEAMMSGLNSGVVLSLIAVLWTVVWQNLQHLQLQQFFARQLNRRARRLAGEW

SEQ ID NO: 54168 - DNA, 662 bp, Zea mays
  misc_feature: Ceres CLONE 1478097-F
  misc_feature: Encodes the peptide sequence at SEQ ID NO. 54169
  misc_feature (365)..(365): n is a, c, t, g, unknown, or other
  misc_feature (366)..(366): n is a, c, t, g, unknown, or other
  misc_feature (448)..(448): n is a, c, t, g, unknown, or other
aagctggagctccccgcggtggcggccgctctagaactagtggatcccccgggctgcaggaattcgtctcacccctagaaaaaactgtctgaatccaagggcatttgtctgtagttctaagccattcaagcgaatgcattacttaaatatcagagaaccacactatacttgtgttgtaagttgtattataagattctactgtatgcaccatgtcactggattagactattcttgcatttgtaattagcaggtcaatgcttctagatatgtgttgtatatcccatgttcccagattttgacatgatattttttatcaaccagaaactttgttcaacaaggatttgatatgaaccttgctttctgcnnatcagagaagcagagaaatgaggagagttcggtggagtcatcacaatggagaaacatcaagcagcatgtgctaccttatggnttctcgaggccactcacacgaaagctttcatttgatgcctccctcagtgaatcagggggcacagaacccctcacaagtatgtcaacagagaacacacctgtgtccatcaacgtcccaaagtggcagagggcattgaatttgggagcaaccatggtcacatcctccactttggtagagctaacactagactagatttctcaaggagcgaagtcgc

SEQ ID NO: 54169 - protein, 97 aa, Zea mays
  misc_feature: Ceres CLONE 1478097-F
  misc_feature (7)..(7): Xaa is any aa, unknown, or other
MNLAFCXSEKQRNEESSVESSQWRNIKQHVLPYGFSRPLTRKLSFDASLSESGGTEPLTSMSTENTPVSINVPKWQRALNLGATMVTSSTLVELTLD

SEQ ID NO: 54170 - DNA, 717 bp, Zea mays
  misc_feature: Ceres CLONE 1478102-F
ggagctccccgcggtggcggccgctctagaactagtggatcccccgggctgcaggaattcgtctcacccctagaaaaagaacccccaaggcgaggcgacgaaaccctcgccagtccccaactcgaacctcagtcaggcagcgtgaagagggagagttcaaggaccgaggcggcgtctggctaaatgaaccttaccgtcaagaccctcaagggcaccaacttcgagatcgaggcgagccccgatgcctccggttgctgacgtggaaaagatctttgagacccctctgggcccagagaggtaccggggccgcccccaaaggccttagttgccgagggaaaatctcccgcggcatggaaccttttttggaaaggggcggggtgtgccccccacccccccccctcctttaattccttggaagcgcccccccccccccccccccccggtgggggtgttgcgcggtggcgggggtcgttggggttaaaaccacaccctggacggccggtcgtcggcgagcctgccggtgggcggcggggccggaggggcgggggtgtcggccgcgggcggggggcgcgcgccgcgccgccccccaaccgcggaccggcggcggcgcccgtgcgcccccccccgagcggccggggcgacccgccgtctcccggcaggccggtctcccctcatccccaccgggcccgccccgtggcgaccggcccgcggggaccg

SEQ ID NO: 54171 - DNA, 671 bp, Zea mays
  misc_feature: Ceres CLONE 1478110-F
  misc_feature: Encodes the peptide sequence at SEQ ID NO. 54172
aagctggagctccccgcggtggcggccgctctagaactagtggatcccccgggctgcaggaattcgtctcacccctagaaaaagatcatttccccactcgatcgccaatagtggagtttccgcaccaccaccaccaccatggccatcgccgcgacgacgacgaagacgaccgcagaggcccgcctcccccggtctacggcggctacggccagccaccgccacccgacccgtacggacgcgcgcccgtcgacctctatgcgtacggtcgacctccgccgcagtccgcgtacggtggggtcggggacgcctacggccactgcgggcaatgctactcgcccccgtcagtctacggcgcggggggcgggtacggcaacgtcgtccacgtcacgcacgaggtctgcaactagatggcatactactgctgggggaagctcggtcttgatagcacatacggaggggtgggctcctagtacgggcacgagggcccgactgaacacgggggggggcgggatcctgttggggcacgagacacgcccgctcccgggcgggagggggggggcccccctgcctgggaatggaacaaaccgtacgagaatctactggagggggtgggggagggaactttaactgccttgccctccccgcgaacgggatagggtcagccatcgggg

SEQ ID NO: 54172 - protein, 134 aa, Zea mays
  misc_feature: Ceres CLONE 1478110-F
AGAPRGGGRSRTSGSPGLQEFVSPLEKDHFPTRSPIVEFPHHHHHHGHRRDDDEDDRRGPPPPVYGGYGQPPPPDPYGRAPVDLYAYGRPPPQSAYGGVGDAYGHCGQCYSPPSVYGAGGGYGNVVHVTHEVCN

SEQ ID NO: 54173 - DNA, 647 bp, Zea mays
  misc_feature: Ceres CLONE 1478111-F
  misc_feature: SWISSPROT Homolog: EC 2.3.1.167 10-deacetylbaccatin III 10-O-acetyltransferase
  misc_feature (442)..(442): n is a, c, t, g, unknown, or other
  misc_feature (477)..(477): n is a, c, t, g, unknown, or other
  misc_feature (479)..(479): n is a, c, t, g, unknown, or other
  misc_feature (480)..(480): n is a, c, t, g, unknown, or other
  misc_feature (492)..(492): n is a, c, t, g, unknown, or other
  misc_feature (647)..(647): n is a, c, t, g, unknown, or other
gctccccgcggtggcggccgctctagaactagtggatcccccgggctgcaggaattcgtctcacccctagaaaaaacccggcgcgtgacgggctcagccccgcggagaccatagagcgggccctcgcacgggcgctggtcgactactacccgctcgccggccgcctcgccgtgtccgagagcgccgggggcctgcacgtcgactgcagcgctgagggcgtctggttcatcgaggccgccgtacggtgccgccttgaggacgtcgactacctcgagtacccgctccagatccccaaggacgagctgctcccgcacccgctgccgaggcccagccacgaggaggagagcaagctcatcctgctcgtccaggtgacggcgttcgcgtgcggcggcttcgtggtgggcttccgcttcagccacgcggtggcggacgggctcggcgncgccaagttcatgggcgcgttggggggagcttgcncnncggggcgacctngtgtccgtggcgcccacctgggcccgcgacgccatcccagacccgtcgggcgcgctggtcggcagcctccccgagcccacgggcgccaagcgcctcgagtacctgggcatcgacatctccggcgactacatccaccacttgcagtcccaggtcgn

SEQ ID NO: 54174 - DNA, 650 bp, Zea mays
  misc_feature: Ceres CLONE 1478112-F
  misc_feature: Encodes the peptide sequence at SEQ ID NO. 54175
  misc_feature (650)..(650): n is a, c, t, g, unknown, or other
ctccccgcggtggcggccgctctagaactagtggatcccccgggctgcaggaattcgtctcacccctagaaaaacccctagaaaaaattccttccttccactcccccgcccagcgccaccatggcctcctccgtcgcggtgtccctccgcgccctcgctgccgccccgctccccaagtccagccccgccacttcctgccccttcttcgtgctccttgcgccggcgctgccccgacgcctgctccgcctccgctccgcacgccgcctgccgctcgccccgctcgccgcctccgattccgccttcgagtcctccgtcggagttaactacgcggagcccgacgactcggagaaggataaggaggtggagttgttcggatcgggtgacgacgagggggcgggtgagttggtggatgaccattccgtagaggtctcagccgctgtcgaggacgaggtggaggaggaggtcggggagtacgttgagccgcccgaggaggccaaggtctacgtcggaaacctgccctacgacgtcgacagcgagcgcctcgctcagctcttcgaccaggccggcgtcgtcgaggtcgcagaagtcatttacaacagagaaacagatcaaagtcgtgggtttgggtttgtcactatgagcactgtcgn

SEQ ID NO: 54175 - protein, 176 aa, Zea mays
  misc_feature: Ceres CLONE 1478112-F
MASSVAVSLRALAAAPLPKSSPATSCPFFVLLAPALPRRLLRLRSARRLPLAPLAASDSAFESSVGVNYAEPDDSEKDKEVELFGSGDDEGAGELVDDHSVEVSAAVEDEVEEEVGEYVEPPEEAKVYVGNLPYDVDSERLAQLFDQAGVVEVAEVIYNRETDQSRGFGFVTMSTV

SEQ ID NO: 54176 - DNA, 655 bp, Zea mays
  misc_feature: Ceres CLONE 1478114-F
  misc_feature: Encodes the peptide sequence at SEQ ID NO. 54177
  misc_feature (243)..(243): n is a, c, t, g, unknown, or other
  misc_feature (246)..(246): n is a, c, t, g, unknown, or other
  misc_feature (249)..(249): n is a, c, t, g, unknown, or other
aagctggagctccccgcggtggcggccgctctagaactagtggatcccccgggctgcaggaattcgtctcacccctagaaaactaccctccccacctcttccacggttccaccccgtccctctcctctcgagaagcacccgcaccatacatcttccggcgcccgacgcggacggcgagccgctgctgctgctgccgccggaggaggaagggcaccagggccagcgggtgcaggaggaggagancancancaggccgccggccgcttgggggctgtgccacatgccgctctggggggcccgcgcgtccgcggcgcggcagccgacggcgacgccgcccgcgcgccgtcggggatcggcggcggggtcaaagtgatccgggcgctgctccccacccggcgcctcctccgcctagatccgcccgccagctctacttccatatgagcccggcaggcaagtccggagcgcggtcaggatcaggaacatcagcaaggcccatggggccttcaagttccaaacgactgcaccaaagagttgcttcatgaggcctccggggggggtggcttctcccggggaaaccatccttccaccgtttttcaagttgggggagcctccggaaaacacgagaacccaagggccaggtgcaggttaattttaa

SEQ ID NO: 54177 - protein, 36 aa, Zea mays
  misc_feature: Ceres CLONE 1478114-F
MRPPGGVASPGETILPPFFKLGEPPENTRTQGPGAG

SEQ ID NO: 54178 - DNA, 607 bp, Zea mays
  misc_feature: Ceres CLONE 1478115-F
  misc_feature: Encodes the peptide sequence at SEQ ID NO. 54179
  misc_feature (561)..(561): n is a, c, t, g, unknown, or other
  misc_feature (573)..(573): n is a, c, t, g, unknown, or other
ctccccgcggtggcggccgctctagaactagtggatcccccgggctgcaggaattcgtctcacccctagaaaaagtaacaagtgtccttcctccatcttcctcctccactccactcccaagtccccaccacccccaaccccgtctctccactgcggcgcaggcttcgcttcggctccgctcggctcgagcagaagaaaatgcaacgggcagtgcaggccgtcaggtcacacggcaatgttcttaaatatgctgttctacaacacatcagcgctcccaagccagcaatgcttcctgctgccttttctcgtttcatgtcagtttcatctgctcgcctagaggatcgtggatttgaaactgccactgtagcagatgtcttgaagtctaaagggaagagtgctgatggatcttggctctggtgcaccacagaggatagcgtctatgacgctgtcaaatctatgactcagcacaacgtgggagctttgggtgggtgtcaacctggacagaataaatcaatcgctgggcatgtcactgagagagatatctccggaaatcatagtgcngggaggtctccnagtcaactaaggtggcgaactctgactgagagaa

SEQ ID NO: 54179 - protein, 136 aa, Zea mays
  misc_feature: Ceres CLONE 1478115-F
MQRAVQAVRSHGNVLKYAVLQHISAPKPAMLPAAFSRFMSVSSARLEDRGFETATVADVLKSKGKSADGSWLWCTTEDSVYDAVKSMTQHNVGALGGCQPGQNKSIAGHVTERDISGNHSAGRSPSQLRWRTLTER

SEQ ID NO: 54180 - DNA, 649 bp, Zea mays
  misc_feature: Ceres CLONE 1478117-F
  misc_feature: Translation starting site: 168
  misc_feature: Pfam Name: ELO Pfam Description: GNS1/SUR4 family
  misc_feature (491)..(491): n is a, c, t, g, unknown, or other
ctccccgcggtggcggccgctctagaactagtggatcccccgggctgcaggaattcgtctcacccctagaaaaaactcagtccacactccacagggaaggagggagcaggagaggtaggtagccaagaagatcggttccagcggcaggcgcgagcgaggcgtgaccgatggcggccgcgtcgctgctgagccgggcgcggtggctcctggtggagcacccggccgtggcctcgttccgctggcagccaggccgcacggtcggcgcgacgccgtccttcgcggccgccgtcatctgcggctacctcgccgcggtgctcgtcctccgccgcctcgtcctgccccgcctcccggcgctgcctccgccggcgctccgcgcgctctccgccgcccacaacgcggtcctgctggcgctctccgccgccatggccggcgggtgcgcgctgtcgacggccgcgacggcgccggcgcccgcgtgggcgtgggccttctgncttccgccgcgggcgccacggaggcgtcggggcccgtctttctctgggcgcacgtgttctacctctccaaggtgtacgagctcggcgacacgctgctcattctggtcgcccgccgcccgctcacggtgcttcacgtgtaccaccacgcgctcgtcgtg

SEQ ID NO: 54181 - DNA, 652 bp, Zea mays
  misc_feature: Ceres CLONE 1478120-F
  misc_feature: Encodes the peptide sequence at SEQ ID NO. 54182
ggagctccccgcggtggcggccgctctagaactagtggatcccccgggctgcaggaattcgtctcacccctagaaaaaagacctacaaactccggcaacagtcgaccaacaatgggcttcatccacagggggccctccaagcagagcagcaaggttaagacccttctagggctcgccttgtcccgccttaccgctgcccgccgtccccgcctcgctcgcaggtcgatttcccgcagcgatgtgggacagctgctagggctcagccacctcgatcgcgctctccaccgtgcagagcagctcatagaggaggataacatgctggaggcattcaacataatagagctacactgcaattgcctcatcgagcacgcaaagcagttagacaagcccaatgaatgcggcgaggacattcgggaggcagccgccgggatcatatttgcagccgggaggtgcagcgatcttccagagctgctgtttgcacgcactatactggcaaataagtttggagacgacttcgcaacgatggcaagggagggcactggcgtcgtcaaccccatgtgggtctggaagctatctggcaacaaaacaaacatggaggtcaagaaaaaggtggtgaaaaagatggctgcccagaacaatggtcggggggatt

SEQ ID NO: 54182 - protein, 180 aa, Zea mays
  misc_feature: Ceres CLONE 1478120-F
  misc_feature (21)..(142): Pfam Name: DUF292 Pfam Description: Eukaryotic protein of unknown function, DUF292
MGFIHRGPSKQSSKVKTLLGLALSRLTAARRPRLARRSISRSDVGQLLGLSHLDRALHRAEQLIEEDNMLEAFNIIELHCNCLIEHAKQLDKPNECGEDIREAAAGIIFAAGRCSDLPELLFARTILANKFGDDFATMAREGTGVVNPMWVWKLSGNKTNMEVKKKVVKKMAAQNNGRGD

SEQ ID NO: 54183 - DNA, 695 bp, Zea mays
  misc_feature: Ceres CLONE 1478125-F
  misc_feature: Encodes the peptide sequence at SEQ ID NO. 54184
  misc_feature (420)..(420): n is a, c, t, g, unknown, or other
  misc_feature (494)..(494): n is a, c, t, g, unknown, or other
  misc_feature (572)..(572): n is a, c, t, g, unknown, or other
aagctggagctccccgcggtggcggccgctctagaactagtggatcccccgggctgcaggaattcgtctcacccctagaaaaagaagagcatagagctagcaactagctcacttgatatacatatacacaggccggcatattgcatcggcataaaaactgaatttaccatggcccacctgatctcttctgcaatcgcaggcgcgggcaacttggtcgctgatggaatcagtggtgtcactggcgtagcgtcgcaggttgtagaaggcgtagaggacactttaggcagtatcgtagaagcaatcgaccaaggagtcaaggatgaggaccaactggacttgcccaagtacgtgtgtttcaagggagataaacgtctgtaccttagtgctcgaaaggttgaaggccatccctacctgcaattngcatcgggagatattggcgaccccagtgtgaggttcatcaccttacaccacaaggtgaacggcaaacgggtggntgcgcttcaagtcaacccatcttcgcaagttctgggcgacaaaccctaactggatctgggccaacccgacaaaccggnctaaaaaatcccaacccttgttaaacctctcaaaatacggaaaaaaggctggaaacccctccgaaacctggaaaaaaaattttttgccaccgggttacctaaaagggaagggaaaactcccta

SEQ ID NO: 54184 - protein, 124 aa, Zea mays
  misc_feature: Ceres CLONE 1478125-F
  misc_feature (84)..(84): Xaa is any aa, unknown, or other
  misc_feature (109)..(109): Xaa is any aa, unknown, or other
MAHLISSAIAGAGNLVADGISGVTGVASQVVEGVEDTLGSIVEAIDQGVKDEDQLDLPKYVCFKGDKRLYLSARKVEGHPYLQXASGDIGDPSVRFITLHHKVNGKRVXALQVNPSSQVLGDKP

SEQ ID NO: 54185 - DNA, 709 bp, Zea mays
  misc_feature: Ceres CLONE 1478133-F
  misc_feature: Encodes the peptide sequence at SEQ ID NO. 54186
  misc_feature (479)..(479): n is a, c, t, g, unknown, or other
  misc_feature (480)..(480): n is a, c, t, g, unknown, or other
aaagctggagctccccgcggtggcggccgctctagaactagtggatcccccgggctgcaggaattcgtctcacccctagaaaaaatccccccgcgtagaggagaggagaggaagaagaagaacccagccaaatcctcagtcctcaggctgctcacagctcgtgccgtccactctcccccgagccagtctcttgcgttcgctgctcgacatggcgctccaggcggcgacgtccttcctcccctctgccctctccgcgcgcaaggaggggtcggtgaaggactcggcgtcgttcttgggtgttcgtctcgcggcggatggcctcaagctggacaccaccgctctgggcctacgcaccgtgagggtgagcaggtcggcggacatccgcgcgcagacggcagcggtgtcctccccgtcagtgacccccgcgtcgctgtctggcaagaagatctttccgcaagggcacagcggtcatcaccggnngcgtcgtccggcctcggcctcgccacggcgaaagccctcgccgaagacaggcagttgcacgtcatcaatggctgccgggacttctcaaggggtccggcgcggccaaggggggccgatggaacaaggaaattttcccgtgcggggacctggaacctcccctcctggaaaagtttcccccaatttccagagaactgcgcccccttgaaaagcccctccaccggggggctcg

SEQ ID NO: 54186 - protein, 158 aa, Zea mays
  misc_feature: Ceres CLONE 1478133-F
  misc_feature: SWISSPROT Homolog: EC 1.3.1.33 Protochlorophyllide reductase
  misc_feature (91)..(91): Xaa is any aa, unknown, or other
MALQAATSFLPSALSARKEGSVKDSASFLGVRLAADGLKLDTTALGLRTVRVSRSADIRAQTAAVSSPSVTPASLSGKKIFPQGHSGHHRXRRPASASPRRKPSPKTGSCTSSMAAGTSQGVRRGQGGPMEQGNFPVRGPGTSPPGKVSPNFQRTAPP

SEQ ID NO: 54187 - DNA, 664 bp, Zea mays
  misc_feature: Ceres CLONE 1478143-F
  misc_feature: Encodes the peptide sequence at SEQ ID NO. 54188
  misc_feature (468)..(468): n is a, c, t, g, unknown, or other
aaagctggagctccccgcggtggcggccgctctagaactagtggatcccccgggctgcaggaattcgtctcacccctagaaaaagcgcgacatggcgcccgccgcccggtggtccacgtcccctgtgctcttcctcctgctgctgctcgcggcggccacggcgacgaccactacggcaaagcatgggcatccgtcgccgacgccgtggccggagcgtttccacgcggtgctgttcacgaacctgaccaactacacggaagcctccacgtacgggcccgccgctgcgcgtgacggacctctactacgactggccgcggcggcggaacctgaacctggtgcggcaccagctgtcggacgacccgctgtacgacgtggagtggaacaacggcaccggcttctacttcgactccaaggcgtgccgcgtggagcagttccccgtgggcgtgctgccgccgtggtggctctccngggcgcggcgcgagtacgtgggcccgccgcgtcgccgggcgggatcgactgccacgtgtgggggaaagggcggctttatcttctactacaaggaggccgcacggggcggcccgtgccctgggacttcctccacgtgaccgggatcccccattccgagagagacttcagcccggaacttcccttgagaacaccccac

SEQ ID NO: 54188 - protein, 191 aa, Zea mays
  misc_feature: Ceres CLONE 1478143-F
  misc_feature (126)..(126): Xaa is any aa, unknown, or other
MAPAARWSTSPVLFLLLLLAAATATTTTAKHGHPSPTPWPERFHAVLFTNLTNYTEASTYGPAAARDGPLLRLAAAAEPEPGAAPAVGRPAVRRGVEQRHRLLLRLQGVPRGAVPRGRAAAVVALXGAARVRGPAASPGGIDCHVWGKGRLYLLLQGGRTGRPVPWDFLHVTGIPHSERDFSPELPLRTPH

SEQ ID NO: 54189 - DNA, 656 bp, Zea mays
  misc_feature: Ceres CLONE 1478157-F
  misc_feature: Translation starting site: 396
  misc_feature: SWISSPROT Homolog: EC 1.4.1.2 Glutamate dehydrogenase
  misc_feature (420)..(420): n is a, c, t, g, unknown, or other
  misc_feature (552)..(552): n is a, c, t, g, unknown, or other
aaagctggagctccccgcggtggcggccgctctagaactagtggatcccccgggctgcaggaattcgtctcacccctagaaaaaactatcattgcaaaagcaaagcacgcaatccaatttccctccatttctctagatctcgagttgctctgctacttcttttagattccttctttcgttcgggagagcgattctctagctggtggcaatggcgaagggcgagggtccggcgatcgggatcgatctcggcaccacctactcgtgcgtcggcgtgtggcagcacgaccggagtggagatcatcgccaacgaccagggcaaccgcaccacgccgtcctatgtcgccttcaccgacaccgagcggctcatcggtgacgccgccaagaaccagggtggcatgaacccccacaacaccgtcttcnatgccaagcggttgatcggcaggaggttctctgacccgtcagtgcagagtgacatgaagctatggcccgttcaagtcatccctggccctggtgacagcccatgattgtagtctcctacaagggtgagggagngcagttcgctgctgaaaagatcctctccatggtgctcatcaagatgaggagattgctgaaccctacctcgctctactatcaagaatgcaggggggacgtggccg

SEQ ID NO: 54190 - DNA, 714 bp, Zea mays
  misc_feature: Ceres CLONE 1478169-F
  misc_feature: Translation starting site: 137
aaagctggagctccccgcggtggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactactgctgggacaccgccgggctgtccgccgaccccgagaccttcgccaagaacccgcgagctgaggtgatccactcccgctggggcatgctcggcgcgctcggctgcgtcttccccgagctgctttcccgcaacggcgtcaagttcggcaaggccgtctggttcaaggccggctccaaaaacttcagcgagggcgggctgggactacctcggaacccccagcctgatccaaggccaaaacatcccccccaattgggcctgccaggtcttgcccaggggggccctcaaaggctaccccattcccggggggccccctcgaaaagctttcaaccccttttcccctggggggaagttttaac

SEQ ID NO: 54191 - DNA, 643 bp, Zea mays
  misc_feature: Ceres CLONE 1478189-F
  misc_feature: Encodes the peptide sequence at SEQ ID NO. 54192
  misc_feature (258)..(258): n is a, c, t, g, unknown, or other
  misc_feature (260)..(260): n is a, c, t, g, unknown, or other
  misc_feature (269)..(269): n is a, c, t, g, unknown, or other
  misc_feature (291)..(291): n is a, c, t, g, unknown, or other
  misc_feature (296)..(296): n is a, c, t, g, unknown, or other
  misc_feature (338)..(338): n is a, c, t, g, unknown, or other
  misc_feature (403)..(403): n is a, c, t, g, unknown, or other
ctccccgcggtggcggccgctctagaactagtggatcccccgggctgcaggaattcgtctcacccctagaaaaagtcgcggagccgccgcaacccagcgtcccccgaagtctaaccctagatccggaccggccatggcgtcccgccgggtcgtctcctcgctcctccgctccgcgtcccgcctgcgggcccgctcgcccgctgctccacgcccgcgcgcgccaccgaccgcccgtccccgggcgggtacctcttcaancngcgctgccngctacgctcttccgcgcggccnaggcngcacctgccaccccgcgcccggcaccgggaagacggggggcnggcagatcacggacgagttcacggcgctggcgcatccgccaggtgtgccaggtatcggcgcctcntaacctgccctcgagagggctccccccatctcacgggctgaggtgtcgacaacaactcggctcgtgctcgagtggggcagcacctggcgagaacatgggcccaacatccctatgacgggacggaggggttcttccgcggccagcgcttccctaaaaactggctccccccatcaccggtgcctgggggcaggggctaccctttgggaccccttattaaatgttttttggggaaaccccatt

SEQ ID NO: 54192 - protein, 90 aa, Zea mays
  misc_feature: Ceres CLONE 1478189-F
  misc_feature (42)..(42): Xaa is any aa, unknown, or other
  misc_feature (43)..(43): Xaa is any aa, unknown, or other
  misc_feature (46)..(46): Xaa is any aa, unknown, or other
  misc_feature (53)..(53): Xaa is any aa, unknown, or other
  misc_feature (55)..(55): Xaa is any aa, unknown, or other
  misc_feature (69)..(69): Xaa is any aa, unknown, or other
MASRRVVSSLLRSASRLRARSPAAPRPRAPPTARPRAGTSSXXAAXYALPRGXGXTCHPAPGTGKTGGXQITDEFTALAHPPGVPGIGAS

SEQ ID NO: 54193 - DNA, 648 bp, Zea mays
  misc_feature: Ceres CLONE 1478198-F
  misc_feature: Encodes the peptide sequence at SEQ ID NO. 54194
  misc_feature (414)..(414): n is a, c, t, g, unknown, or other
ctccccgcggtggcggccgctctagaactagtggatcccccgggctgcaggaattcgtctcacccctagaaaaacgctacgacgtctacaacgacctcggcaaccccgacgccaaaaacccgcgccccgtcctcggcggctccaagcaccacccctacccgcgccgcggccgcacgggccggaatccgacgcagacagaccccaacagcgagagcaggctgacgctgaccgacggcgacgtctacgtgccgcgcgacgagcgcttcggccacatcaagaactccgacttctacggctacaccatcaaggcgttcgtcgacggcctggtgcccatcctggaaggctacctcctcggcatcgagttcaactccttcaaggacatcctgcagctgtacgagggcgggatcaagctgnccgacatccccgccctcgagggagtcccgcagcagttcccgctacagatggtcaaggacctcatgccccgcggcggcgactacgtcctcaagctccccatgccccaaatcatcaaagaagacaagaaagcttggatgagtgacgaggagttcgcaagggagaccctcgccggcgtgaacccccttgatcatcaggcgtctcacggagttccctccgaaaaagcaccttgatccg

SEQ ID NO: 54194 - protein, 213 aa, Zea mays
  misc_feature: Ceres CLONE 1478198-F
  misc_feature: SWISSPROT Homolog: EC 1.13.11.12 Lipoxygenase
  misc_feature (138)..(138): Xaa is any aa, unknown, or other
PRGGGRSRTSGSPGLQEFVSPLEKRYDVYNDLGNPDAKNPRPVLGGSKHHPYPRRGRTGRNPTQTDPNSESRLTLTDGDVYVPRDERFGHIKNSDFYGYTIKAFVDGLVPILEGYLLGIEFNSFKDILQLYEGGIKLXDIPALEGVPQQFPLQMVKDLMPRGGDYVLKLPMPQIIKEDKKAWMSDEEFARETLAGVNPLDHQASHGVPSEKAP

SEQ ID NO: 54195 - DNA, 707 bp, Zea mays
  misc_feature: Ceres CLONE 1478206-F
  misc_feature (13)..(13): n is a, c, t, g, unknown, or other
  misc_feature (14)..(14): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (37)..(37): n is a, c, t, g, unknown, or other
  misc_feature (42)..(42): n is a, c, t, g, unknown, or other
  misc_feature (50)..(50): n is a, c, t, g, unknown, or other
  misc_feature (52)..(52): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (91)..(91): n is a, c, t, g, unknown, or other
  misc_feature (108)..(108): n is a, c, t, g, unknown, or other
  misc_feature (500)..(500): n is a, c, t, g, unknown, or other
ggcgagaaggggnnagggnnntttnnnnnnttnnngnttttngggggggncncacactggaggtcattttggaggaggttgaannngtcanaaagagggccccgggcngcagggattcctacaagggggagaaaaaaggggccttggcgctacccccgttcttatccccacctcgtgcctcccctcctccccccttcccctctctcgcccctcctccctccgtctcgtctcccaggtcatggcaaaagctggagcaccgggaaaaataacaagtgggagataaacaggaagagctaggtgaatacttggagaaaaaggtcccccacaccccccacgcaggtgaatactacaagtagcagtacaaggaagagatccaatctgcccgtgactgccagtgagttgctcgggtgtggtggttagttgaggtcacgatgatgggaggcgggctgatgatggatcagagcgtggtgttccctggcgtccacaacttcgtggatctncctgcagcagaacgggcgacaagaaccctgggctttccccctcacccaatggccgaaagaaattcccccccggggaaccaaagccctgtaataggggggaaaggggggaaaatctcgcggggaaaccccccccctgaaaaaaacaagttttccccccaaaaccccctggggcggggggaaaaaaaaccgtcggtatggacaaaaaac

SEQ ID NO: 54196 - DNA, 752 bp, Zea mays
  misc_feature: Ceres CLONE 1478209-F
  misc_feature: Encodes the peptide sequence at SEQ ID NO. 54197
  misc_feature (19)..(19): n is a, c, t, g, unknown, or other
  misc_feature (22)..(22): n is a, c, t, g, unknown, or other
  misc_feature (36)..(36): n is a, c, t, g, unknown, or other
gggtggggcgccccagccnccnaaaaaaaacattcnatagcggccccaccataaacgaggacccacccgggggcgggccgcatcttttgtagtgtatcccccgggctgcaggagttcctctcacccctagaaaaaaaaccaccacgaactggcgttcccctgccgagcccttcctcctcttcctcttcttctgaccccccgctggcttggaaaaagggagagaaaactcgcgcactcggttatcgaaagggaggagctcgggctagggtgaggtgtcgcccacacggagctgcgaggtgtttgtaggatctcctaggtgagcccctgctgcttggagacagccatggccaccggcgtggctccagctcctctcccacatgtcagagtgcgtcatgggggcgtcgggttcaccgggagcgtcgattttgaaaaggacttgtctgctcccggtgccggtacgatgacacccaccctcctctagaggcagggcgctcgtggcgaagagctctagtactgggctccgagaaccatggagctcgagccattcttcagaaggaagcccactttttgtacccaggcagaagtactgtggaatcaacacaccagtacatgggaggaaggaaaactccaaactgtacatcggtggggaaatggtgaccactttggggggtgaatcagtccccaataagggattccaaaaccattgggcgaaactttcataaataaccaaagggaatcgtttcccaaaaaaa

SEQ ID NO: 54197 - protein, 45 aa, Zea mays
  misc_feature: Ceres CLONE 1478209-F
MATGVAPAPLPHVRVRHGGVGFTGSVDFEKDLSAPGAGTMTPTLL

SEQ ID NO: 54198 - DNA, 714 bp, Zea mays
  misc_feature: Ceres CLONE 1478223-F
  misc_feature: Encodes the peptide sequence at SEQ ID NO. 54199
aaagctggagctccccgcggtggcggccgctctagaactagtggatcccccgggctgcaggaattcgtctcacccctagaaaaagatccctacacttgccagtactcttgacttggggactcattctgatgctcgtctgtgaaatatcccactaacaaatacatcagctgactctgtccaccgaaccagacgctagtgcgaatgcaggtgcctccccctttcccggcgtgcgtgccttgcgttggagatgcgggcgctgatcacgtactgcagcatgaccctcgcctatggccctgacgtctaccaacgacgtgctggtgctgcgttgctccacgtgctgatatgtgccgctgcacactgtgccctccagatgtactttcctcgttcgatgctgccgtttcttgcctttttgccccacccagcttgggatctcggcggaacctttcgaggaatcactaaggccgctgctatcggggcttcattccgtcaaggggatgtctttggaatccccccttacctaaacctctttaggggtttctttgggtggttgaaaattgcccccctaaaggggattttccctttgaaccttttttgacccgctccccgaaatacactgaaggtttttttttgtgaaattcaaattggttggggctttcccctttttccgcggaaataaatttccggtggtttttccagaaatatgggggccccaca

SEQ ID NO: 54199 - protein, 115 aa, Zea mays
  misc_feature: Ceres CLONE 1478223-F
MRALITYCSMTLAYGPDVYQRRAGAALLHVLICAAAHCALQMYFPRSMLPFLAFLPHPAWDLGGTFRGITKAAAIGASFRQGDVFGIPPYLNLFRGFFGWLKIAPLKGIFPLNLF

SEQ ID NO: 54200 - DNA, 652 bp, Zea mays
  misc_feature: Ceres CLONE 1478229-F
  misc_feature: Translation starting site: 325
  misc_feature: SWISSPROT Homolog: EC 3.2.1.21 Beta-glucosidase
  misc_feature (652)..(652): n is a, c, t, g, unknown, or other
ctccccgcggtggcggccgctctagaactagtggatcccccgggctgcaggaattcgtctcacccctagaaaaacacttcacaagcagctcaaagctctagttctagctagctagcaaagggggggaaaatggctccgcttctcgctgctgccatgaaccacgctgcagcccatcctggccttaggagccacctagtaggacccaacaatgagagtttctcacggcaccacctgccgtcttcttctccacagagcagcaagcgaaggtgtaaccttagctttactacacgatctgcaagagtaggcagccaaaatggagtccaaatgttgagcccctcggaatcccacaaagggactgggtcccctctgacttcaccttcggtgccgccacttcagcgtaccaaattgaaggtgcttggaatgaagatggaaagggggaaagcaactgggatcacttctgccaccatcatcccggaaagatactggacgggagcaattcggacgttggagcgaatccttaccatatgtacaaaaccgaactcagattgctccaaggaaatgggcatggacccctataggttctctatctcttggcccaaaatcctgccgaaggggaccaaagaaggaggttttaccccggatggcatcaatn

SEQ ID NO: 54201 - DNA, 718 bp, Zea mays
  misc_feature: Ceres CLONE 1478231-F
  misc_feature: Translation starting site: 146
  misc_feature (379)..(379): n is a, c, t, g, unknown, or other
  misc_feature (386)..(386): n is a, c, t, g, unknown, or other
  misc_feature (387)..(387): n is a, c, t, g, unknown, or other
  misc_feature (402)..(402): n is a, c, t, g, unknown, or other
  misc_feature (405)..(405): n is a, c, t, g, unknown, or other
  misc_feature (422)..(422): n is a, c, t, g, unknown, or other
  misc_feature (437)..(437): n is a, c, t, g, unknown, or other
  misc_feature (442)..(442): n is a, c, t, g, unknown, or other
  misc_feature (447)..(447): n is a, c, t, g, unknown, or other
ctggagctccccgcggtggcggccgctctagaactagtggatcccccgggctgcaggaattcgtctcacccctagaaaaaaaggaccaacgtgctcgatctccatctcgaccgtcgctcaccgggaagctacgctacgacgaagcatggcgtccgtcaccgcccgcgccccggtcgcagccctgcgcccgtcgtcgtcgtcggccttccttggccactctagccgcctcggccgcactgctaccgcgtcgccgacgaggcgcagcctcaaggcggaggccaagggcgagtggctcccgggccttccctcccccgcctacctcgacggcagcctgccgggtgacaatggcttcgaccccgttggcctgggcgaggacctngagaccnntgagtgtacgtgcangcngaagctgtgaaacggcngtgggcaatgctggncgtgnccggnatgctgatcccggagtgctgaccaggccggcctgatcaacgcccgcattggtacaaccccggcagtcgaagtattcccgtcgtcctccaaccgttttcgggaccaattcatcctggttccctaccggaaaatccggcgggggaagaatttaaaaccctggaggggttaaccggaacccctttttaaaaactacacctggccccccccaaatggggttacccgggggggttttaacaccgttaaatttccgcccccctttaggccaaggaag

SEQ ID NO: 54202 - DNA, 814 bp, Zea mays
  misc_feature: Ceres CLONE 1478237-F
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (531)..(531): n is a, c, t, g, unknown, or other
  misc_feature (652)..(652): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
cgcgtactggcttttcttcatcgctgttacaatattagggtagctcttagtggtttattttttgttgagcgccccccctagtcgggggtcccccgnnnnnnnngtttttttcccatactgggactccccgcggtggcggccgctctagaactagtggatcccccgggctgcaggaattcgtctcacccctagaaaaatctcaagtcttcacactcctcgccatcacataaaaccagtgcaagcagaagcagcgcaatggcgagcagcaccatggccctctcctcacagccttcgccggcaaggcagtgaacgtgccgtcgtctctcttcggcgaagtctgcgtgacgatgcccaagaacggcgggaagggaaagcccggcgggaaagttcccggaggcccggggtaaaggccccccaccgcggggctcctactggggcccccttttcccggggggcgcccccaaaaatctcttaagggggggaaaatctcccgggggggaaaacaagggggggggacaccccccggggggntttttttgcggggggaccccacgaaaaaccccccctcccccaaaaaaaacagggggttagccggaggggagggaaacaacacccccccccccccccctggggggaaacatatagggggganggnnngcgaggagggggcttctttgtgtctccccccccggagaggggtctcctccccccccccacaacagcggttctcattaatttattctctctacaaaaacccctctcccctttttgtttttttttttgtggggggggtaaaaatactctctccttcgcc

SEQ ID NO: 54203 - DNA, 761 bp, Zea mays
  misc_feature: Ceres CLONE 1478239-F
  misc_feature (281)..(281): n is a, c, t, g, unknown, or other
  misc_feature (298)..(298): n is a, c, t, g, unknown, or other
  misc_feature (326)..(326): n is a, c, t, g, unknown, or other
  misc_feature (327)..(327): n is a, c, t, g, unknown, or other
  misc_feature (341)..(341): n is a, c, t, g, unknown, or other
aaagctggagctccccgcggtggcggccgctctagaactagtggatcccccgggctgcaggaattcgtctcacccctagaaaaaagccctggagtctgacgacctcgtttccctgctgtctcgcctctctttcggttctcacggcgacgactgggcgagcgccgcctcccctccctcgctccgtgaggtcctcgccggcgacgagtgccgccgcccgtttccatgttttttccgccgattagtgtccaccagatctagtgcaggctggtaacttgacgcanggtgttcgagaaatttnagccacacactcttcatcataggcccanngcatatttgtgttnatctcagggacttccagtagatggctgagagttattcttgaatccgggggatattgaccccaaatttttttaaactttgatttttaaccccggggtgcaaggggctccaaacttggggggtctccggaccccccggaaagtgttaacccgaaggggttcaaaaaaaaccgggcccaattttgcccccctaaaaatttttgcgcccctaaaaagaagggcctttttggggcaccccgggggggtgtgtttttaaaaatccccccccccccacaaaaaaaaaaaatttttttttttttgaaatttttttttgggcccgccctttttaaagaggagaaattctccccccccgaaaagatattttttcctggagaaaaaaaaccccccccgaattttgttttttttcccccctacccccgcggg

SEQ ID NO: 54204 - DNA, 706 bp, Zea mays
  misc_feature: Ceres CLONE 1478244-F
  misc_feature: SWISSPROT Homolog: EC 1.2.1.12 Glyceraldehyde-3-phosphate dehydrogenase (phosphorylating)
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
aaagctggagctccccgcggtggcggccgctctagaactagtggatcccccgggctgcaggaattcgtctcacccctagaaaaaccgtccacctcagctcccatatccgctcccctacctctccagcatctcccgtctccgacgtctcgtctctgctactcagctcgtcgccagtcatgggctagatcaagatcggaatcaacggtttcagcaggatcctcaggctagtagccaaagtctgactgtagacgcagatgtccagctcgtcgtcgtcaacgaccccttcgtcaccagggatacctgtacttcatgttcaagtacaaccccgggtactgccattggaacagcgacaccatcccctgtaggaaacccagaacccttttttaccgggaaaaacccgggtccttttttgggtcccccaccccccaaaaaaccccccgaggcaggggggggttacatatttcggaagaaacccgggcttttcccagaaggaaaacgctctctccaaacttaaaaatgggggccaaaaaaaaatattcatctttccccaaaaaaaaaatgccccccgggtttatggttgtgggcgccccatgaggacagtaccctccgatgttcacttcgttccatgctagctgaaccacagatgcctgtcctgcagtagatgtaggtgaattcctcgccaagggctaaagagcaggnnnnnnng

SEQ ID NO: 54205 - DNA, 632 bp, Zea mays
  misc_feature: Ceres CLONE 1478257-F
  misc_feature: Encodes the peptide sequence at SEQ ID NO. 54206
  misc_feature (220)..(220): n is a, c, t, g, unknown, or other
  misc_feature (221)..(221): n is a, c, t, g, unknown, or other
  misc_feature (241)..(241): n is a, c, t, g, unknown, or other
  misc_feature (296)..(296): n is a, c, t, g, unknown, or other
  misc_feature (454)..(454): n is a, c, t, g, unknown, or other
  misc_feature (561)..(561): n is a, c, t, g, unknown, or other
ccccgcggtggcggccgctctagaactagtggatcccccgggctgcaggaattcgtctcacccctagaaaaagaaaattccttcggctccagttattacggaggattaggttggtgaactggtgactggagctggatcgcatttcttgctctttggtctctccagatcatcctccggcagccgttcttggaatcctcccgagattcgcttgcccgccctnnttcttttcagtggatctgancttgggagggaacccgatgcagccgcggtacggagaagcacgacaaccgctgccnggggcgtacgcgctgtaccactcggcaccagcggcgccgcgtcgccgccgcacccgcgtgacccatccgtcgatgttatcaagtcaggcttcaatgcagcttgctgggcaaagaggaacttagtgggatggtacttaaggcacagcacctacagtttncatattcacacttcttctgatgtaaaatcatttcctaagtatatgtgtattgggaaatatggtaggaaacaatatttacacaaaatggttaaagggaaggggactcngtccactctacctggggactttccacaagcgttgggcgaagagctgtttttctatggggggcctttcggtt

SEQ ID NO: 54206 - protein, 53 aa, Zea mays
  misc_feature: Ceres CLONE 1478257-F
MQPRYGEARQPLPGAYALYHSAPAAPRRRRTRVTHPSMLSSQASMQLAGQRGT

SEQ ID NO: 54207 - DNA, 745 bp, Zea mays
  misc_feature: Ceres CLONE 1478266-F
  misc_feature: Encodes the peptide sequence at SEQ ID NO. 54208
  misc_feature (318)..(318): n is a, c, t, g, unknown, or other
  misc_feature (411)..(411): n is a, c, t, g, unknown, or other
  misc_feature (416)..(416): n is a, c, t, g, unknown, or other
aagctggagctccccgcggtggcggccgctctagaactagtggatcccccgggctgcaggaattcgtctcacccctagaaaaagtcaactccggctcccgcgcgagatcgagctagcgtttggggttctcgagaccggctgccatggcgacagagcaagaggcggagaactacacggtggaggaccttgtggccctgaatccgtacaaccccgacatcctcaacgaccttgagaagttcgtcaacgagcaagttgcgtctcagacatataacttggatgcagatctcagccttcttcagctgtaccagtttgcagcangaaggatgagcatacatattgtggcccacatactgatcaagggtctcatggcatgcccgcccctgacttcgaccttgctaattctaattcctngaacngggccaatgaaaaacaaatcccgggcatggaaagtcttttcccaaacccaaaaacgggaagttctgggggttttgggataccccccacaaaaaccccccctattggaaaagctccccgttttttggggggggccccccccctaccactttgggtttttttttcgacacaaaaaaactcccggaatttttctttaaaagaaaaaaaaggaaggggcccctttgaaaaattttttaaaccacccccccaccccccttggggtaataaaaaggggcggccccccataaatattttctccccccagggaggacccccccccccccaaaagaga

SEQ ID NO: 54208 - protein, 155 aa, Zea mays
  misc_feature: Ceres CLONE 1478266-F
  misc_feature (59)..(59): Xaa is any aa, unknown, or other
  misc_feature (90)..(90): Xaa is any aa, unknown, or other
MATEQEAENYTVEDLVALNPYNPDILNDLEKFVNEQVASQTYNLDADLSLLQLYQFAAXRMSIHIVAHILIKGLMACPPLTSTLLILIPXTGPMKNKSRAWKVFSQTQKREVLGVLGYPPQKPPLLEKLPVFWGGPPPYHFGFFFRHKKTPGIFL

SEQ ID NO: 54209 - DNA, 717 bp, Zea mays
  misc_feature: Ceres CLONE 1478274-F
  misc_feature: Encodes the peptide sequence at SEQ ID NO. 54210
  misc_feature (373)..(373): n is a, c, t, g, unknown, or other
aagctggagctccccgcggtggcggccgctctagaactagtggatcccccgggctgcaggaattcgtctcacccctagaaaaaaatcttccattcctcctctctccttccctgtgtctctctcctcgcgagctcttcatcccttcttccagcgcggtttggcgatggcggcagcgcaggcgatctcgaaggggagcgtggtgtctccatgcggcaatcgagcggcgccgggcttccttgccaggcggaggggtgccgtggcggcgcggatggcaccgtcagcggcgcggatcgggggcttctggaggaagaacgcgtttcctggcgggaggctaaccctgaggacgaggagatccagggccgcgtcaccgacncacatgaacatgaaccttgcgcttgggaaatcgatgacgcgctgggagaaggggttgcagcccaccatgcgtgatatcgagtccgcccaagaccttgtcgatgctttgaccaacgcccgcgacaggatcgtcgtcttcgacttcttctctcctggctgcgggcgctggcgtgcctttcacccccagatttgtcattttgcggagcaaaatccagatgggccgttcttgccattgaaactatgaggagcaccacgtcttatgtgcctaaccctttccgtttccatttcctaaccccttgttttaaatttctaccgggggaagccccaggggaccgactttttttt

SEQ ID NO: 54210 - protein, 150 aa, Zea mays
  misc_feature: Ceres CLONE 1478274-F
MAAAQAISKGSVVSPCGNRAAPGFLARRRGAVAARMAPSAARIGGFWRKNAFPGGRLTLRTRRSRAASPTHMNMNLALGKSMTRWEKGLQPTMRDIESAQDLVDALTNARDRIVVFDFFSPGCGRWRAFHPQICHFAEQNPDGPFLPLKL

SEQ ID NO: 54211 - DNA, 690 bp, Zea mays
  misc_feature: Ceres CLONE 1478276-F
  misc_feature: Encodes the peptide sequence at SEQ ID NO. 54212
  misc_feature (690)..(690): n is a, c, t, g, unknown, or other
aaagctggagctccccgcggtggcggccgctctagaactagtggatcccccgggctgcaggaattcgtctcacccctagaaaaaaatcgcagccagcagcctcatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgagggcgccggctccgcggggctgtcctgcgcgtacgagctctccaaggaccccgccgtgagcatcgccatcgtggagcagtcggtgtcgccgggcggcggcgcgtggctgggcgggcagctgttctcggccatggtggtgcgcaagccggcgcacctgttcctggacgagctgtgcgtggcgtactacgaggccgaggactacgtggtcatcaagcacgccgcgctcttn

SEQ ID NO: 54212 - protein, 170 aa, Zea mays
  misc_feature: Ceres CLONE 1478276-F
  misc_feature (64)..(171): Pfam Name: Thi4 Pfam Description: Thi4 family
MATAAASSLLKSSFAGSRLPAATRTTPASLVVATGPRGAGAGPICASMSMSSSNPPYDLTSFRFSPIKESIVSREMTRRYMTDMITYADTDVVIEGAGSAGLSCAYELSKDPAVSIAIVEQSVSPGGGAWLGGQLFSAMVVRKPAHLFLDELCVAYYEAEDYVVIKHAAL

SEQ ID NO: 54213 - DNA, 747 bp, Zea mays
  misc_feature: Ceres CLONE 1478294-F
  misc_feature: Encodes the peptide sequence at SEQ ID NO. 54214
  misc_feature (389)..(389): n is a, c, t, g, unknown, or other
aaagctggagctccccgcggtggcggccgctctagaactagtggatcccccgggctgcaggaattcgtctcacccctagaaaaacttccctcccaattcaaggcggtccggaagctcctgcagccttccggaagggcttcgaggccgaggcgggcacgggatgtgggggcggcactactggggcggcggccggcgcccaagctgggcgcccggaggggacggagccggcaccggcggcgtggtggtgatgttcgcgtggctgtccagccaagagcggcacgtgcgggcgtacgtcgagctgtacgccgcgcacgggtgggcgtgcctcgtctgccactacgacttcctcaccctgttttttcctgagaaggctgccatgctcgccgacngggtgactgggggagcttgttcacgcgcctaaagattacccgtggacctgtttgggtctgccccattttccgggggggccaaaggggggcaattccagggtttttcgcctgattcaaaaaaaaatgttaaggggaaccaaaaatggggtggatcccccttcgaaaaaaattgtctttgcgccacaaattgtaaaaaaaacccccggggattttttttagaaaatatggggaataaattttccccccaaaaaaagggggcggagaaaattttaaaaacccccccggggtgtgtggggggaagaaaaacgggggcgccccccggggggggggggttttttttttaaaaaatattttagag

SEQ ID NO: 54214 - protein, 86 aa, Zea mays
  misc_feature: Ceres CLONE 1478294-F
  misc_feature (77)..(77): Xaa is any aa, unknown, or other
MWGRHYWGGGRRPSWAPGGDGAGTGGVVVMFAWLSSQERHVRAYVELYAAHGWACLVCHYDFLTLFFPEKAAMLADXVTGGACSRA

SEQ ID NO: 54215 - DNA, 733 bp, Zea mays
  misc_feature: Ceres CLONE 1478303-F
  misc_feature: Translation starting site: 253
  misc_feature: Pfam Name: Peptidase_M16_C Pfam Description: Peptidase M16 inactive domain
aagctggagctccccgcggtggcggccgctctagaactagtggatcccccgggctgcaggaattcgtctcacccctagaaaaaaacctgataacataaagggacgtgtatcccaacacgcactttcccctgataacacatatggtgttgatagtggtggggacccaaatgaaatcccaaaacttacttttgaacaattcaaggagttccatcacaagtattatcatccaagcaatgctaggatactggttctatggagatgatgacccaccaagagcgtctgcacattctaagtgaataccttgaccaatttgaagcacaccctgctcctaatgcatcaaaggtttggccacctaggctattagaggaagttgtgacccaacgacataagtaccctgctggtccataacccccctctacaaagaaatatatggtgtgcatcaattggcttatgctcataagagccattagatgtaaaaactgaccttgcactagagtaccctggacccaacattggttggggaacttcccagcttcaccacttcacaatgattcctcttcgaaaatggcttaagtagaaaccaattgtggcaaattggtcccaaagaaagagcttcttttaccccctcctttaccctttggcctgaaaaggtgggattcaaagtattatattttgtaaaaatttagaaaagtgtgggccatgctaagcttttcaacctatattttgtcagaag

SEQ ID NO: 54216 - DNA, 695 bp, Zea mays
  misc_feature: Ceres CLONE 1478306-F
  misc_feature: Translation starting site: 168
  misc_feature: SWISSPROT Homolog: EC 3.4.22.16 Cathepsin H
aagctggagctccccgcggtggcggccgctctagaactagtggatcccccgggctgcaggaattcgtctcacccctagaaaaagctcgtgccagcgcccagcaggccattctgctcgccttactccctcacagaacccagtaaaatattgccagtcccgccgtcgagatggccccacgccgcctgctcgtcctcgccgtcctcgccctcgcggccaccgccgccgcggccaactccggcttcgcggactccaacccgatccgccctgtcaccgaccgcgcggcctccgcgctcgagtccacggtcttcgccgcgctcggccgcacccgcgacgcgcttcgcttcgcacgcttcgccgtcaggtacggcaagagctacgagagcgcggcggaggtccataagcggttcaggatcttctccgagagcctccagctggtccgctccaccaaccgcaaaggcctctcctaccgcctcggcatcaaccgcttcgcggacatgagctgggaggagttccgtgcgacccggctcggcgcagcccagaactgctccgccacgcttaccggcaaccaccggatgcgcgccgccgccgttgcgctgccggagacgaaagactggagggaggatgggattgtgagcccagtgaaaaaccaggccactgtggatcatgctggaccttcagcactactggtgcacttg

SEQ ID NO: 54217 - DNA, 687 bp, Zea mays
  misc_feature: Ceres CLONE 1478311-F
  misc_feature: Encodes the peptide sequence at SEQ ID NO. 54218
aaactggagctccccgcggtggcggccgctctagaactagtggatcccccgggctgcaggaattcgtctcacccctagaaaaaatcaccacatagacataaccacacgccttcccgttgtccagttgctcagcctgccggcgccgccactgcaaagtccgtacacacagacacacaacgcacgtcaccgccatgtctgccgccactgcttgcatgcccctggtccttgatccgtctcctctccatggatcggcggcaatggcagatgccgttgagaggcggcagcccggtgccatggagaccaccaagactggttccgagggaacgctcggccgcgtcgtcaggagccaagtgtttggcaacgaggacgacgaccgtgctgggcacgacgccggcgacggcgacgaggtgagcaagccgcgggcggtggtccacacactgacgtgcgagcgcaagccattgttcgagggcttcgcgctgtggcggagcatcggcaggcctgagcttcccgaactggatccaatcttatcgttcgacgaattcgagttttctgctccagctggcttccttgaccatcctcacaggggatttgagaacgttacctatatgctcgagggcggcatcagttaccacgacttttcaggccacaagggaaccatcaacccaggagacgttcagtggctgacgg

SEQ ID NO: 54218 - protein, 165 aa, Zea mays
  misc_feature: Ceres CLONE 1478311-F
  misc_feature (93)..(165): Pfam Name: Pirin Pfam Description: Pirin
MSAATACMPLVLDPSPLHGSAAMADAVERRQPGAMETTKTGSEGTLGRVVRSQVFGNEDDDRAGHDAGDGDEVSKPRAVVHTLTCERKPLFEGFALWRSIGRPELPELDPILSFDEFEFSAPAGFLDHPHRGFENVTYMLEGGISYHDFSGHKGTINPGDVQWLT

SEQ ID NO: 54219 - DNA, 674 bp, Zea mays
  misc_feature: Ceres CLONE 1478317-F
  misc_feature: Encodes the peptide sequence at SEQ ID NO. 54220
aagctggagctccccgcggtggcggccgctctagaactagtggatcccccgggctgcaggaattcgtctcacccctagaaaaaccccctagaaaaacaacgcggcacagagcctcattcatctccattcgaaacaccctcgcacccacactctcccttcgtccccagcctaaatccccgcaacgatggctcgcacgaagcagacggcgcgcaagtccacgggcggcaaggccccgaggaagcagctggcgaccaaggcggcgcgcaagtcggcccctgcgaccggcggcgtgaagaagccgcaccgcttccgcccgggcaccgtggcgctgcgcgagatccgcaagtaccagaagagcacggagctgctcatccgcaagctgcccttccagcgcctggtccgcgagatcgcgcaggacttcaagaccgacctccgcttccagtcctccgccgtcgccgcgctgcaggaggccgccgaagcttacctcgtcggcctgttcgaggacaccaacctctgcgccatccacgccaagcgcgtcaccatcatgcccaaagacatccagctcgcccgccgcatccgcggggagcgcgcctaggcggccggcccggcggataggccgtggcgcattctcttctcggaagttgtactaatggtcgggtcttgtggagggagtg

SEQ ID NO: 54220 - protein, 136 aa, Zea mays; identical to SEQ ID NO: 6923
  misc_feature: Ceres CLONE 1478317-F
  misc_feature (58)..(132): Pfam Name: Histone Pfam Description: Core histone H2A/H2B/H3/H4

SEQ ID NO: 54221 - DNA, 697 bp, Zea mays
  misc_feature: Ceres CLONE 1478325-F
  misc_feature: Encodes the peptide sequence at SEQ ID NO. 54222
aaagctggagctccccgcggtggcggccgctctagaactagtggatcccccgggctgcaggaattcgtctcacccctagaaaaaaacccactcatcactcctcactcactcactcaaaacgaaagccagctcagctcagctctgctcagctcatctgctcacacctcacacccacaggccggccgccacagcaccgcggatagcagagcggcagctaggtcggtcgtcgtcgtcgtcgtcagccatgagcaaggacaagcaccacaagcacgagcaccacctgcggcgttgctgcgggtgcatggcgtcgtgcctcctggcgctggtcctcatcgtggccttcatctcgctggtggtgtacctggcgctgcgcccctcgaagccgtccttctacctgcaggacctgcagctgcccacgcccatctcgctgggcgacccgtcgctgacggcgtcggcgcaggtgacgctggcctcccgcaaccccaacgaccgcgggggcatcttctacaagcgcctggacgtgttcgccacctaccgcaacaaggccctgaacggggcccctggtctcttccccccgcagaaccaggggcccccgcgaacttccaccgtctgggcccccccgggctgtcagaccgaagccagtgccccgttggcccccttactttcgtccaaagcccatgaaaacagggacagtccc

SEQ ID NO: 54222 - protein, 151 aa, Zea mays
  misc_feature: Ceres CLONE 1478325-F
  misc_feature (39)..(151): Pfam Name: Hin1 Pfam Description: Harpin-induced protein 1 (Hin1)
MSKDKHHKHEHHLRRCCGCMASCLLALVLIVAFISLVVYLALRPSKPSFYLQDLQLPTPISLGDPSLTASAQVTLASRNPNDRGGIFYKRLDVFATYRNKALNGAPGLFPPQNQGPPRTSTVWAPPGCQTEASAPLAPLLSSKAHENRDSP

SEQ ID NO: 54223 - DNA, 659 bp, Zea mays
  misc_feature: Ceres CLONE 1478357-F
  misc_feature: Encodes the peptide sequence at SEQ ID NO. 54224
  misc_feature (557)..(557): n is a, c, t, g, unknown, or other
  misc_feature (578)..(578): n is a, c, t, g, unknown, or other
  misc_feature (594)..(594): n is a, c, t, g, unknown, or other
  misc_feature (623)..(623): n is a, c, t, g, unknown, or other
aaagctggagctccccgcggtggcggccgctctagaactagtggatcccccgggctgcaggaattcgtctcacccctagaaaaagtgctctctcagaggtgggctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcngctgctaccgaggccgtggcngctacggctgtcggcncaagggtggtggtggctgctactgcggcngcggcggcggctgtagggactgatgtgtgggcccat

SEQ ID NO: 54224 - protein, 157 aa, Zea mays
  misc_feature: Ceres CLONE 1478357-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (129)..(129): Xaa is any aa, unknown, or other
  misc_feature (136)..(136): Xaa is any aa, unknown, or other
  misc_feature (141)..(141): Xaa is any aa, unknown, or other
  misc_feature (151)..(151): Xaa is any aa, unknown, or other
MAAADVEYRCFVGGLAWATSNESLENAFASYGEILDSKVITDRETGRSRGFGFVTFSSENSMLDAIENMNGKELDGRNITVNQAQSRGGGGGGGGYGGGRGGGGYGGGRRDGGYGGGGGYGGRREGGGXCYRGRGXYGCRXKGGGGCYCGXGGGCRD

SEQ ID NO: 54225 - DNA, 682 bp, Zea mays
  misc_feature: Ceres CLONE 1478369-F
  misc_feature (511)..(511): n is a, c, t, g, unknown, or other
ctggagctccccgcggtggcggccgctctagaactagtggatcccccgggctgcaggaattcgtctcacccctagaaaaaaaaaaaaaaaaaaacgccggctagaccatgaaaagatcttgaatgaatagaatgatctgaaaaaagagataagacctcacggagaaaaagaaagaggagctcggacaaggcagcgccttcgttcggtttctttgctgaattccggatcggtcgcccggtcaaaaagaaaaaagctagcttttagcagggcgtctctggcgttcggcagcaccgtaccggcggccgtgtgcggcaaacctcggggaagcacacagggcctgcacgccgggtcccgtgtttggttttggccgcccactttccaaataggggggggcccgggcccccgccaagggagaaaaaaagggccctggaaaaaccttttttggggtttttttttaaaaaaaacacatttgggggaaaaaaaacccccccccccaaaaagggtggggggnccggaaaaggggccccccctctcccgggcccaaaaaaaaccccccgcgaaaaaaagggtgtcgggggggaaaaaaaacacggggggggggggggggggggttttaccccccccgggggccccgcggggggttttttcccccccaaaaaaaaaaacaatataataaaggggt

SEQ ID NO: 54226 - DNA, 677 bp, Zea mays
  misc_feature: Ceres CLONE 1478372-F
  misc_feature: Encodes the peptide sequence at SEQ ID NO. 54227
  misc_feature (452)..(452): n is a, c, t, g, unknown, or other
aaagctggagctccccgcggtggcggccgctctagaactagtggatcccccgggctgcaggaattcgtctcacccctagaaaaaaacggaacttagctgccgagcgcccaaagccccaccgccgctcccatcaagcggcgctaaaggtttcctcgcccgcaacgcgatgccgaagaacaaggaaaaggaaggcaagaaccggacgcggggcaagaacgaggcggacgacgagaagcgggagctggtgttcaaggaggacgggcacgagtacgcgcacgtgacgcagatgctggtgaacggccgctgcgaggcgatctgcatcgacgggaccaagcgcctctgccacatccggggcaagatgcacaagaaggtgtggatcgccgcacgggacatcgtgctcttcggcctgcgcgactaccagaacgacaatgcggacgtcatccatcagtacntgaactacgacgccccccctgctcaagggctaccgctgagatccccgacaacgttcgggctcaacaaggggcgtcattgatgagagaggatgccgggacccaggatgactatcttccggtccagggacaagaacatccaccaaatctgaatgtaccccttcttccaacgggccccttttccgtgggaaacaaaaagtggggcaaaacaaggggaccccttctggt

SEQ ID NO: 54227 - protein, 121 aa, Zea mays
  misc_feature: Ceres CLONE 1478372-F
  misc_feature (30)..(94): Pfam Name: eIF-1a Pfam Description: Translation initiation factor 1A / IF-1
  misc_feature (96)..(96): Xaa is any aa, unknown, or other
MPKNKEKEGKNRTRGKNEADDEKRELVFKEDGHEYAHVTQMLVNGRCEAICIDGTKRLCHIRGKMHKKVWIAARDIVLFGLRDYQNDNADVIHQYXNYDAPPAQGLPLRSPTTFGLNKGRH

SEQ ID NO: 54228 - DNA, 750 bp, Zea mays
  misc_feature: Ceres CLONE 1478383-F
  misc_feature: Encodes the peptide sequence at SEQ ID NO. 54229
aaactggagctccccgcggtggcggccgctctagaactagtggatcccccgggctgcaggaattcgtctcacccctagaaaaatcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggggaacctcaagtacgtgcgcgtcgggtaccactacctcatcaggcaaggggggtgaacctggccaccatccccgccatcgtggtgggggcccccccccccacactgggcagcctcaccccccaaccaccttgggcccaagggggggggggagaggcccctacgacctcgccaccgggggccgctttccccggccgtctcggctatcaccatacccgggttaaattatgggcaagggcccgggcccggggacccccacccaactttccaaggttcaaaacccggccaaaaaaatctctaggtgtccccaagcggggattccttcaacccgggcgccccactttccggcaatttttcacaaaagaagcccggggggttccactatccgctttttggggaacaaattctgcgcctagtggaaaaa

SEQ ID NO: 54229 - protein, 62 aa, Zea mays
  misc_feature: Ceres CLONE 1478383-F
  misc_feature: SWISSPROT Homolog: EC 2.3.1.119 Icosanoyl-CoA synthase
MAREEQALLSTEIVNRGVEPSGPDAGSPAFSVRVRRRLPDFLQSGNLKYVRVGYHYLIRQGG

SEQ ID NO: 54230 - DNA, 655 bp, Zea mays
  misc_feature: Ceres CLONE 1478386-F
  misc_feature: Encodes the peptide sequence at SEQ ID NO. 54231
atagctggagctccccgcggtggcggccgctctagaactagtggatcccccgggctgcaggaattcgtctcacccctagaaaaaagtgtcggtgcgcgttgtgctctgtgtctctattcgttctccgcctcagcccgagccagccagtgtacgctagggtttagccgccgccgatcggcgccgccgccgctatgcctgcaccagtcattcacgaaggtctgccctgcttccagctacccgtgctgctccagtgaggaaccggccacaggctggacgccacgatgctcctccagctgctgttcgagatggtggcggatccctggtaggagaaattgcctcaaccatagctcaaggtatgggggctggaccacgtatagctatggcacttaggggaggagaagcggttctacgtgccctgatcatgccgcgtgagactgtgctctccatgctgctgctggtgctcctgggcctccagtgatgaatgctaacgattgtcctctccattctcagggtctccaagattgtgtcagctactatggcctgcagatcagcaagcgcacgttctacctagacatgctgaagaagatgacgctcctgatattgtacctacctatactgcgtctggggctattcgtcgtatgccatctcatggatg

SEQ ID NO: 54231 - protein, 59 aa, Zea mays
  misc_feature: Ceres CLONE 1478386-F
MNANDCPLHSQGLQDCVSYYGLQISKRTFYLDMLKKMTLLILYLPILRLGLFVVCHLMD

SEQ ID NO: 54232 - DNA, 676 bp, Zea mays
  misc_feature: Ceres CLONE 1478392-F
  misc_feature: Encodes the peptide sequence at SEQ ID NO. 54233
ctggagctccccgcggtggcggccgctctagaactagtggatcccccgggctgcaggaattcgtctcacccctagaaaaaagccacgaaccgcccctcagtccctcacccttgagtccacacgctctggcgcacgcgcacggcgcacaccatggccgctgccttagcttcgcttctccacctcgcgaccccgacccagactcgctccactcacctcgccgtccgcctccccagcgcccagctgccgcgctggccgtcgggatcacgcatcgccgccgcgcagccgccgcgggcgtacaaggtgacgatcgagcactgcggctagtcgcgtgtggtgcaggcggaggaggacgagactatcctgtcccgcgcgctggacgagggcctggacgtgccgcacgactgcaagctcggcgtgtgcatgacgtgcccggcgcggctggtctccgggacggtggaccagagcgacggcatgctcagtgacgacgtcgtcgcgcgcgggtacgcgctgctatgcgccgcgtacccgcgctccgactgcaccatccgcgtcatccccgaggacgagctgctcaaagtccagctcgccaccgccgacgactgacgccccgccgatgacctgcaggcatcaacctcgggctgtgaaatgatgctgcgcctgggacttgacaccattg

SEQ ID NO: 54233 - protein, 60 aa, Zea mays
  misc_feature: Ceres CLONE 1478392-F
MTCPARLVSGTVDQSDGMLSDDVVARGYALLCAAYPRSDCTIRVIPEDELLKVQLATADD

SEQ ID NO: 54234 - DNA, 658 bp, Zea mays; identical to SEQ ID NO: 53999
  misc_feature: Ceres CLONE 1478394-F

SEQ ID NO: 54235 - DNA, 695 bp, Zea mays
  misc_feature: Ceres CLONE 1478396-F
  misc_feature: Encodes the peptide sequence at SEQ ID NO. 54236
  misc_feature (695)..(695): n is a, c, t, g, unknown, or other
agagctggagctccccgcggtggcggccgctctagaactagtggatcccccgggctgcaggaattcgtctcacccctagaaaaaagcctttgccgagcggcaggacgacgaagcggaggagttgctgtgcggggtgaaggaagaggagtcggctcaggtacaagaaccggccaagaatccggcaggacgtcccaccccactaccccaggggtcgaaacagcggccggccccggccttacttgacctcggcagcactgggttaattccacggagccacgttttctacaagtttcgtgattggtggtgtggggttgatgaacaaaggacttgaagcattactcatccggtcagacgtgtttcgtagaccttgacgctgagctatcggagttgggtttccaaaaaaaggtggagctctgacacagttccgcattcttctaaaggaagtaggagatacccaggaagcagcatggcattttcttacagcaatgggaggacattgcccctcgaatgggaggatgcagagaggtggatcttcagtctcaattccagcgacatgcgtgggagaactacggttgctcatggtcggaagccaaagtctaaaagtggccccctggggcctcccaggagacttggtggacagtaatcatctgtttcttcggtgccattgcttgatagggagaaagttggacctattn

SEQ ID NO: 54236 - protein, 58 aa, Zea mays
  misc_feature: Ceres CLONE 1478396-F
MAFSYSNGRTLPLEWEDAERWIFSLNSSDMRGRTTVAHGRKPKSKSGPLGPPRRLGGQ

SEQ ID NO: 54237 - DNA, 652 bp, Zea mays
  misc_feature: Ceres CLONE 1478403-F
  misc_feature: Translation starting site: 192
aaagctggagctccccgcggtggcggccgctctagaactagtggatcccccgggctgcaggaattcgtctcacccctagaaaaacgagcgaacgatccagaagcagaagccaccgatcggcgtgccgcgtgcgtgaggcgatcggagcatcccgtcccgaggaggaagacaaccggcgacgcggggggaacatggggaagacgccggtgcggatgaaggcggtcgtgtacgcgctgtcgcccttccagcagaaggtaatgccggggctgtggaaggacatcaccagccaagatccaccacaaggtcaccgagaactggatctccgccacgctcctcctcacccccgtcgtcggcacctaccaatacgccatgtggtacaaggagcaggagaagctttcccacagatattaaatgcgctgcccttgacagacagcactcggagttttcatgatgggtttcataatcctcccatgatgatttaacatttgtttgatcaatttcagttcaacgccttttcatcgttccatatgcatatatggtatccgtgtctggcaaacttattttgaggcttgctaaatatgtaccttttgtctctgaagttgttaaataaagcaaattaacttccagtttctcgtgtttgtgtttaagaatg

SEQ ID NO: 54238 - DNA, 704 bp, Zea mays
  misc_feature: Ceres CLONE 1478410-F
  misc_feature: Encodes the peptide sequence at SEQ ID NO. 54239
cagagctggagctccccgcggtggcggccgctctagaactagtggatcccccgggctgcaggaattcgtctcacccctagaaaaagattcagtttcttgaccagacttccatgccatttaataccgcaggataatatcagtagtacaccagtatgataaagcactaaatgaacactggttttgtaacatcctttaggtcttcatttataatgatgttcttttgagtggtctagacaaacataattccaaagtaccgagttttgacattatattctttaaaagtctatttttttccaatgtaaaataccgaggttactacaagtccatttcgtctctaggtccttgtaggggatggaatttgatggtaagaagtttctcaatgggcaactttttgtttgagtttctatcagacatctcatcttcgtctgtgttcttgggcgtacgcggacacagccccgatccgaatcgtcctcctcgcgagcctcgtcgatcccccactcccctcccctcgcttcaagatgcagatctttgtgaagaccctcaccggcaagactatcaccctcgaggtggagtcttctgacaccattgacaatgttcaggctaagatccaggacaaggagggcatccctcctgaccagcagcggcttatcttccccggcaagcagcttgaggacgggcgcacaactgctgactacaacatccag

SEQ ID NO: 54239 - protein, 62 aa, Zea mays
  misc_feature: Ceres CLONE 1478410-F
  misc_feature (6)..(62): Pfam Name: ubiquitin Pfam Description: Ubiquitin family
MQIFVKTLTGKTITLEVESSDTIDNVQAKIQDKEGIPPDQQRLIFPGKQLEDGRTTADYNIQ

SEQ ID NO: 54240 - DNA, 692 bp, Zea mays
  misc_feature: Ceres CLONE 1478411-F
  misc_feature: Encodes the peptide sequence at SEQ ID NO. 54241
  misc_feature (460)..(460): n is a, c, t, g, unknown, or other
  misc_feature (461)..(461): n is a, c, t, g, unknown, or other
  misc_feature (478)..(478): n is a, c, t, g, unknown, or other
  misc_feature (479)..(479): n is a, c, t, g, unknown, or other
aaagctggagctccccgcggtggcggccgctctagaactagtggatcccccgggctgcaggaattcgtctcacccctagaaaaagcatcgacactcgccgcgcaccaccaccaccgctgcggctcacggctacgcagcccgctctcccgacccccccgtgccctcctctttttgctactagcacatagagtttcgcccgaatcgatcgccgactgactccgctagggttcggcccgatcgccgcttcgtcctcccggctcccgcggggaccccgccgagatgtctgactggagctcgccggctgcgccgacgttcttcccttttggcccgcaggccgaggggtgggacgtcaccttcaaggtcagatatggtgatacacttaaaaggttttatggttgtgccaatgggagtcattttgacatgaatttatctgctctacgggcgaggattgatactgccnnttagtttggtcctgacnngtgactttgtctgacttacaccgatgaggatggtgatattgtcatgctagatgatgatgatgacttgcgtgatgcagctctcccgtcgagattaaaccctctcaagattactggtccacttgaggaaaatcaccaacctgaaaaaaaggtactttctgcccacatggaattccgctgctcaggaaccatatccccgttaaaggtcccttatga

SEQ ID NO: 54241 - protein, 60 aa, Zea mays
  misc_feature: Ceres CLONE 1478411-F
MSDWSSPAAPTFFPFGPQAEGWDVTFKVRYGDTLKRFYGCANGSHFDMNLSALRARIDTA

SEQ ID NO: 54242 - DNA, 686 bp, Zea mays
  misc_feature: Ceres CLONE 1478416-F
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (379)..(379): n is a, c, t, g, unknown, or other
  misc_feature (380)..(380): n is a, c, t, g, unknown, or other
  misc_feature (457)..(457): n is a, c, t, g, unknown, or other
aaagctggagctccccgcggtggcggccgctctagaactagtggatcccccgggctgcaggaattcgtctcacccctagaaaaaaccgccgaacgatggccgcctctcgccgcctcgcgcggaagctgccgtctctgatctcccggtatgagcgcctcatctccccggagactgacgcgcctgaactcaccgaagcccccaccacctccgcatccatcccgctcgacccctcactccctgtccttccgctcgccgtctcccacctctcgccgcctaacccgcttcccggggctcccctccgctcacgctttctcccccgcctctctttttcgtctcctccggcgaggccgggagagccccccacccgcgggcnnnnaannttaaaattttgttgggcgccccccaacccgttcttccctttttccaaccaaaccaggggggtcacgtcccctctttncccgcccccctgcgggggtttccccccccctcccttttttttccagggcttctggaggtttgttttttacccccccccttgcctctggtgcaaaaaaaccccttttttgttggccccaggtccttccccccctttccccagggggcattttgggcccttcccccccccccggggaaaaacccccctccgaaaaaaaaggacctcccctctcttctcgggggggtggtgg

SEQ ID NO: 54243 - DNA, 607 bp, Zea mays
  misc_feature: Ceres CLONE 1478417-F
  misc_feature: Encodes the peptide sequence at SEQ ID NO. 54244
  misc_feature (315)..(315): n is a, c, t, g, unknown, or other
aagctggagctccccgcggtggcggccgctctagaactagtggatcccccgggctgcaggaattcgtctcacccctagaaaaagtggttgcgccatccctcactctcctccgaagccatcgtccacgtcccagcctccccggactctaggggcagaagctgcagcgtctagatggtgaaggggcgcacggggcagcgcgtgaggctctacgtccggggcaccgtccttggatacaagcggtccaagtcgaaccagtacgagactacgtcgctggtgcagatcgacgggggtgaacaccaaaggagggaccgtcgncgtggggtactgcggggaaaagcggatgggcctacattcttccaaggccaaagaacaaaaaagcaggggggccccccctttcccggtttctttttgggggaaaagggtgcgccccccccccccaattgggaaaaacccccggggggtgttttccccccccccccaaaagtttttgggggggtccaacaaccccccggccccccccgaaaaaaacctctttgggggggcccccccaaaaaagaaggccccggggggggtgggtttttttttttttatttccccccccccccca

SEQ ID NO: 54244 - protein, 145 aa, Zea mays
  misc_feature: Ceres CLONE 1478417-F
MVKGRTGQRVRLYVRGTVLGYKRSKSNQYETTSLVQIDGGEHQRRDRRRGVLRGKADGPTFFQGQRTKKQGGPPFPGFFLGEKGAPPPPNWEKPPGGVFPPPPKVFGGVQQPPGPPRKKPLWGGPPKKEGPGGGGFFFFYFPPPP

SEQ ID NO: 54245 - DNA, 723 bp, Zea mays
  misc_feature: Ceres CLONE 1478420-F
  misc_feature: SWISSPROT Homolog: EC 2.7.11.1 Non-specific serine/threonine protein kinase
aaagctggagctccccgcggtggcggccgctctagaactagtggatcccccgggctgcaggaattcgtctcacccctagaaaaaaccacttccaatccactccccgcgttcgcctcgccgagctgttcttgctctgtcctctctccaactccacgatttgttccacacccggttcccgagcctccgcagcgcttcttgctgaaaaagggaactccgagttctccagctctggatcggcagagagcggtggttccttttgcggactctgaggtccagttcttgtttttgatttgtctcatcaacccaccagtcgggctgcaggcttagagctggaaggaataatttgactagagaaatggggcagtgttgcagcagagctaccgccccggactctggacgggggagtgccaatggtcaccgctattctaacccaggaaagcccgccccaagcacctcccattaacaccctcctcaacagggcgccggaggtgagggacaaccattgggggacaaattttcgggagtcccacccctggctgggccgcccaaaaccaacggggaacaaaattctttggaaaaaataaaaggaaggggcctctttttacccccccggaaaaggactttggccggggcccctttttgggggaaacaccctttcgcccaaaaattccctctggggggagaaaacccctggaaattttttctcaagggaaagtttgcggg

SEQ ID NO: 54246 - DNA, 680 bp, Zea mays
  misc_feature: Ceres CLONE 1478429-F
  misc_feature: Encodes the peptide sequence at SEQ ID NO. 54247
  misc_feature (636)..(636): n is a, c, t, g, unknown, or other
  misc_feature (641)..(641): n is a, c, t, g, unknown, or other
aaagctggagctccccgcggtggcggccgctctagaactagtggatcccccgggctgcaggaattcgtctcacccctagaaaaaaacaccaatccactactcggctgacgtcatcaaagcattgaagtgactctccagtctccactctccagcacctgcacggctgcacccggccgcacaacccgacggagccgccgcaccagctcacacgcccacgcgtccgcgatccagggcgcgtgccatgcatggcggcatgcgcgcggcgcctacttctctgagttctctccaccccgagtccggaccctgcgctgcactgacgctacattcctaccctcgcgtcgctggactctaatagcgcgacacgcgagaggcaatggctgtgcggaggtgcctcctgctgctcgtgttagtgtcggctgcggccgcgccttgctcggagaagggggagtgggactccgtgattcgcatgcctggagagaaggagcctgcagggtctcactcgcacagcgtcgagggattcgatagcgaggtggatgacgccgtcgggacgaggtgggcagtgctcgttgccgggtcctcaagctacggcaactacaggcaccaggctgatatatgtcatgcgtaccagatactgcnaaaangaggcatataagaggagaacattgtcgtgtttatataaa

SEQ ID NO: 54247 - protein, 92 aa, Zea mays
  misc_feature: Ceres CLONE 1478429-F
  misc_feature: SWISSPROT Homolog: EC 3.4.22.34 Legumain
  misc_feature (88)..(88): Xaa is any aa, unknown, or other
  misc_feature (90)..(90): Xaa is any aa, unknown, or other
MAVRRCLLLLVLVSAAAAPCSEKGEWDSVIRMPGEKEPAGSHSHSVEGFDSEVDDAVGTRWAVLVAGSSSYGNYRHQADICHAYQILXKXGI

SEQ ID NO: 54248 - DNA, 649 bp, Zea mays
  misc_feature: Ceres CLONE 1478432-F
  misc_feature: Encodes the peptide sequence at SEQ ID NO. 54249
  misc_feature (53)..(53): n is a, c, t, g, unknown, or other
  misc_feature (62)..(62): n is a, c, t, g, unknown, or other
  misc_feature (82)..(82): n is a, c, t, g, unknown, or other
aaagctggagctccaccgcggtggcggccgctctagaactagtggatcccccngggctgcanggaaattcgtctcacccctnagaaaaaaaaaaaaacacacgcacgctagctagggagcagcagcagagcagcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtactgcgcgaacgtcgacggatacagcccaatctacaacgaggatgactggtctcccaccggcgacgtctacgtcgggtggaaccactgggcttctgatctgggccgtcaccctcgctggaatcctcggcagcggcgccctcctcgtctacaacaaccagcgcccttcctcggctaaagaaataccatgcatgcccttcctggaaattcgcctggaaaaaacaggggggctggtctaaatccagcccccccggggggcccccccttcgcccaggaaaaaaaaacccggggcccccccc

SEQ ID NO: 54249 - protein, 129 aa, Zea mays
  misc_feature: Ceres CLONE 1478432-F
  misc_feature (32)..(107): Pfam Name: PsbR Pfam Description: Photosystem II 10 kDa polypeptide PsbR
MAASMISSSALAVAPQGLPPLGRRASSFAVVCSKKKIKTDKPYGIGGGLTVDVDANGRKGKGKGVYQFVDKYCANVDGYSPIYNEDDWSPTGDVYVGWNHWASDLGRHPRWNPRQRRPPRLQQPAPFLG

SEQ ID NO: 54250 - DNA, 667 bp, Zea mays
  misc_feature: Ceres CLONE 1478438-F
  misc_feature: Encodes the peptide sequence at SEQ ID NO. 54251
aaactggagctccccgcggtggcggccgctctagaactagtggatcccccgggctgcaggaattcgtctcacccctagaaaaacccctcacgtgctcgacccatatcgagggctcgatccgtcggccatggcgctggagtgggtggttctgggctacgcggcgggcgcggaggcgatcatgctgctgctgctgacgctgccggggctcgacggcctgcgccggggcatgatctccgtggtgcggagcgcgctgaagcccatgatgtcagaaatgcccttctgcctcttcctgctcatggacatctactggaagtactaaacgcgccccacctgcgacgacgagcacgcctgcaccccctccgagcacctccgccaccagaagtccatcatgaagtcgcagcgataacgcgctcctcatcgccgacgagctgctcctctactggatcctcttctccgatcacccagctcgtcgtctggctcgagcagatgcaacagctcgtcaactagctcatgacacgcgacgactgatggatccgcatccatccggtgggctcgttcttcctctgcctgccttgtgatcctgcttcatgttgtggtgctgatgctctacatctcggatcgtgatttgagacctgctggtagcatttgcttcctctgccttgccgtc

SEQ ID NO: 54251 - protein, 63 aa, Zea mays
  misc_feature: Ceres CLONE 1478438-F
MALEWVVLGYAAGAEAIMLLLLTLPGLDGLRRGMISVVRSALKPMMSEMPFCLFLLMDIYWKY

SEQ ID NO: 54252 - DNA, 675 bp, Zea mays
  misc_feature: Ceres CLONE 1478443-F
  misc_feature: Encodes the peptide sequence at SEQ ID NO. 54253
aagctggagctccccgcggtggcggccgctctagaactagtggatcccccgggctgcaggaattcgtctcacccctagaaaaaaaaagcctctccgccgccacttctcctccggcatccacgaagcgaattcccttagaccgagtccctctccctgctcccacgacccatggcggcatgatatggcgtacgcgccgcccatcaacgaggacgtggccggattcgacgatggtatgatgcatgcgcagcacaggatccgaatcactctctcttccgagagcgtcaagaacctcgataaagtctgcggtgatctggtccaaggcgccaacgctaagacactctaggtcaagggccccgtgcggatacctaccaaggcgctccacatcgccaacaggaatgctccctgtggagaaggcaccaacacctgcgatcgctttgagatgaggattcccatgaggctgaccgatctcgttctgacccctgacgttgcccagctgatcacctccgtcaccattgaaccaggtgccaacgttgaggtgactatacttgacccttagtatggaagccttctcgtttcaatggtttctagttgaacggaaattttcaattcctattgagaacttgtttaacagaagaatccaaagttttcctatccaaattttaaaattcttttcgg

SEQ ID NO: 54253 - protein, 53 aa, Zea mays
  misc_feature: Ceres CLONE 1478443-F
MAYAPPINEDVAGFDDGMMHAQHRIRITLSSESVKNLDKVCGDLVQGANAKTL

SEQ ID NO: 54254 - DNA, 745 bp, Zea mays
  misc_feature: Ceres CLONE 1478446-F
  misc_feature: Encodes the peptide sequence at SEQ ID NO. 54255
  misc_feature (286)..(286): n is a, c, t, g, unknown, or other
  misc_feature (319)..(319): n is a, c, t, g, unknown, or other
  misc_feature (330)..(330): n is a, c, t, g, unknown, or other
  misc_feature (399)..(399): n is a, c, t, g, unknown, or other
  misc_feature (594)..(594): n is a, c, t, g, unknown, or other
  misc_feature (678)..(678): n is a, c, t, g, unknown, or other
gcgctctacaactagtggatcccccgggctgcaggaattcgtctcacccctagaaaaacttgctcgctgcgccgccgcctccgacatcgtcccttcgtccccacgagcaaccgataatccgccggcgttgatatgttggtttatcaggatctcctatctggcgaccagctcctgtcggattcattcacctacaaggagctcgagaacggcgtcctgtgggaggtcgagggaaagtgggccaccccaggtcctgttgatgttggacttggtgctgatccatcccccnacggtgttttttacaaaaacattgataaaacanctggggaaagngttttttttccccccccccattgggggaaagaagggggaccctccttttttacaaaccaatacattttnatatcttccttccaaaaaataaaaccaaaaaaacatcggggaggtggttcggtattccccccccacaccccggaatcaaatttcaacaaaagggtggtgcaagggggagataacccagtacctcccatttaggatctagtgtgaagagactgcctcacatatattctcctcgcggcggcctcccctatatgggangggccgctccgctcgagagtatgtggccgcagccgaggtggcgtagctaactcggcaaatcaccgaaggtaaaaaataaatgcnggcacacgcacatctaacaggaaaccccccgcccccccacaccctctccgccaggctcgaacaccca

SEQ ID NO: 54255 - protein, 132 aa, Zea mays
  misc_feature: Ceres CLONE 1478446-F
  misc_feature (1)..(133): Pfam Name: TCTP Pfam Description: Translationally controlled tumour protein
  misc_feature (52)..(52): Xaa is any aa, unknown, or other
  misc_feature (63)..(63): Xaa is any aa, unknown, or other
  misc_feature (66)..(66): Xaa is any aa, unknown, or other
  misc_feature (89)..(89): Xaa is any aa, unknown, or other
MLVYQDLLSGDQLLSDSFTYKELENGVLWEVEGKWATPGPVDVGLGADPSPXGVFYKNIDKTXGEXVFFPPPHWGKEGGPSFFTNQYIXISSFQKIKPKKHRGGGSVFPPHTPESNFNKRVVQGGDNPVPPI

SEQ ID NO: 54256 - DNA, 698 bp, Zea mays
  misc_feature: Ceres CLONE 1478459-F
  misc_feature: Encodes the peptide sequence at SEQ ID NO. 54257
agagctggagctccccgcggtggcggccgctctagaactagtggatcccccgggctgcaggaattcgtctcacccctagaaaaactctcgatccggaaacctctcaaaccctagccgcctcctgcaagtttcagagctcaggactctgcctcatggccagtgagacggagaccttcgcatttcaggctgagatcaaccagctgctctcactcatcatcaacaccttctactccgacgaggagatcttcctccgcgagcttatctccaactcttccgatgcgctggacaagatcaggttcgagagtctcactgacaagagcaagctcaatgcgcagcctgagcttttcatccaccttgacccagagaaggccacaaacacgctctccatcatcgacagcggtatcggcgtggcccccacccaccttgtctacaacctcagtaccatcgccaggtcccggaccaaggagttcatggaaacccttgctggccgccctgaagtgtacatgatcggccagttcgacctcggttgctactctgcctacctcgtcccccatagaggtgtactgaccacccgtctccccaatgataagcgttacttgtgggattcccaccggggccggggtcgtcccgggttacctcgcgccactttcaggggaaaaaattgggcagggggcccctaaatcccccctgcctccccc

SEQ ID NO: 54257 - protein, 175 aa, Zea mays
  misc_feature: Ceres CLONE 1478459-F
MASETETFAFQAEINQLLSLIINTFYSDEEIFLRELISNSSDALDKIRFESLTDKSKLNAQPELFIHLDPEKATNTLSIIDSGIGVAPTHLVYNLSTIARSRTKEFMETLAGRPEVYMIGQFDLGCYSAYLVPHRGVLTTRLPNDKRYLWDSHRGRGRPGLPRATFRGKNWAGGP

SEQ ID NO: 54258 - DNA, 656 bp, Zea mays
  misc_feature: Ceres CLONE 1478466-F
  misc_feature: Encodes the peptide sequence at SEQ ID NO. 54259
  misc_feature (490)..(490): n is a, c, t, g, unknown, or other
  misc_feature (656)..(656): n is a, c, t, g, unknown, or other
aagctggagctccccgcggtggcggccgctctagaactagtggatcccccgggctgcaggaattcgtctcacccctagaaaaagcaagctagccatagtagggggctcactcatccgcacagaccggcacccagctcaagtcacccccgaaacgcaagctaagcgcgcagccatggcggcggctccagggcggccgctggcggtggacttcgaggcgctgagctacatcagcagcctggtggaggcgttccaggcgttcgactccgacaacgacgggctggtgacggcgcccgagctccggggcctgctggcgtcgctgggcctggacaagtcggaggccgaggcgcgcgacatgctggcgcgcgccgacgccgaccgcgacggccggctcagcgtcgaggagttcctggacgtgatgaacgccggggagctcgggctgggcgcgctcggggcggtgctgcagtcggcgctccccacgctggaggccgcnggaggcgcgctggtcggcgcggacgagctcgcccgggcgctcggcgccctcggcagcgctagcgccgaagactgcgcggctattgttgagtgcctggacggcgacggcgacggcgccatcaccattgaggagttcaggctcatggccgacctgctctaggtctagn

SEQ ID NO: 54259 - protein, 158 aa, Zea mays
  misc_feature: Ceres CLONE 1478466-F
  misc_feature (57)..(85): Pfam Name: efhand Pfam Description: EF hand
  misc_feature (21)..(49): Pfam Name: efhand Pfam Description: EF hand
MAAAPGRPLAVDFEALSYISSLVEAFQAFDSDNDGLVTAPELRGLLASLGLDKSEAEARDMLARADADRDGRLSVEEFLDVMNAGELGLGALGAVLQSALPTLEAAGGALVGADELARALGALGSASAEDCAAIVECLDGDGDGAITIEEFRLMADLL

SEQ ID NO: 54260 - DNA, 659 bp, Zea mays
  misc_feature: Ceres CLONE 1478467-F
  misc_feature: Encodes the peptide sequence at SEQ ID NO. 54261
aaagctggagctccccgcggtggcggccgctctagaactagtggatcccccgggctgcaggaattcgtctcacccctagaaaaaacagcagcttcctttcctccggcgatggcgaagaatcccaaagatgccgctccggaggaggagatgcccgccgcggccgaggaacaggcagcgcctgccgcgacggtgaaggtgctcttcttcgcccgcgcgcgggacctaacgggcgtggcggattccgcggtggaggtgccgccggggagcaccgtgggggagtgcctcgcgcgggtcctagcccagttccccaagctggaggagatccggggctccgtcgtgctcgcgctcaactaggagtacgcggccgtctcggccgcggtcgccgacagcgaccagctcgctgtcataccgcccatcagtggcggctgacgttattaaccacggccgacttgtgtggaggtgatataaaagatatgaagacatcgatcgttgaggaaaaaaaaaagagagggaaagttcctctcccttcttcatggtcagtttatcaccttgaatgattgaaattattatttgctcgataaaataacctcttgttcttgattacaattttggttcccttgatcactaatttttttgttgccaaagaatggatgaaatgg

SEQ ID NO: 54261 - protein, 81 aa, Zea mays
  misc_feature: Ceres CLONE 1478467-F
MAKNPKDAAPEEEMPAAAEEQAAPAATVKVLFFARARDLTGVADSAVEVPPGSTVGECLARVLAQFPKLEEIRGSVVLALN

SEQ ID NO: 54262 - DNA, 801 bp, Zea mays
  misc_feature: Ceres CLONE 1478468-F
  misc_feature: Encodes the peptide sequence at SEQ ID NO. 54263
  misc_feature (27)..(27): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (46)..(46): n is a, c, t, g, unknown, or other
gggcgcacaccccactaccaccctgcnccgtttnnnnnnnnccccncctcatagctggagctccccgcggtggcggccgctctagactagtggatcccccgggctgcaggaattcgtctcacccctagaaaatccgccccgctccttgcctccgatccccaattcctccttcggatctcgcattcagcgcagcgcaggtgtgaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtgtgggaaaccgggggtcaggacaagattagacctctttggaggccccacctgcggaacacccagggtcttatctcttgctgtggaccgcaatggaccgctgaccgtgtttggttgaagccaggaaatgagctcccacaaggaggcttgaacgaggatgagactacggggtggctgtggcttgtttggttttgtgcccacgaggcaagaatcttcccccatggccagtaaatgcctgccggaaatttaccgcgacgagcttgggaatatcacaccgcctgggggacgggggaaaatttggaaaaatactggaggaaaattgggtggcccaccaccttcgcgcagaggggcccttgctctgaaacggggcctggcgaactgggg

SEQ ID NO: 54263 - protein, 140 aa, Zea mays
  misc_feature: Ceres CLONE 1478468-F
  misc_feature (5)..(129): Pfam Name: Arf Pfam Description: ADP-ribosylation factor family
MGLAFGKLFSRLFAKKEMRILMVGLDAAGKTTILYKLKLGEIVTTIPTIGFNVETVEYKNISFTVWETGGQDKIRPLWRPHLRNTQGLISCCGPQWTADRVWLKPGNELPQGGLNEDETTGWLWLVWFCAHEARIFPHGQ

SEQ ID NO: 54264 - DNA, 581 bp, Zea mays
  misc_feature: Ceres CLONE 1478471-F
  misc_feature: Encodes the peptide sequence at SEQ ID NO. 54265
  misc_feature (434)..(434): n is a, c, t, g, unknown, or other
  misc_feature (581)..(581): n is a, c, t, g, unknown, or other
aagctggagctccccgcggtggcggccgctctagaactagtggatcccccgggctgcaggaattcgtctcacccctagaaaaagcaagctagccatagtagggggctcactcatccgcacagaccggcacccagctcaagtcacccccgaaacgcaagctaagcgcgcagccatggcggcggctccagggcggccgctggcggtggacttcgaggcgctgagctacatcagcagcctggtggaggcgttccaggcgttcgactccgacaacgacgggctggtgacggcgcccgagctccggggcctgctggcgtcgctgggcctggacaagtcggaggccgaagcgcgcgacatgctggcgcgcgccgacgccgaccgcgacggccggctcagcgtcgaagagttcctggacgtgatgaacgccggggagctcnggctgggcgcgctcgggggcggtgctgcagtcggcgctccccacgctggaagcccgcggaagcgcgctggtccgccgcgacaagctcgcccgggcgctcggcgccctccgcagcgctagcgccgagactgcccggctattgttgaan

SEQ ID NO: 54265 - protein, 126 aa, Zea mays
  misc_feature: Ceres CLONE 1478471-F
  misc_feature (57)..(85): Pfam Name: efhand Pfam Description: EF hand
  misc_feature (21)..(49): Pfam Name: efhand Pfam Description: EF hand
  misc_feature (88)..(88): Xaa is any aa, unknown, or other
MAAAPGRPLAVDFEALSYISSLVEAFQAFDSDNDGLVTAPELRGLLASLGLDKSEAEARDMLARADADRDGRLSVEEFLDVMNAGELXLGALGGGAAVGAPHAGSPRKRAGPPRQARPGARRPPQR

SEQ ID NO: 54266 - DNA, 754 bp, Zea mays
  misc_feature: Ceres CLONE 1478475-F
  misc_feature: Encodes the peptide sequence at SEQ ID NO. 54267
aagctggagctccccgcggtggcggccgctctagaactagtggatcccccgggctgcaggaattcgtctcacccctagaaaaagcccaccaccactctctagtctcaccgccccccgtcccgctcattggacgagacgacggacccttcctttctcgcacgggaagagtagcgaggaggcgcggcgcccgtgcggcgtatgcccgtgcctgccgtcgggctccgcctctaggactagggtccgctccagcgccagccgtccgccatgggtgggctcgaggagatcaagaacgaagccgtcgatctggagaacatccccatcgaggaggtgttcgagcagctgatatgcacccgcgcagggctgagcatcaggaggcccaccagcgtctcgagatctttgggccaacaggctccccccacaccaagagagcaaggtctccagtttctttgggtcatggtgaaaccgctgtcatgggtcatgaaaatggctcccaccctggcttttgcccctccccacggggggggcaaacccccccgaacgggagggacttcccccggaatctaccggcctcttgggtaaaaaaattcccccccctcctttatttgggggaaaaaaaagggggggaacgcccccccccccccctccttgggccaccctttgttcccaaaaaacaaaggttttctaaaaaaatccctagtgggggccacacaaaaaggggccactcctctgttttccgcgggggcacatttttcca

SEQ ID NO: 54267 - protein, 104 aa, Zea mays
  misc_feature: Ceres CLONE 1478475-F
  misc_feature: SWISSPROT Homolog: EC 3.6.3.6 Proton-exporting ATPase
MGGLEEIKNEAVDLENIPIEEVFEQLICTRAGLSIRRPTSVSRSLGQQAPPTPREQGLQFLWVMVKPLSWVMKMAPTLAFAPPHGGGKPPRTGGTSPGIYRPLG

SEQ ID NO: 54268 - DNA, 669 bp, Zea mays
  misc_feature: Ceres CLONE 1478478-F
  misc_feature: Encodes the peptide sequence at SEQ ID NO. 54269
  misc_feature (311)..(311): n is a, c, t, g, unknown, or other
  misc_feature (410)..(410): n is a, c, t, g, unknown, or other
  misc_feature (580)..(580): n is a, c, t, g, unknown, or other
  misc_feature (591)..(591): n is a, c, t, g, unknown, or other
  misc_feature (605)..(605): n is a, c, t, g, unknown, or other
aaagctggagctccccgcggtggcggccgctctagaactagtggatcccccgggctgcaggaattcgtctcacccctagaaaaagagagagaccgagagagagagagagaaaaaatcaagtcatccccctttcctctgagctcgttccatggagaactcttctcacaagcgggcgcgggaggcgggcgacctcgtcgccggcggctgcggagaggagggctcgccgcaggccgacgccaagaggctgcggccgcaggacctgctcgacatgctggaggacgacacggacgcggccgcggccggcgacctancgtcggtcatgcggagcctgggagaagagatagccaggctccaacaggccccggaagcccccggccccgggagtgggggttccctggtccaaaccctcngaagaagaggtgggggcttgccgcccgcctcccctttggggggagggagaagcccccccccccccgggggggaaagagaaaggccccccccccctcgaacggccaaattttgggggtgtttcagagaaaaaaatggggagaggagcgcggcctccccgcggctataattncccggggaganggtgtggtgtcccncccccccccccccccccccccccggaggaaaaaaaaaaaggttttctttggcctggggcctttt

SEQ ID NO: 54269 - protein, 142 aa, Zea mays
  misc_feature: Ceres CLONE 1478478-F
  misc_feature (55)..(55): Xaa is any aa, unknown, or other
  misc_feature (88)..(88): Xaa is any aa, unknown, or other
MENSSHKRAREAGDLVAGGCGEEGSPQADAKRLRPQDLLDMLEDDTDAAAAGDLXSVMRSLGEEIARLQQAPEAPGPGSGGSLVQTLXRRGGGLPPASPLGGGRSPPPPGGERERPPPPRTAKFWGCFREKNGERSAASPRL

SEQ ID NO: 54270 - DNA, 729 bp, Zea mays
  misc_feature: Ceres CLONE 1478479-F
  misc_feature (407)..(407): n is a, c, t, g, unknown, or other
  misc_feature (427)..(427): n is a, c, t, g, unknown, or other
  misc_feature (474)..(474): n is a, c, t, g, unknown, or other
  misc_feature (529)..(529): n is a, c, t, g, unknown, or other
  misc_feature (530)..(530): n is a, c, t, g, unknown, or other
  misc_feature (538)..(538): n is a, c, t, g, unknown, or other
  misc_feature (539)..(539): n is a, c, t, g, unknown, or other
  misc_feature (585)..(585): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (640)..(640): n is a, c, t, g, unknown, or other
  misc_feature (686)..(686): n is a, c, t, g, unknown, or other
  misc_feature (704)..(704): n is a, c, t, g, unknown, or other
  misc_feature (726)..(726): n is a, c, t, g, unknown, or other
  misc_feature (727)..(727): n is a, c, t, g, unknown, or other
ataagctggagctccccgcggtggcggccgctctagaactagtggatcccccgggctgcaggaattcgtctcacccctagaaaaaaccgagcagcaacaagccaacaactaaaggcaggcgcggcacaccgcgacaccgtaccggcctagacacttggagaaaggagaagcagcgtagcggcatgggcaccagtcccgtcatccctgcgacgatgctcgtcgtcgctctccttgtcgctagtagtactgtctgcttcggcgccaccgccaccgacaccgacaccgactgcgccgttcgtctccgcagcagctctggtgctgttggtcgaccgcgggactgctgtgactatgtccaccaaggttttttttctcccccccccccgggggggggggggggagaaccgtgntggccaattcctcccccccnacccccacaaatgccaagaagttcgccgggcgcgggagagtttcatnttacccacgacgggaactttaagcctggcttcaacccccccggtttactaccgcnntggccctnnggtatggggtcccacccttccccccccgtgcccacacggaaccaanttccccctaacagcacaggggcgcgtgactcctccggagagtcctggccnnnngncgaccgccttctggtcggccttctctccggagggtccaccactctncgcccctgcctggccctngtaagcacgtttctcgcgtggnnta

SEQ ID NO: 54271 - DNA, 648 bp, Zea mays
  misc_feature: Ceres CLONE 1478484-F
  misc_feature: Encodes the peptide sequence at SEQ ID NO. 54272
aaagctggagctccccgcggtggcggccgctctagaactagtggatcccccgggctgcaggaattcgtctcacccctagaaaaagacccgtagcggcacggaatggcggacacagagtactgggtggggctcctctgcggctcacgccctgccgggagccttcctccctgcgacgtcaccagcgtgtgccacaaccagcttcgcctccgagacgcaccaaggctgatctccctgcaccatgacagggacgcttccgaggacacgtcagcctccggcgaggactagctcatctaacacctcaaggcaaagtgggacgccgatgaggacaagcccaccgtcctcctgtacggaggcggagccatcatcacactatggttgacgtccgttgtcgtcggaaccattgacgccgtgacgctgctccccaagatcctgaagctcgttggcctcggctacaccggctggttcgtctaccgctacctcctcttcaaacatagcaggaggagactggtcgacaacattgacaccctcaagaatagatagctggaacggcggaataagcgctagctctcgtggaaagcttttttaaaccaacaactagaggggccatgtcttctttggcaattaagatataaaccgaggggcgtacca

SEQ ID NO: 54272 - protein, 60 aa, Zea mays
  misc_feature: Ceres CLONE 1478484-F
MADTEYWVGLLCGSRPAGSLPPCDVTSVCHNQLRLRDAPRLISLHHDRDASEDTSASGED

SEQ ID NO: 54273 - DNA, 628 bp, Zea mays
  misc_feature: Ceres CLONE 1478485-F
  misc_feature: Encodes the peptide sequence at SEQ ID NO. 54274
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
tggagctccccgcggtggcggccgctctagaactagtggatcccccgggctgcaggaattcgtctcacccctagaaaaactccctgctgcaacccaaccaagcccgcacgacacgacaccaagtcgaggagctcgagagggcaccaataatggccggcgtgaactccagcgtcgtcgggctcaagcccgccgcgacagtgccacatgccgccgccgcctcatcgccggcgaagcgggtgcagctggccgcgcccgagggccgccgcgccgctctgctcggcctgacggccgtcttcgccgtcacggccaccaccgggtcggccaaggccacagatctttccgaaatgaataaccctcgagagaaaaaacaaaggcccaacccgggggactttaaacccccaaaaaaaaagggggggggccccccccctgggagaaaccccctttttttggcggcgccccccccccccccccccgggggataaatcttttggaggaccccccccccaaattccccccccccaaaaaaaaatattttttgggggggggggggggggggaaaaacccccccccccccccnnnaaacaaaaaaaaaaaaaaaaccccccaccccccccctttttttaaaaag

SEQ ID NO: 54274 - protein, 110 aa, Zea mays
  misc_feature: Ceres CLONE 1478485-F
MAGVNSSVVGLKPAATVPHAAAASSPAKRVQLAAPEGRRAALLGLTAVFAVTATTGSAKATDLSEMNNPREKKQRPNPGDFKPPKKKGGGPPPGRNPLFLAAPPPPPPGG

SEQ ID NO: 54275 - DNA, 673 bp, Zea mays
  misc_feature: Ceres CLONE 1478486-F
  misc_feature: Encodes the peptide sequence at SEQ ID NO. 54276
  misc_feature (371)..(371): n is a, c, t, g, unknown, or other
ctggagctccccgcggtggaggccgctctagaatagtggatcccccgggctgcaggaattcgtctcacccctagaaaaacaatgatggttgccagcttgtacatctctcaaattgaagagctgatgtttgagatctctctgtggcgctgtaacgatgagattcgggttagtggggacgagctccaaactgcgtctggttccgaagtgacgaagtattacgtagaattctggaagcaaattcatcaaaacgagccctaccgggtgatactaggacatgaaatggacaatctgtccaagacactccagcgtgctcgccatgtgctgggttccgcagtttctgtagatttcagcggaatcgtaatttaagaganccaacagttccttgagccacttgagctgtgctagcaatcactcaagactgcgccaagaggccatcgggcacagaagctcctggacctcctgatcaggtttacggggcggggtctccctgtagacgctggacatccggcaggatgctgaggggcgaactaaatgatggacaccatcgccagacgcctcggtgatcgggtcgacccaacaattcggcccgaggaccacgaggcaggaaattgcttgctttcctaaacctggaaggcaaagcaccctgctggtggcctccgggacctttccccat

SEQ ID NO: 54276 - protein, 94 aa, Zea mays
  misc_feature: Ceres CLONE 1478486-F
  misc_feature: SWISSPROT Homolog: EC 4.1.1.31 Phosphoenolpyruvate carboxylase
MMVASLYISQIEELMFEISLWRCNDEIRVSGDELQTASGSEVTKYYVEFWKQIHQNEPYRVILGHEMDNLSKTLQRARHVLGSAVSVDFSGIVI

SEQ ID NO: 54277 - DNA, 699 bp, Zea mays
  misc_feature: Ceres CLONE 1478493-F
gctctcgaactagtggatcccccgggctgcaggaattcgtctcacccctagaaaaaatcccagatcaggattagccgaccacccgccgaaggccagagagaaatatctcatcttctctccaccggatcggttcaatcgagagcgagggagaaagggaggtggtgcgtcgaggggggccgagattttgccggtttggagccaaataggggtatgagctgcttcgcgcaccgccgccgctccgacgtcgcccgccgccaggacggcctcctcgtcttcttcttcttcctctcgattcccatacgtaccagtagttttaatttaagtagtagtaattgtagtagcaatctcttgtaaactgcgctcgcctttgcgtgttggtggtttgtgcccccccccctcgtccctctttctctcaatctctccttactctttctccttcacggcaaagctcggccgctgggatgggatcccaatggccttcaaattggaggctttttgctcccgaccatccgagagggggtggacgccgcctcccttcggtaatggtcatcggcggggggccatttaggtgatttccaggttgccccgggcccctctcccattctttcctttttagggggaaccgttttctggggttccaggagatctcctcttgggggggcggcctttctaccctcgtatcactttttgtgggggagg

SEQ ID NO: 54278 - DNA, 728 bp, Zea mays
  misc_feature: Ceres CLONE 1478495-F
  misc_feature: Encodes the peptide sequence at SEQ ID NO. 54279
aagctggagctccccgcggtggcggccgctctagaactagtggatcccccgggctgcaggaattcgtctcacccctagaaaaaaagaataatcgaatctcccaaaccaaatcgacgtcgtcgtcgcatcggaccatcgggagtgcccagggtctgcggaccgaatccgtttccagacacccaagggcaagattcatcgctcgtgacaccctgcctcctccttcttcagcttggtcgtctgatctcgctttccaggcgcgcgcgatccgagtcgctcaacggctgtgaatgatggtgctcaacctgtctcaccagaccggcgcgtacgtggctgcggcacctgaggccccacgagcggctgtcgtaccgagtggaggcaagctgccacgtttggccgtctacggtgcggtggccacctcggcggcagcacgagcgtaggagctcgcctccgttccggggcatcagctgcagactatgacggtggactcagaccctgcgcaggcgcccgaagcggaaaactcggacctcgcccaggcctgccaagattgggtgtgagctgagcccccaggcggtaggcgcccacttctgccagcgaatttcctgcaacacggtgcggggaggccctttctccctccatgaaggccacctcgacaccagggtcccagggacggcaagctcccctccagcgaggggctagggtccttcgggagggctaaccctggggcggtg

SEQ ID NO: 54279 - protein, 48 aa, Zea mays
  misc_feature: Ceres CLONE 1478495-F
MVLNLSHQTGAYVAAAPEAPRAAVVPSGGKLPRLAVYGAVATSAAARA

SEQ ID NO: 54280 - DNA, 700 bp, Zea mays
  misc_feature: Ceres CLONE 1478496-F
  misc_feature: Encodes the peptide sequence at SEQ ID NO. 54281
aaagctggagctccccgcggtggcggccgctctagaactagtggatcccccgggctgcaggaattcgtctcacccctagaaaaagaattgaaacgaaggcccgcgacgcgaggagcgagggaactaccaccggtctcggcgcctccgcgacgatagcctctccgacctcgagcgcggtccggttcctccctgcgtcagcacgcgagcccttggagcttcgagtcagatcccggcgggcgcccatggtggctctggtgccgttgagccgcgcgatgtagggttttcgcgcgccgcatagtaggagcgatggggcgccggaagatgtccgcggcggcaccgccgtctcggagctggtccaacgttggcggaagcgtcatcccggaacttcgagctaaacacaaaacagactccccacaatttgacgctgaccaaacagccactcagaacattgcattttttcctattagccatgttacaatacttgaaaagattagcaacatatatcctggagtaagggtgggtttcttctttcctcctaaatgttttaattggtagctttctggaatctgtgctcgtcgtttcggatgggctgcataagaaaccatgtgccgggatttccttaattatgctaaactttggggcggggggggggttcattaggggggggcttcatcaaatgggaaaaggttcctgggtttgc

SEQ ID NO: 54281 - protein, 82 aa, Zea mays
  misc_feature: Ceres CLONE 1478496-F
MGRRKMSAAAPPSRSWSNVGGSVIPELRAKHKTDSPQFDADQTATQNIAFFPISHVTILEKISNIYPGVRVGFFFPPKCFNW

SEQ ID NO: 54282 - DNA, 715 bp, Zea mays
  misc_feature: Ceres CLONE 1478497-F
  misc_feature: Encodes the peptide sequence at SEQ ID NO. 54283
  misc_feature (528)..(528): n is a, c, t, g, unknown, or other
aaagctggagctccccgcggtggcggccgctctagaactagtggatcccccgggctgcaggaattcgtctcacccctagaaaaagctttccgattttcgtttctctctcttttcctttccccccgtccctctctttctttctctcttggaattggaattggactcaaaagtttcggcggccttctccatgaacacggtggcttcgctgcctttggcgccgcgcctactcattaagccctccctcgcctgcttctccagaaaggacgtcgcccgctatggcgggatcaaggtgtacgccgtgctcagggaagacggggccgagttcgcccggaacaacaacctgggggccctgttccaggtggacgaccccgggccgcgggcccccgtcaagaagttcctggacgtgaacgacgcccccgaggtggtccgcttcgacatccagtactgcgactggagggcgcgccaggatctcctcaccatcatgcttctccacagcaaagtggtggaggtcctcaaacctctggcganggagttcaagtccatcgggaccttgaggaaagagctcgccgagctacagcaggagtctggaaaaagctcacaatcaggtccatctctcggaagccagagtctcatcggcgctcgaacagctagcgcatatggagaccctggtgagcgcatcatcaacaggcgagccgcccacttcttcctcccctgg

SEQ ID NO: 54283 - protein, 176 aa, Zea mays
  misc_feature: Ceres CLONE 1478497-F
  misc_feature: SWISSPROT Homolog: EC 1.13.12.14 Chlorophyllide-a oxygenase
  misc_feature (114)..(114): Xaa is any aa, unknown, or other
MNTVASLPLAPRLLIKPSLACFSRKDVARYGGIKVYAVLREDGAEFARNNNLGALFQVDDPGPRAPVKKFLDVNDAPEVVRFDIQYCDWRARQDLLTIMLLHSKVVEVLKPLAXEFKSIGTLRKELAELQQESGKSSQSGPSLGSQSLIGARTASAYGDPGERIINRRAAHFFLPW

SEQ ID NO: 54284 - DNA, 743 bp, Zea mays
  misc_feature: Ceres CLONE 1478500-F
  misc_feature: Encodes the peptide sequence at SEQ ID NO. 54285
  misc_feature (393)..(393): n is a, c, t, g, unknown, or other
  misc_feature (410)..(410): n is a, c, t, g, unknown, or other
agagctggagctccccgcggtggcggccgctctagaactagtggatcccccgggctgcaggaattcgtctcacccctagaaaaaattccctctcttcctcccgaaatttcccacctcagactccgagagaagcaaacacaagaagaagaagaaaaaaaaccgtccgcacaaaaaagaaaacggtagcgccagccagtgaggagaaaagcttcagatccagctccagctccaggtccccctcctccccaatgcctcgcccgtagccgcgtccgccgcacgtcgcaatggccggccccagcgtgcccgcagcggcgctggcggccctgctcgcggtcgccgccctcactggctgcgccgtcgcggagccgccgcccgagggagggggccgctctnctggctttcctcaccgngaacccgttcgacccccccctaagggtggaaacgcctcccccccgggggtggggcttggctcgcgggtcacgggccaaccaaagctcaactgcatccgttgtacgagggtggtgcctcccggggcgtggggccctcttttggggccctttctcttctgccgattgtccccggcgatgttctaccaacctttcccgcgggcgttttgtccccacctccaaacccgcgtttcgtcttgtaccctcccgctaacccacagtgtttcaatgcccgctcgctcctttcagggcactttttctcatgataacccaatattgggctctcctggcccctat

SEQ ID NO: 54285 - protein, 153 aa, Zea mays
  misc_feature: Ceres CLONE 1478500-F
  misc_feature (37)..(37): Xaa is any aa, unknown, or other
MAGPSVPAAALAALLAVAALTGCAVAEPPPEGGGRSXGFPHREPVRPPPKGGNASPPGVGLGSRVTGQPKLNCIRCTRVVPPGAWGPLLGPFLFCRLSPAMFYQPFPRAFCPHLQTRVSSCTLPLTHSVSMPARSFQGTFSHDNPILGSPGPY

SEQ ID NO: 54286 - DNA, 699 bp, Zea mays
  misc_feature: Ceres CLONE 1478506-F
  misc_feature: Encodes the peptide sequence at SEQ ID NO. 54287
aaagctggagctccccgcggtggcggccgctctagaactagtggatcccccgggctgcaggaattcgtctcacccctagaaaaaagccaccgaaatcttccgtctccaaatcctcctagcgaattcaccacagcttctcaccaccgctaccttcgatggcacccaaggcggacaagaagccggcggcgaagaagcctgcagaggaggagcccgcgacagagaaggcggagaaggctccggcggggaagaagcccaaggccgagaagcgcctcccggcgggcaagtccgccggtaaggagggcggcgagggcaagaaggggaaaaagaaagcgaagaagtccgtggagacctacaagatctacatcttcaaggtgctgaagcaggtgcaccccgacatcggcatctcgtccaaggccatgtccatcatgaactccttcatcaacgacatcttcgagaagctcgcggccgagtccgccaagctggcgcgctataacaagaagcccaccgtcacctcccgcgagatccagacctcggtgcgcctcgtcctccccggcgagcttgccaagcacgccgtctccgagggcaccaaggccgtcaccaagttcacctcttcttaaggttcatagtactaggctgggtgggtgttggtagacgtggctcaatttatctggtaggggtagtgatggatgatatgatctg

SEQ ID NO: 54287 - protein, 153 aa, Zea mays
  misc_feature: Ceres CLONE 1478506-F
  misc_feature (60)..(130): Pfam Name: Histone Pfam Description: Core histone H2A/H2B/H3/H4
MAPKADKKPAAKKPAEEEPATEKAEKAPAGKKPKAEKRLPAGKSAGKEGGEGKKGKKKAKKSVETYKIYIFKVLKQVHPDIGISSKAMSIMNSFINDIFEKLAAESAKLARYNKKPTVTSREIQTSVRLVLPGELAKHAVSEGTKAVTKFTSS

SEQ ID NO: 54288 - DNA, 708 bp, Zea mays
  misc_feature: Ceres CLONE 1478507-F
  misc_feature: Translation starting site: 112
  misc_feature: SWISSPROT Homolog: EC 2.7.7.27 Glucose-1-phosphate adenylyltransferase
tccccgcggtggcggccgctctagaactagtggatcccccgggctgcaggaattcgtctcacccctagaaaaactcggccgttgccgcgagctcgctccgacccaccgccaatggcgacggcgatgggcgcgatggccgccacctgcatggcctcgatgccggccgccgctacgttccccggtgatctcggcgtcggacgacgccgagcggctgtaccagggtggcgcgccggtgggagacggctgcgtgcgacgccgcctgcccggaggccgttcctgttctcgccgaagggcgtttcggactcgcggagctcgcaaacgtgccttgatccggacgccagcacgagtgttcttgggatcatccttggagggggtgctgggacaaggttgtatcccctgaccaccaccaggccaaacccgcagtgccgttggggcgccactacgggctcataaatatccctgtcagcacctgtctcaacataacgtctccaagaaatttgggcaaaccagttaaaattttgtttggtaaccggcaccttttcgagggctttgggaaacacttttgccgggtcaaaaatagggggattcttgtgggcccttgcccccccccgaattcaaaaaacccccccgggttttggggtctcgcaaaatcccgggcccaaaatatttgggtttttttgggggacaaaaattcggggggtctctttt

SEQ ID NO: 54289 - DNA, 759 bp, Zea mays
  misc_feature: Ceres CLONE 1478509-F
  misc_feature: Encodes the peptide sequence at SEQ ID NO. 54290
  misc_feature (759)..(759): n is a, c, t, g, unknown, or other
acccgcggtggcggccgctctagaactagtggatcccccgggctgcaggaattcgtctcacccctagaaaaacccccgccacctgagtacctgacacacagcgaaacgccgaaaccgcgtcaagttccccatctccgatcccccaatcgccctaaccctagactcgccaccgccgccgcgatgctccgctcgccgggcaattcgccccgccgcctctcaccgtcgcccacacccgcgccctccacccctcgcccggcctccccgcccccctccaccgccccctcctcgaagcgcccccggtcggaggtgctcgacgaggacaactacgtcgccgccatcgagcgcatcatcgagcgggaatacttccccgacctgccccccctcggggacggcctggaatgccccccccgccccgcgggccccagaaaccgttcatccctccgcaaactgccaccttcaaaatcccaaaaacggccggtcggccgggcctcaataggcaaaaggggggggggacctgttccccaagcccgaaatcctggtataatttcccccgaggctccgttttccccgggtctttttccccccacccccccccggaaaaccttgcccccggtggggatgggagaggtccccaaaccccccatacaagaaaaaatacttgtaggggcgcgcgagttatccttggagggggtttttttcccggcggtttcaaccggggagggcgagatccccttttgttgggcacacataaaaaaaaan

SEQ ID NO: 54290 - protein, 192 aa, Zea mays
  misc_feature: Ceres CLONE 1478509-F
MLRSPGNSPRRLSPSPTPAPSTPRPASPPPSTAPSSKRPRSEVLDEDNYVAAIERIIEREYFPDLPPLGDGLECPPRPAGPRNRSSLRKLPPSKSQKRPVGRASIGKRGGGPVPQARNPGIISPEAPFSPGLFPPTPPRKTLPPVGMGEVPKPPIQEKILVGARELSLEGVFFPAVSTGEGEIPFCWAHIKK

SEQ ID NO: 54291 - DNA, 710 bp, Zea mays
  misc_feature: Ceres CLONE 1478511-F
  misc_feature: Encodes the peptide sequence at SEQ ID NO. 54292
  misc_feature (373)..(373): n is a, c, t, g, unknown, or other
agagctggagctccccgcggtggcggccgctctagaactagtggatcccccgggctgcaggaattcgtctcacccctagaaaaaaaatgtcagcgatccctctccctcgctccctcgtatccgagacaacagcccgtgcgatccgatccccatgtttgcccaatcggactgctgctgcgcctactgcgcatcgacgcgcaccttcagtagtaagcgctgggacatcacgatccccgccgacgcgaacctgaacgtcgtcaggttcctctggtgcagccgctacgcgggcgtcatcgcgctcatccacgctagctctggcaccgggtcacgttccaggaacttggcgcacggttgaaggtcgggcactcggttncccaaccccattctcgtccgaaagggccaaaatagcccccccccggtgcccaaaatctccccacttccccgtttggcgccccttccacccctggtcgttaggggggcagtcctcacctacctccaacccgttttaaaaagccgggctgaaatttccaaaggaaggtttttctaagggtgttccccctattaacgccttttggaacccgaaaaagtttcttcccaaaagtttccggggttgtcttgggccccgggccccccggtatttttcttctggggcttctcttaaaaagcccaaacccccctccccttcggtagcggggggccactttccctct

SEQ ID NO: 54292 - protein, 67 aa, Zea mays
  misc_feature: Ceres CLONE 1478511-F
MFAQSDCCCAYCASTRTFSSKRWDITIPADANLNVVRFLWCSRYAGVIALIHASSGTGSRSRNLAHG

SEQ ID NO: 54293 - DNA, 672 bp, Zea mays
  misc_feature: Ceres CLONE 1478961-F
  misc_feature: Encodes the peptide sequence at SEQ ID NO. 54294
aaagctggagctccccgcggtggcggccgctctagaactagtggatcccccgggctgcaggaattcgtctcacccctagaaaaagaaaaaatcttcctgcttcggacagttgagagagagagagagggatcgagagcgcggcggaggcgatggcgagcggagggaagggactcaacgcgactggggagttcttccggcggagggacgagtggaggaggcaccctatggcggggaaccagctgcgccacgccacacccgggctcggcatcgccatcgtcgccttcgggatctacctcgtcggcgaggccgcctacaaccgcctctaccgcccctccggcgacaaccaccactagatcgccggcaggatccgtgactcggtcaagaagctggagccaactttaccaagcactggtgctgttgatgtttttacagttttgagctcataaggtcagccatgaccatattgtaatctgtgaccaggtagacttgcccactggtccgtccaactattgtcttgggaccctgtgttaatccttgctatatggatctgacagtgctcatgtaattcaagaatcctggactatctttttatgtgcttatttgaggaaaaaaaaaaaaaaacgagacgctcgaggtacccaattcgccctatagtgagtcgtattacgcgcg

SEQ ID NO: 54294 - protein, 67 aa, Zea mays
  misc_feature: Ceres CLONE 1478961-F
MASGGKGLNATGEFFRRRDEWRRHPMAGNQLRHATPGLGIAIVAFGIYLVGEAAYNRLYRPSGDNHH

SEQ ID NO: 54295 - DNA, 669 bp, Zea mays
  misc_feature: Ceres CLONE 1478965-F
  misc_feature: Encodes the peptide sequence at SEQ ID NO. 54296
  misc_feature (255)..(255): n is a, c, t, g, unknown, or other
  misc_feature (258)..(258): n is a, c, t, g, unknown, or other
  misc_feature (275)..(275): n is a, c, t, g, unknown, or other
  misc_feature (276)..(276): n is a, c, t, g, unknown, or other
  misc_feature (289)..(289): n is a, c, t, g, unknown, or other
  misc_feature (291)..(291): n is a, c, t, g, unknown, or other
  misc_feature (303)..(303): n is a, c, t, g, unknown, or other
  misc_feature (309)..(309): n is a, c, t, g, unknown, or other
  misc_feature (409)..(409): n is a, c, t, g, unknown, or other
  misc_feature (503)..(503): n is a, c, t, g, unknown, or other
aagctggagctccccgcggtggcggccgctctagaactagtggatcccccgggctgcaggaattcgtctcacccctagaaaaactactgacgagctcgccatggcctccctctcctctgccgccgtcaccgccccttccttcgccgcaccagcgccagcccgcgccgtggtcagaaggaggtccttcaccgtgcgcgcctctctccgcaaggcaccggcaccgccgccgtggcaatgctgccagcgccctgcttngcngcggtgccatgggccanngagtgctgctggncncaggcaacggcnggctcntcttcaagcccagccagttcaccgtcagggccggcgacacatcacattcagaaacacgccggcttttccgcacacgtcgtcttcaagaagacgagggtgngagcggcgtcaacgccaccagatctcgcaggaggagtaccctcacgcgccaggcgagacctactccgtcaccctcaccgtggcggggacctacngcttctactgcgagccgcatcaaggagccggaatggtcggcaagatcaccgtcaactaaataagctagctatcgatcgatatcccatcatggtattagctggttgctttcctgctttggactcccgccgatactgcccttctctaccttgttttccgtcttccacc

SEQ ID NO: 54296 - protein, 153 aa, Zea mays
  misc_feature: Ceres CLONE 1478965-F
  misc_feature (71)..(153): Pfam Name: Copper-bind Pfam Description: Copper binding proteins, plastocyanin/azurin family
  misc_feature (52)..(52): Xaa is any aa, unknown, or other
  misc_feature (53)..(53): Xaa is any aa, unknown, or other
  misc_feature (59)..(59): Xaa is any aa, unknown, or other
  misc_feature (64)..(64): Xaa is any aa, unknown, or other
  misc_feature (68)..(68): Xaa is any aa, unknown, or other
  misc_feature (70)..(70): Xaa is any aa, unknown, or other
  misc_feature (103)..(103): Xaa is any aa, unknown, or other
  misc_feature (135)..(135): Xaa is any aa, unknown, or other
MASLSSAAVTAPSFAAPAPARAVVRRRSFTVRASLRKAPAPPPWQCCQRPAXXRCHGPXSAAGXRQRXAXLQAQPVHRQGRRHITFRNTPAFPHTSSSRRRGXERRQRHQISQEEYPHAPGETYSVTLTVAGTYXFYCEPHQGAGMVGKITVN

SEQ ID NO: 54297 - DNA, 651 bp, Zea mays
  misc_feature: Ceres CLONE 1478967-F
  misc_feature: Encodes the peptide sequence at SEQ ID NO. 54298
  misc_feature (320)..(320): n is a, c, t, g, unknown, or other
  misc_feature (322)..(322): n is a, c, t, g, unknown, or other
  misc_feature (356)..(356): n is a, c, t, g, unknown, or other
  misc_feature (425)..(425): n is a, c, t, g, unknown, or other
  misc_feature (430)..(430): n is a, c, t, g, unknown, or other
  misc_feature (585)..(585): n is a, c, t, g, unknown, or other
aagctggagctccccgcggtggcggccgctctagaactagtggatcccccgggctgcaggaattcgtctcacccctagaaaaatgatccgtgtgaaacaccttcgagtcttcgatcttcttgtgcgtcgccaacgcgccggcgccctcctcccctgcgcctcagcctggtaccgtgcctgcgccgccctgtgctccggtcctccgcccctcgcatctgcctggtaccgtgctagtgccgccttcgcatccgtcctcccgctgggtctccgccctccgcggctcccgcttgcgacttttacctgcacggcccagccgcggncngtcgcccgtccggagccactgacccgagtttccngtcagcactccagggaccagcgcctgttcgtcagagtaccacagatctcgtcaagagtctgaggatgangaggnactgcatcctcgatgcatgggattcattgtgacccaaggggtagctgatcatatcatgatgaccagggtgaccatactgcaaggtgtacacatgagggccaagcgggaaatgctcaaagcctcggcagattgcaagttcaacgtcgatttgagcnggagcaaaggaaacaaaacaattggatggtgtgggaaggagtttaacccctgtggcataaccagtt

SEQ ID NO: 54298 - protein, 68 aa, Zea mays
  misc_feature: Ceres CLONE 1478967-F
  misc_feature (47)..(47): Xaa is any aa, unknown, or other
MGFIVTQGVADHIMMTRVTILQGVHMRAKREMLKASADCKFNVDLSXSKGNKTIGWCGKEFNPCGITS

SEQ ID NO: 54299 - DNA, 675 bp, Zea mays
  misc_feature: Ceres CLONE 1478972-F
  misc_feature: Encodes the peptide sequence at SEQ ID NO. 54300
  misc_feature (76)..(76): n is a, c, t, g, unknown, or other
  misc_feature (125)..(125): n is a, c, t, g, unknown, or other
  misc_feature (232)..(232): n is a, c, t, g, unknown, or other
  misc_feature (363)..(363): n is a, c, t, g, unknown, or other
  misc_feature (432)..(432): n is a, c, t, g, unknown, or other
aagctggagctccccgcggtggcggccgctctagactagtggatcccccgggctgcaggaattcgtctcacccctnagaaaacccctagaaaaatggagcttcctgagtgggttgacatttgtgngactgcgaggttcaaggagctccctccttatgaccctgactggtactacatcagggctgcatctgtagcaaggaagatctacttgagacaaggctttggtgttggtngctttcaaaagatttatggtgcccgccagaggaaatgctcacgccacctcacttctgcaagagcagtggtgccattttcacgcacatcctccagcagctgcaggagatgggcatcattgatgtccatcccnagggtggaccgcccatcacctcccaggaaggcgtgatctggaccagtggctggaagggttgctgttaancttgacaatctcatatttgtttccataatgccatgttaaattgtgaaatggctcactttatttcccctttggataagattttttggttaagaaaactcagggctttctacctatggttccaactttttttttccctgagatccttttttttccaacccttttcaaaaaaaaaaaaaaaaaaaggaaacccctggagggccccaatttcccccctatagggggggtcctttttaccccgccctc

SEQ ID NO: 54300 - protein, 101 aa, Zea mays
  misc_feature: Ceres CLONE 1478972-F
  misc_feature (1)..(92): Pfam Name: Ribosomal_S19e Pfam Description: Ribosomal protein S19e
  misc_feature (11)..(11): Xaa is any aa, unknown, or other
  misc_feature (47)..(47): Xaa is any aa, unknown, or other
MELPEWVDICXTARFKELPPYDPDWYYIRAASVARKIYLRQGFGVGXFQKIYGARQRKCSRHLTSARAVVPFSRTSSSSCRRWASLMSIPRVDRPSPPRKA

SEQ ID NO: 54301 - DNA, 681 bp, Zea mays
  misc_feature: Ceres CLONE 1478978-F
  misc_feature: Encodes the peptide sequence at SEQ ID NO. 54302
  misc_feature (226)..(226): n is a, c, t, g, unknown, or other
  misc_feature (227)..(227): n is a, c, t, g, unknown, or other
  misc_feature (236)..(236): n is a, c, t, g, unknown, or other
  misc_feature (237)..(237): n is a, c, t, g, unknown, or other
  misc_feature (254)..(254): n is a, c, t, g, unknown, or other
  misc_feature (292)..(292): n is a, c, t, g, unknown, or other
  misc_feature (422)..(422): n is a, c, t, g, unknown, or other
  misc_feature (465)..(465): n is a, c, t, g, unknown, or other
  misc_feature (590)..(590): n is a, c, t, g, unknown, or other
aaagctggagctccccgcggtggcggccgctctagaactagtggatcccccgggctgcaggaattcgtctcacccctagaaaaaacctgcagccaaccatctaccagcgactcagcgagcgagagcagcacacactgcacgcagctagctaggagcagcagcagcggcggcgatggcggcctccatgatctcctcgtcagctctggcggtggcgcctcagggcctnngcgccctcnnggcgcgcgcctcctccnttcgcgtcgtctgctccaagaagaagatcaagaccgancagccctacggggatggggggtgggctgaccgtcgacgtccacgccaacgggagaaaggggcaggggcagggcgtgtaccagttcgtcgacaagtacggcgcgaacgtcgacggatacagcccaatctancacgaggatgactggtctcccaccggcgacgtctacgtcggtngaaccactggggcttctgatctggggcgtcaccctcgctgggatcctcggcggcggcgcccctcctcgtctaacacacaagcgccctctccgggtaaggatatccaatgcatgcgcttctttgcnattcgtcatgtaaaaatcagggtgtctgtctataatctagccctccatggatgctccaaccttcgtcatgttccaaataatcagggctacc

SEQ ID NO: 54302 - protein, 125 aa, Zea mays
  misc_feature: Ceres CLONE 1478978-F
  misc_feature (1)..(63): Pfam Name: PsbR Pfam Description: Photosystem II 10 kDa polypeptide PsbR
  misc_feature (39)..(39): Xaa is any aa, unknown, or other
  misc_feature (54)..(54): Xaa is any aa, unknown, or other
MGGGLTVDVHANGRKGQGQGVYQFVDKYGANVDGYSPIXHEDDWSPTGDVYVGXTTGASDLGRHPRWDPRRRRPSSSNTQAPSPGKDIQCMRFFAIRHVKIRVSVYNLALHGCSNLRHVPNNQGY

SEQ ID NO: 54303 - DNA, 672 bp, Zea mays
  misc_feature: Ceres CLONE 1478986-F
  misc_feature: Translation starting site: 230
ggagctccccgcggtggcggccgctctagaactagtggatcccccgggctgcaggaattcgtctcacccctagaaaaacgaagaggcgcccaaaccaggtcaagagaacctgctatgctcaggcatcccagatccgtcagatccgccgtaagatgggttgagattatgatcaaccaggcttctacatgtggacctgaaagaacttgttccgaagttcattccagaagttatgggtaaggagatggagaagtctacctccagcatcttcccacttcaaaacgtcttcatccggcagggtgaagatactcaaggcccccaagttcgatcttgggaagctcatggaggttcatggcgactacaaaaaggatgttggtgggaagttaaaaagcctgtcaagggagataaaggtttcccacaacttgctggtgccaaaaagttcgtttgctacttcttatccagggtgaatctgggactgaggttggttaatgactggaccttaagaggtgccaatttgtttcccccccccccctaaaattttttctgggaaccattgtaaaaataaagaattttcctccaaagggcgttaaaaaatcccccgggggggatcttctgaatttcgaaacctggcaaaaaaaaaaaaaaaaaacaccccggcgcctcggggtcccccat

SEQ ID NO: 54304 - DNA, 633 bp, Zea mays
  misc_feature: Ceres CLONE 1478987-F
  misc_feature: Encodes the peptide sequence at SEQ ID NO. 54305
  misc_feature (197)..(197): n is a, c, t, g, unknown, or other
  misc_feature (239)..(239): n is a, c, t, g, unknown, or other
  misc_feature (355)..(355): n is a, c, t, g, unknown, or other
  misc_feature (356)..(356): n is a, c, t, g, unknown, or other
  misc_feature (370)..(370): n is a, c, t, g, unknown, or other
  misc_feature (391)..(391): n is a, c, t, g, unknown, or other
tggagctccccgcggtggcggccgctctagaactagtggatcccccgggctgcaggaattcgtctcacccctagaaaaacaacaccagaatccgcgaatcacagacgcgtctatctcagcttgctgcactgcactaccctgccctgccatcatatcgtacgtgagccccggcgagcgagagcgagggagaagcatgnctgctccgaaactcgcgacgctggcgctggccgtgctcctgncggcgaccgtggtggctcccccggccccgcgtgcgcgcgcgatgtcgtgctccaccgtgtacagcacgctgatgccgtgcctgccgttcgtccagatggggcgggccatgccgccnncagcgtgctgcggnggcatccgcagcctgctgcanaggccaaacacacccccgaccgcgcacatctgcgggtgcctcaagacgtcgccaacgcgccaacggagcggcactacatcagccgcgccgcgcgctgcccagaaggcggcgtccccctgcgtacagatccgcacaacgttactgcacccgattattagtgatgagcctccctgtcccctccgggcaaggatgcatgcatggccctggcaaaaagaaaaaaaaaatgcacgggtatttagcca

SEQ ID NO: 54305 - protein, 146 aa, Zea mays
  misc_feature: Ceres CLONE 1478987-F
  misc_feature (2)..(2): Xaa is any aa, unknown, or other
  misc_feature (16)..(16): Xaa is any aa, unknown, or other
  misc_feature (55)..(55): Xaa is any aa, unknown, or other
  misc_feature (66)..(66): Xaa is any aa, unknown, or other
MXAPKLATLALAVLLXATVVAPPAPRARAMSCSTVYSTLMPCLPFVQMGRAMPPXACCGGIRSLLXRPNTPPTAHICGCLKTSPTRQRSGTTSAAPRAAQKAASPCVQIRTTLLHPIISDEPPCPLRARMHAWPWQKEKKNARVFS

SEQ ID NO: 54306 - DNA, 669 bp, Zea mays
  misc_feature: Ceres CLONE 1479003-F
  misc_feature: Encodes the peptide sequence at SEQ ID NO. 54307
  misc_feature (52)..(52): n is a, c, t, g, unknown, or other
  misc_feature (79)..(79): n is a, c, t, g, unknown, or other
  misc_feature (106)..(106): n is a, c, t, g, unknown, or other
  misc_feature (123)..(123): n is a, c, t, g, unknown, or other
  misc_feature (372)..(372): n is a, c, t, g, unknown, or other
  misc_feature (503)..(503): n is a, c, t, g, unknown, or other
  misc_feature (515)..(515): n is a, c, t, g, unknown, or other
  misc_feature (577)..(577): n is a, c, t, g, unknown, or other
aaagctggagctccccgcggtggcggccgctctagaactagtggatcccccngggctgcaggaattcgtctcacccctnagaaaaaagaagccaccctggccgccntcaccgcctctctcacntctgagaccgcagaaatccgttgtccggtgagtggaagccgcacgaacccatggcctccggcgagcttgcctgcacctacgccgctctcatcctcagcgacgatggcatcgccatcaccgccgagaagatcgccacgatcgtgaaggcggccaacatcaaggtcgagtcctactggccggcactcttcgccaagctcctggagaagcgcaacgtcgaggacctcatcctctccgttggatctggtggcngagctgctccagttgctgctgccgcacctgctggtggtgctgcggctgctgctgccccggctgtcgaggagaagaaggaagaggcaaggaggagtctgatgacgacatgggcttcagccctgtcgactgangagaccccctcnaccaggcatttagcaattttacttgtgctgtcaaagactatcttggcttatggtatggcccnagggctttttgtacaactacccaagttttgagtttttggagatgtggctatggcatgaactcaaaccatctttaggagggtagaaacctgtt

SEQ ID NO: 54307 - protein, 144 aa, Zea mays
  misc_feature: Ceres CLONE 1479003-F
  misc_feature (21)..(100): Pfam Name: Ribosomal_60s Pfam Description: 60s Acidic ribosomal protein
  misc_feature (67)..(67): Xaa is any aa, unknown, or other
  misc_feature (110)..(110): Xaa is any aa, unknown, or other
  misc_feature (135)..(135): Xaa is any aa, unknown, or other
MASGELACTYAALILSDDGIAITAEKIATIVKAANIKVESYWPALFAKLLEKRNVEDLILSVGSGGXAAPVAAAAPAGGAAAAAAPAVEEKKEEARRSLMTTWASALSTXETPSTRHLAILLVLSKTILAYGMAXGLFVQLPKF

SEQ ID NO: 54308 - DNA, 677 bp, Zea mays
  misc_feature: Ceres CLONE 1479012-F
  misc_feature: Encodes the peptide sequence at SEQ ID NO. 54309
atagctggagctccccgcggtggcggccgctctagaactagtggatcccccgggctgcaggaattcgtctcacccctagaaaaaacaccaagaattgtcagcggcggcggttgctccccaaccgacgagactccccagccacaagcaaactgccgattggaaagatagatgaaaggcatgtctcagaggtgcacaacccacctggaggaggccctggatgccctgatggtacgtggccccaggcggacgacctgcagcgctgcagggcctccggcaccgaggccgccttcacccacctaccttccctacgagggctccccgtcaccctccacaagccacgtcgacttcctcgctgacatcataccccaccaccatgaacttccctttcctgacctcaactcacctctcgtggctcgcgaacgactacccctctcctgcgatcactccacaaccctccccgcaggacccgcaggacccgacgacctgccgcatgtaccgcaccgatgctcaactgcatcctcactttcgagctcgccgacaacgtcaacctctaccactcgctcggctcctgcagctaccgcctgctctacacctacgcgcacaaggtgccaccgcctcgacaccatagagcccctattctacacattcaagaccgcttgagtagttcgccatctcca

SEQ ID NO: 54309 - protein, 58 aa, Zea mays
  misc_feature: Ceres CLONE 1479012-F
MLNCILTFELADNVNLYHSLGSCSYRLLYTYAHKVPPPRHHRAPILHIQDRLSSSPSP

SEQ ID NO: 54310 - DNA, 694 bp, Zea mays
  misc_feature: Ceres CLONE 1479013-F
  misc_feature: Encodes the peptide sequence at SEQ ID NO. 54311
  misc_feature (254)..(254): n is a, c, t, g, unknown, or other
gagctccccgcggtggcggccgctctataactagtggatcccccgggctgcaggaattcgtctcacccctagaaaaaagtgcagcagcagtcacgtacagcaaagcagccaggtaccagctgcctgagggttgggtagatgggcaagctgtgctgcagcaacgaggcggaggaggaggccgggttcaacctcctggggctgctggtcgccgccatcatcgcgctggtgttcatgctcctctgcgcgccgccccnagagcgctgcgtcgccgtctacccgtgctgctgacccctcagtcaggggtcgggcctcctcgttctggcgctgccgttgcttggccctcctcctgcgggacgggacttcttgaatccacccaacggtttcggaaaacctttccccttggggcggggaactttaaagtttttgggggggggggaccaaaacggaccgcgtttgtttctcccccctacctttttggcccccccaaaaattttccccccccggtaaataccggggggccccccccaggagaaacttttttttttggggaaaaaggggggtttttctttttttttcccccaaaaaaaaaaaaaaaaagaggccccggggggccccccccccccccccaagggggggtattcaccccccccccccgcgcggcgtttttttttcccgccgggggggaaaaaaaacc

SEQ ID NO: 54311 - protein, 49 aa, Zea mays
  misc_feature: Ceres CLONE 1479013-F
  misc_feature (39)..(39): Xaa is any aa, unknown, or other
MGKLCCSNEAEEEAGFNLLGLLVAAIIALVFMLLCAPPXERCVAVYPCC

SEQ ID NO: 54312 - DNA, 663 bp, Zea mays
  misc_feature: Ceres CLONE 1479015-F
  misc_feature: Encodes the peptide sequence at SEQ ID NO. 54313
  misc_feature (276)..(276): n is a, c, t, g, unknown, or other
  misc_feature (278)..(278): n is a, c, t, g, unknown, or other
  misc_feature (282)..(282): n is a, c, t, g, unknown, or other
  misc_feature (285)..(285): n is a, c, t, g, unknown, or other
  misc_feature (290)..(290): n is a, c, t, g, unknown, or other
  misc_feature (291)..(291): n is a, c, t, g, unknown, or other
  misc_feature (391)..(391): n is a, c, t, g, unknown, or other
ggagctccccgcggtggcggccgctctagaactagtggatcccccgggctgcaggaattcgtctcacccctagaaaaactcccatttctctgcacgcagctcagtctcgtccatccagtgctgtagaattttctttggtctgttggcaaggcagcatgaaacccctcagctgccggcagggagggggcctcctgggctcacgaggtcagcaggccctccgtgagaactcgggcgctcctacggcgccggagctgcctccgccacacggaggcaggncngccngcnaaacnnagcgtggcgctgagtgccgcggctcggcggccgaggaccccataaggagagtcatgttcttggctcccctgggtcacacataggaacacaaacgggcggncgagatctgggcatgcaagcttgcatggccatgtctttgtcagtcaaatctgcaaacacccaactgtaaaaaagaactggagcctggtctggtaatcatgggagtttgctgctgccttgcccccattaaaaaaatgaacgcagtgaagagctggtaaactagctaggtagaataaatataccatatattgggtatgaaggggggggaaataaaattaaaaaaacaaggtacctaaacccaatgttcttgggttttgggggaagtggctttta

SEQ ID NO: 54313 - protein, 72 aa, Zea mays
  misc_feature: Ceres CLONE 1479015-F
  misc_feature (41)..(41): Xaa is any aa, unknown, or other
  misc_feature (43)..(43): Xaa is any aa, unknown, or other
  misc_feature (44)..(44): Xaa is any aa, unknown, or other
  misc_feature (46)..(46): Xaa is any aa, unknown, or other
MKPLSCRQGGGLLGSRGQQALRENSGAPTAPELPPPHGGRXAXXTXRGAECRGSAAEDPIRRVMFLAPLGHT

SEQ ID NO: 54314 - DNA, 678 bp, Zea mays
  misc_feature: Ceres CLONE 1479020-F
  misc_feature: Encodes the peptide sequence at SEQ ID NO. 54315
  misc_feature (1)..(1): n is a, c, t, g, unknown, or other
naaagctggagctccccgcggtggcggccgctctagaactagtggatcccccgggctgcaggaattcgtctcacccctagaaaaaatccactgcggcacgcgtcccgcctctggtttgcttgcctcccagatcttgccaactaattggaggcagccgagctgatctcccatcccgcaacgcgccgtctcgacggcggatcgttttcttctgcttctactgcgtgatctttgggcaagaagataagacacgtccaagcgtcgccacagtcaagggcggcttggttgcagtcaagatggggaaggacagagaatctgccaagctgaaggaggagaaggggtccaaggatgagatccatatgaaggtcaagagcaagggcgagccgtccggcgaggaagacggcaaggaggaggtcgaggtagagattgaggccaagtttgttgagaaggaagaggtcacaggctcgggtgacagtgcgggaggaaagggtaccaagaagaaggatacaaaggagaaagacaagaaaaagaaggaaggtggtgacgattcagggaaggcagaggaagacaataagggtaaagcgaaggattcggagggcaagggccaagtgaagaatgaaaagaaggatggtgctggggacgacggatgccaggagaagggcaaagaaaagtaagataaga

SEQ ID NO: 54315 - protein, 125 aa, Zea mays
  misc_feature: Ceres CLONE 1479020-F
MGKDRESAKLKEEKGSKDEIHMKVKSKGEPSGEEDGKEEVEVEIEAKFVEKEEVTGSGDSAGGKGTKKKDTKEKDKKKKEGGDDSGKAEEDNKGKAKDSEGKGQVKNEKKDGAGDDGCQEKGKEK

SEQ ID NO: 54316 - DNA, 694 bp, Zea mays
  misc_feature: Ceres CLONE 1479028-F
  misc_feature: Encodes the peptide sequence at SEQ ID NO. 54317
aaagctggagctccccgcggtggcggccgctctagaactagtggatcccccgggctgcaggaattcgtctcacccctagaaaaaactgacgttcattcggcttgcttgattgttccaggtattcgcagtcgaccgtgtcctcggagcacgatgaaggttgttgctgcctacctgcttgctgtcctcgctgggaatgccagcccctccgctgaggatttgactggcattctggagtcagttggctgtgaagttgaacatgaaaggatcgaactgctgctgtcccaactgagcggtaaggacatcaccgagctcattgccgcgggcagagagaagtttgcttcattcccatgtggctgcggcggtgtcgctgttgcggcaggtgcacctgctgctggcggatctgctcctgcagctgacgcaaaaaaagaagagaaggtggaagagaaggaaaaaagccatgatgatttgggcttcagcctcttcgactaggttgcacagtcatcacaagttttgtttcggggagtggaattcaaggggaaaccaagagccatgtttaaaattttacccttttttttatggttggaaaagaactggaaaaaactgctaatttggcccctgggatttcggaaaattcccgcttgtagattcgctattaatgggttgggaattttccctccgggaacccaatattttt

SEQ ID NO: 54317 - protein, 112 aa, Zea mays
  misc_feature: Ceres CLONE 1479028-F
  misc_feature (17)..(111): Pfam Name: Ribosomal_60s Pfam Description: 60s Acidic ribosomal protein
MKVVAAYLLAVLAGNASPSAEDLTGILESVGCEVEHERIELLLSQLSGKDITELIAAGREKFASFPCGCGGVAVAAGAPAAGGSAPAADAKKEEKVEEKEKSHDDLGFSLFD

SEQ ID NO: 54318 - DNA, 654 bp, Zea mays
  misc_feature: Ceres CLONE 1479232-F
  misc_feature: Encodes the peptide sequence at SEQ ID NO. 54319
ctccccgcggtggcggccgctctagaactagtggatcccccgggctgcaggaattcgtctcacccctagaaaaagtttggccgcgacccctgcgacgcgcatttgttgagaggcggcctactacgaactaccgtcgatggcgttcctcgcgcctccgcagttcaagtggcccctttccacccgtgcggcggcggtgttcagggagcccaccggcggcgcaggctcccgccccagtcggataaactgttctttctcctccacggcagtcgtcgatgcagagtgcttatccgtcgggccgccgccttctcctcaccgaacgcttccgggctgtttcggtgaggcacttcttaacaaggaggcagtggtggcggccgcggccgcggaagccgtcgctctggctcgcgcagcggccgaggtcgccggagaagtcgcccggatggcgcagaatgatcacccggctgccttaccgccgcgcgatgacacggtggatagcttcctgtcaagagaggtcctccgctccgaggtggggctggatgccaggcgcgccgggctcgtcgaaatgctggagggcgaagagcacagcagcattttcagcgacgaatccgaggatgacgatgatggcgggcatagcatagccgtaacggtgaagtcggc

SEQ ID NO: 54319 - protein, 172 aa, Zea mays
  misc_feature: Ceres CLONE 1479232-F
MAFLAPPQFKWPLSTRAAAVFREPTGGAGSRPSRINCSFSSTAVVDAECLSVGPPPSPHRTLPGCFGEALLNKEAVVAAAAAEAVALARAAAEVAGEVARMAQNDHPAALPPRDDTVDSFLSREVLRSEVGLDARRAGLVEMLEGEEHSSIFSDESEDDDDGGHSIAVTVKS

SEQ ID NO: 54320 - DNA, 672 bp, Zea mays
  misc_feature: Ceres CLONE 1479234-F
  misc_feature: Encodes the peptide sequence at SEQ ID NO. 54321
gctggagctccccgcggtggcggccgctctagaactagtggatcccccgggctgcaggaattcgtctcacccctagaaaaaattcccatcagagaagagataaccacacgtccacacaccacagaccacacgcacggtacagcctctccgcagctgcaggtgcctgctgttctccgacgagaccccaagaactcgccaacctatcccaattcccagccacccttccctctttcacaatgctggcctccgccgccaccgtcaagccctccaccgccgcggccgcggccacctgcaaggcggccttcaagccgctccacctccctcccctccccgccgccgccggcctcaggccgctctccctctccgtctccgcgcgcccgctgtaccgtcaggagcatgtcctggcatccgtggcggtggcggcggctgggcacaacgaacgcgccacgtcccccgcgccgccgtccgccaccgatgacggcgcccggccgctggaggtcgccgcgccggcggaaacgggtcggcgcgccaagatcggggtctacttcgccacgtggtggggcgctgaacgttatttttcaacatctaacacaagaaaggtcctcaaacggcgttcccggaacccggtggttcaggtcggaggtttctcccttcgccggcgggtttccccca

SEQ ID NO: 54321 - protein, 145 aa, Zea mays
  misc_feature: Ceres CLONE 1479234-F
MLASAATVKPSTAAAAATCKAAFKPLHLPPLPAAAGLRPLSLSVSARPLYRQEHVLASVAVAAAGHNERATSPAPPSATDDGARPLEVAAPAETGRRAKIGVYFATWWGAERYFSTSNTRKVLKRRSRNPVVQVGGFSLRRRVSP

SEQ ID NO: 54322 - DNA, 811 bp, Zea mays
  misc_feature: Ceres CLONE 1479235-F
  misc_feature: Encodes the peptide sequence at SEQ ID NO. 54323
  misc_feature (20)..(20): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (811)..(811): n is a, c, t, g, unknown, or other
cttatttttctttttaagcntgcgcaccctcttnnnnnnnnnnnnnnnnnnnnntaagctggagctccccgcggtggcggccgctctagaactagtggatcccccgggctgcaggaattcgtctcacccctagaaaaaaagcggcactcgcacgatcaatgtacacattgcccgtccgcgccaccacatccagcatcgtcgccagcctcgccacccccgcgccgtcctcctcctccggctccggctccggccgccccaggcccaggctcatccggaacgcccccgtcttcgccgcccccgccaccgtcgtgggcatggaccccaccgtcgagcgcttgatgagcggggtccagaagttcccgaccgaggtctatgacaagaaagccggagctgttcgagccttctaaggccggccagaaccccccgtacatggggggggcggggggggggggaaatcacgaaagaacccaatcaaccacccctggggcctggtggcccggtcgaggcaaattcgaccgacggagacagcccccctcccgggggccccaccccccggtatcgggatcccaggtaagtccgggcacccggcgggcgcgccatgagaaaacacgcaggggggggtattgcgccggcgcgggccgggtcgctctgctggcgaccttgaggtccacagccctgacttccgctattctcctcccgcgggtgacttccttctcctctctcagcgggcgtgtgttcggcgccccccgcctcactctccaaccttcctcctggctaataacccgggggccacacggcacccccccgcctn

SEQ ID NO: 54323 - protein, 30 aa, Zea mays
  misc_feature: Ceres CLONE 1479235-F
MDPTVERLMSGVQKFPTEVYDKKAGAVRAF

SEQ ID NO: 54324 - DNA, 658 bp, Zea mays
  misc_feature: Ceres CLONE 1479239-F
  misc_feature: Encodes the peptide sequence at SEQ ID NO. 54325
tccccgcggtggcggccgctctagaactagtggatcccccgggctgcaggaattcgtctcacccctagaaaaaagacgcatcaaaccgccctcctctgtccctccctctcccgtctgccccctcgcatccccaaattaagccccgcgcgcaaggcagcaaacgcgccgcgcaccggaaggccccggggagctgcacgaggtggccccattgcggcatggctgctacggccgccgccgctggcgtcgagttcccgctcattggcgttgccgtggccacgctcatcgtgacggtccttgtcgcggccgtgatgcgccgccgccgccgtccctggcaccaggcgcctctggtggaggggaaacccgcaccagaggcaggctgcgcggtcagcgatggcgggacggacgtcatcatcgtcggcgccggggtagctggatctgcgctgggatacacgctcggaaaggatggccgtcgggtgcatgtcatcgagagggatctgacagaacctgacagaattgtgggcgagctgttgccacctgggggttacttggaattaattgagctgggcctccaagaatgtgtggaagaaattgaagcccaaccgcgggcttggttacgcatttattccaggagggaaggaacacaaagcctggcttaatc

SEQ ID NO: 54325 - protein, 146 aa, Zea mays
  misc_feature: Ceres CLONE 1479239-F
  misc_feature: SWISSPROT Homolog: EC 1.14.99.7 Squalene monooxygenase
MAATAAAAGVEFPLIGVAVATLIVTVLVAAVMRRRRRPWHQAPLVEGKPAPEAGCAVSDGGTDVIIVGAGVAGSALGYTLGKDGRRVHVIERDLTEPDRIVGELLPPGGYLELIELGLQECVEEIEAQPRAWLRIYSRREGTQSLA

SEQ ID NO: 54326 - DNA, 655 bp, Zea mays
  misc_feature: Ceres CLONE 1479243-F
  misc_feature: Encodes the peptide sequence at SEQ ID NO. 54327
  misc_feature (655)..(655): n is a, c, t, g, unknown, or other
tggagctccccgcggtggcggccgctctagaactagtggatcccccgggctgcaggaattcgtctcacccctagaaaaaaagtcatccccctttcctctaagctcgttccatggagaactcttctcacaagcggacgcgggaggcggccgacctcgccgccggaggctgtggagaggagggctcgccgcaggccgacgccaagaggctgcggccgcaggacctgctcgacatgctggaggacgacaccgacacggccgcggtcggcgacctaccgtcggtcatgcggagcctgtaggaggagatagctagcttcgacgaggccgcggagacgccggcgccgacatcggggcagcagccagagctgggcttcctactcgaggcctcggacgatgagctggggttgccgccgacgggcgccgcctcctcttcgtcggaggaggctgggcgcgcgggggcaccggagcccgcgctcgacggccagatctggggcttggagggcggaggtgctcctttccttcttggccggcggcggcatggactgggcagcggctttcgggtctccgtcgtggagcgcggtggcgacggaccctggcccgaccatgctgtccttcgcaggcccgtcctcctcccgccacgacgccgaggtgcgactcn

SEQ ID NO: 54327 - protein, 61 aa, Zea mays
  misc_feature: Ceres CLONE 1479243-F
MENSSHKRTREAADLAAGGCGEEGSPQADAKRLRPQDLLDMLEDDTDTAAVGDLPSVMRSL

SEQ ID NO: 54328 - DNA, 657 bp, Zea mays
  misc_feature: Ceres CLONE 1479248-F
  misc_feature: Encodes the peptide sequence at SEQ ID NO. 54329
  misc_feature (403)..(403): n is a, c, t, g, unknown, or other
ggagctcaccgcggtggcagccgctctagaactagtggatcccccgggctgcaggaattcgtctcacccctagaaaaaacttccgtccgttcccccgaactctctctcctcctcgcggccacctcccatccccgttccttcccctccatctcatcaccgccgccagcgccaaaaccctacccacccaccgatggcctccccggcgccggcctcccccgcggccgcggcggcgcactgccccccgccgcgcatcgggctcgcgggcctcgccaccatgggccagaacctggccctgaacatcgccgagaaagggttcccgatctccgtctacaaccgcaccgccgccaaggtggactccacgctgtcccgcgcgcgggacgagggctcgctgccggtgctgggncaccgcgacccccgcgggttcgtgctgtccctcgcgcgcccgcgcgccgtcgtgctgctcgtccaggccggccccgccgtcgacgacaccatccaggccctctccccctacctcgagcccggggacgccatcgtcgaccgggggaaagagtgttaccagaacacggagcgccgcatccagaaggcggcggcgcgcggccgcctggtacctcgggaaggggcgtctcccggcggccaaagagggcgcgcggaacc

SEQ ID NO: 54329 - protein, 155 aa, Zea mays
  misc_feature: Ceres CLONE 1479248-F
  misc_feature (18)..(153): Pfam Name: NAD_binding_2 Pfam Description: NAD binding domain of 6-phosphogluconate dehydrogenase
  misc_feature: SWISSPROT Homolog: EC 1.1.1.44 Phosphogluconate dehydrogenase (decarboxylating)
MASPAPASPAAAAAHCPPPRIGLAGLATMGQNLALNIAEKGFPISVYNRTAAKVDSTLSRARDEGSLPVLGHRDPRGFVLSLARPRAVVLLVQAGPAVDDTIQALSPYLEPGDAIVDRGKECYQNTERRIQKAAARGRLVPREGASPGGQRGRAE

SEQ ID NO: 54330 - DNA, 676 bp, Zea mays
  misc_feature: Ceres CLONE 1479249-F
  misc_feature: Encodes the peptide sequence at SEQ ID NO. 54331
aagctggagctccccgcggtggcggccgctctagaactagtggatcccccgggctgcaggaattcgtctcacccctagaaaaagtccatccgtatttccgtcacaactcacaacccgagccccccaaacccgaagcagcaggagctcccctgaccttgctccgcctccgatcaaggaaaaggaagatgagctactacggccagcagccccccgtcggcgtcccgccgcagcaaggtgcggcgccggctcttcccgccctcgatccatctgctttattatctccgtccgaacctttgtgttccttcgctcgctttccgtggtagggatatttaataaggctaattatcttattaatatttgggttgtggatcttgatttctccaggctacccggggaaggacggctacccgtcagtgggccacccgccggccggctaccccccgccggcgcagggctacccgccgcagggctacccgcagcagggttacccacagcagggctacccggcgcagtacgcgcagccgcctccacagcagcagcagagcagcgggccttccttcatggaaagatggtatgttcttcatcctccccggtccctccactcatgtgccgctcttcgaaatttcctcgccgtattagatcaaaagtagggcggggctaaacgggcaagatccgt

SEQ ID NO: 54331 - protein, 29 aa, Zea mays
  misc_feature: Ceres CLONE 1479249-F
MERWYVLHPPRSLHSCAALRNFLAVLDQK

SEQ ID NO: 54332 - DNA, 827 bp, Zea mays
  misc_feature: Ceres CLONE 1479251-F
  misc_feature: Encodes the peptide sequence at SEQ ID NO. 54333
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
cttttttccttgcgcctcgcgctgttgcctgtgattacaccccnnnnnnnaaagctggtgctccacgcggtggcggccgctctagaactagtggatcccccgggctgcaggaattcgtctcacccctagaaaaatctgctccatttgctcggggagccagctgattaataaagcatttaggcgcgcgcgaagcaacaaactaagtctgggcgagctatggccggtagcaacggaactctgatgctcgcactccgcatcgtcctcttctgcgcccacgcctccgtggccaccaacttgctccctctcgtcacaaggccatgcgcctactccctgccaagaaccatcctcgccgccagcggcctcaaacctcgcctcatctcctgcgcggacgacggctccccccaggcccatctgtctgatggcaatggaggccacaacatgggctggtagcggaggcatgtaaaaaaaccccccgacctggttgtcgtgcggcggagacccgtctccccatcccaaggcgctacccgccccttcccgctgctgacccggtgaacgcccggttgttcgaatactggccggccggcaactttcctcgactcaccgaaacccatgggcaaagccgccacccgggacattcgccccccctaatgatcccgggggggcccggcctgggggaacgcgaatcgttggatgccccacgggatacaaccacacgccacccgcatgtgccgctttgactctgcaagggccgcccccctcccctgcaagttcccggataaacaccgcgagcctcggcgttgttcctagacctcagcgcgggggttggc

SEQ ID NO: 54333 - protein, 77 aa, Zea mays
  misc_feature: Ceres CLONE 1479251-F
MAGSNGTLMLALRIVLFCAHASVATNLLPLVTRPCAYSLPRTILAASGLKPRLISCADDGSPQAHLSDGNGGHNMGW

SEQ ID NO: 54334 - DNA, 809 bp, Zea mays
  misc_feature: Ceres CLONE 1479254-R
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
nnnnggcgattgggtacctcgagcgtctcgtttttttttttttttttaaaaatagaagtaagattattacctcaaatatattgtagagatcaacttaaaaatatcttctaacatttctagatgcaaaatcctcaatgatggcttcaatattgacatcatctaataatttcttctcaatacataaagttgctagttcgtttaacctttcttgagacattgtagaccttaaataattcttcaataacttaagctttgagaagctcctttcagctgatgccacagttattggtatagtaaataatatccgataaacaacaaatatattgggacagcaatccattctcctaacaaactcaaaaatatattggtatagtaaataatatccgtttctatcctatattcctattgaactttgtgtacggtaggcccctgggagatgggggcccaggtcggccgctcctcccgccctgcctcaggcagggccctgaaagatgctcgcccatgtgctaagtatggcgctggacaaatgattcgacaagtggattaacaagctcaggtgcttcatcctgagggcagtgtccaacatctggcaagacaacaaaatcttcaactgtatcaaaagatgcataggctcttccaagctcaacaggctcccatgggtccttctccccccatgctaccaaaactggacacttcaccaatggaagcaactcttcaggtagaggtcctccagaatagcagatgaactcaaggaatacatccactgctccaggatcaagacccaggctgtagaataatctgaactagct

SEQ ID NO: 54335 - DNA, 763 bp, Zea mays
  misc_feature: Ceres CLONE 1479255-F
  misc_feature: Encodes the peptide sequence at SEQ ID NO. 54336
  misc_feature (36)..(36): n is a, c, t, g, unknown, or other
  misc_feature (37)..(37): n is a, c, t, g, unknown, or other
ccaatttctttccccaggacccccgaccccccaaannaccaaccaaaataaactgggactccccgcggtggcggccgctctatactagtggatcccccgggctgcaggaattcgtctcacccctagaaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtcgcagcccgccgtggcgccggccttcacttaaaggcaggtgcccgtcgctggtttgcatggtttcatgagaccccccccagtggaccgcacgccgtggacctacccggtgtacggtggggcccccaaaggctacgaccatgggcggggccgtcccccgctgaggccgcccgtcaagggtcaggatcgctgcgagtcgccgctttccgcctcgccaagcccatacttgtaactccataaagaaccatatgggggttcccctgaaaggggtttccagaaagagggggtaacaaccctggcaatatggaaaccctttaaactagacctctggaaaaaggacccccgccaaacactatttcttcgcggcgggggg

SEQ ID NO: 54336 - protein, 45 aa, Zea mays
  misc_feature: Ceres CLONE 1479255-F
MAPAVGLKRSATQTITLPPPDTRLAVRDVMRSTIPSQPAVAPAFT

SEQ ID NO: 54337 - DNA, 736 bp, Zea mays
  misc_feature: Ceres CLONE 1479256-F
  misc_feature: Encodes the peptide sequence at SEQ ID NO. 54338
  misc_feature (35)..(35): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
ctatttttattcttctcttccccttacacaccatntnnnnntcannnnnnncaaagctggcgctccccgcggtggcggccgctctataatagtggatcccccgggctgcaggaattcgtctcacccctagaaaaaccttcgtctccaaccagatcgccccccgccgcataaatcccccgctgacacccgatcgagcaaaccctcgcttacctcccgtcacgtcgcgtccgaacggcgacgctgcgccgtgatggacgccttcttcggcaagggcggcggcggcggcggattccgcggcgccaagtgcaagacgctgctgaagctgtcgatcccgcggataaagctgctgcggaaccggcgggagctgcagctgcgccagatgcgccgggacatcgccaagcttctcgaggccggccaggaggccaccgcgcggatcagggtggagcacatcatccgggaggagaatatgatggccgcgcaggagatcctcgagctcttctgcgagctcatcgctgtgcgcctgcccatcatcgagacccaaagggagtgtcctattgatctccaagaagcaatatccaagtatctggtttcgctgctccccagatgtgcaagatcaaccttgaaactgatacaaggttcaaatggatgttttgcaacttaaattatgggaaaggaaatttgtccgcttggcagctttcagaagttagatgccctggaattggcgggggacacaata

SEQ ID NO: 54338 - protein, 136 aa, Zea mays
  misc_feature: Ceres CLONE 1479256-F
  misc_feature (25)..(136): Pfam Name: DUF292 Pfam Description: Eukaryotic protein of unknown function, DUF292
MDAFFGKGGGGGGFRGAKCKTLLKLSIPRIKLLRNRRELQLRQMRRDIAKLLEAGQEATARIRVEHIIREENMMAAQEILELFCELIAVRLPIIETQRECPIDLQEAISKYLVSLLPRCARSTLKLIQGSNGCFAT

SEQ ID NO: 54339 - DNA, 795 bp, Zea mays
  misc_feature: Ceres CLONE 1479257-F
  misc_feature: Encodes the peptide sequence at SEQ ID NO. 54340
  misc_feature (8)..(8): n is a, c, t, g, unknown, or other
  misc_feature (39)..(39): n is a, c, t, g, unknown, or other
  misc_feature (40)..(40): n is a, c, t, g, unknown, or other
ctttgttngtggcggtgtgcgctttttcctggggggatnntacagccttgctaaaactggagctccccgcggtggcggccgctctatactagtggatcccccgggctgcaggaattcgtctcacccctagaaaaaaacccagccgcccattgccggcattgctcgcagcgctagcttcttgtgctcatcactcgtctccgaccaagatcagcaaggacggtatggctctcgaagcagcgtacgactacctgcacgtcgccgtcgtccagtgcacgcccacacaagaagcagcagtcctcggcgtcctcctcctcctcgccatccggctagccgcggctgcaaaaaactcgtccgcgacctcccccaaatggaagcatcacaggctgccgccgacgccttcggggaagctccccatcatccggtacctccatctcatccggcttccacgctgaacgtcaaatttagaaaaacccccccccccccccccggccacaacgagaatgaatcttggtggcatgtacggcgacggtgacccaaacaccgtagcggtttatcctcccccggtctccttaagcaggtgctctcccgcagctcgaattaccgtccttggtcgcccttgaccgagggaacactcgcccgccaaacattccatcccactcacttctttccgcgggaacgttggggccttcttcggcccctaagcggggccaaaacccgagcccctactgaatcgcgcacaacagacgtaactcccaataaccacccctgtgcttaccacatcccccaacacttagg

SEQ ID NO: 54340 - protein, 76 aa, Zea mays
  misc_feature: Ceres CLONE 1479257-F
MALEAAYDYLHVAVVQCTPTQEAAVLGVLLLLAIRLAAAAKNSSATSPKWKHHRLPPTPSGKLPIIRYLHLIRLPR

SEQ ID NO: 54341 - DNA, 662 bp, Zea mays
  misc_feature: Ceres CLONE 1479265-F
  misc_feature: Encodes the peptide sequence at SEQ ID NO. 54342
tggagctcaccgcggtggcggccgctctataactagtggatcccccgggctgcaggaattcgtctcacccctagaaaaaccttcccctccaccacctcgtccatggcctcctgctcgtgccgcctccgccccgccgtcgtcgcccgcgcgccgcgccagcagccgcggggccggcgcgcgctccggcgcttcgatgaggtggaaagggtgtcgaagaaaacgcgcggcatcggaagcggtgcggcgtcggcgctggcgggtcgcaaccgtcttcctcccgcagggaaaagggggcttttccgccaattccaggaaccccaggttggctgaatttgatgaaccttaaaaagaacaatttccttaaggcctgcggccaggggcttttgggcctctattccccacccaaattggggttttccccggggaaaacccaagggaaaattttaagggaggggggagggggttttttgagggggggagagggggaaactttttgaaaaaaaggcgattttggggctaaacaccccacccccccgtttttaattttaaaaaaaaagggggaaaaaataaaaaaaaaaatttttttttcccccgggttttttccctcgggggggggggaaaaaggggaacattttgggtgcgccaacatcttgtaagaaaaa

SEQ ID NO: 54342 - protein, 75 aa, Zea mays
  misc_feature: Ceres CLONE 1479265-F
MASCSCRLRPAVVARAPRQQPRGRRALRRFDEVERVSKKTRGIGSGAASALAGRNRLPPAGKRGLFRQFQEPQVG

SEQ ID NO: 54343 - DNA, 654 bp, Zea mays
  misc_feature: Ceres CLONE 1479266-F
  misc_feature: Encodes the peptide sequence at SEQ ID NO. 54344
tggagctccccgcggtggcggccgctctagaactagtggatcccccgggctgcaggaattcgtctcacccctagaaaaagttgcccaccacccagagcacgcggcggcttgtcgccgtgcgcgccgccaccaccaccacacgaggcgccggagaaagacatcaagcgcacgcccatggccatgacgcctcacgcctcggcggcaaccgtagccgttacccctgcgttgcgctttccccacactttgtctgccacgggcctctcctcaccgcctctggctgggggctgcggcggctgccgggttcggttccggcccagccagcgcggccgaggcacgcaggggcggcgaggtggctctcacgtgtcgcgcgtggggggcctgctgggcaccgtattcggcgggggcggtcgcgacgacggggaggccacgcggaagaagtacgcagacaccgtggcgcgtatcaactccatggagcccgaggtctccgcgctctcagacgctgatttgcgtgcacgcaccgctgcgctccaggaccgtgctcgctccggggaatccctggattcccttctccccgaagcatttgctgttgtgagggaggcttccaagagagttctaggcctccggccctttgatgtgcagttgattggtggtatg

SEQ ID NO: 54344 - protein, 160 aa, Zea mays
  misc_feature: Ceres CLONE 1479266-F
  misc_feature (70)..(160): Pfam Name: SecA_DEAD Pfam Description: SecA DEAD-like domain
MAMTPHASAATVAVTPALRFPHTLSATGLSSPPLAGGCGGCRVRFRPSQRGRGTQGRRGGSHVSRVGGLLGTVFGGGGRDDGEATRKKYADTVARINSMEPEVSALSDADLRARTAALQDRARSGESLDSLLPEAFAVVREASKRVLGLRPFDVQLIGGM

SEQ ID NO: 54345 - DNA, 659 bp, Zea mays
  misc_feature: Ceres CLONE 1479268-F
  misc_feature: Encodes the peptide sequence at SEQ ID NO. 54346
  misc_feature (414)..(414): n is a, c, t, g, unknown, or other
ggagctccccgcggtggcggccgctctataactagtggatcccccgggctgcaggaattcgtctcacccctagaaaaagggtcttccccattccccctccactccccccctgggttttccccttcctttaccccccatcagatcttcccccatatctctgtcctgcatcactcgccgccatccactcccgatccaaacccgagagctcccacctccgccgccctgttcgctcgtccgccttttcactccccgtagctagctgctgtcgcggagcaaccccgcgattccaagaaaagcaacttggtcaagaaagagtgcaagaaaggaggacggtgctgacgatgatggcgataagccaccccatgattcgccccatcattccgtcgcctccggggcctgcgcgctagctgctanaagggcctcgccgtccgtcatggtggtggtggtggtggtgtgcgcggggcgggaggggaggggaggggagtcttcactgcgccgccacaatgccacagtaccaggagctgccctgcggcgggcaggagctcgatatcgacaccgcgctcaaggatggcatcctcgggggcgcgcttgaccccgtgggtgcgggcggcgggggacaatggcaagcacccccggggaactgcccaggatgatggaca

SEQ ID NO: 54346 - protein, 49 aa, Zea mays
  misc_feature: Ceres CLONE 1479268-F
MPQYQELPCGGQELDIDTALKDGILGGALDPVGAGGGGQWQAPPGNCPG

SEQ ID NO: 54347 - DNA, 667 bp, Zea mays
  misc_feature: Ceres CLONE 1479269-F
  misc_feature: Encodes the peptide sequence at SEQ ID NO. 54348
ggagctccccgcggtggcggccgctctagaactagtggatcccccgggctgcaggaattcgtctcacccctagaaaaaacgcacgatagccgccgccgtcgaccagagcactcccccgtcgtcgccacgatgtcgtctgagcctccacccgcctcctctgccgccgccggagaggaactcgctgctgacctttccgccgctaccctcagcaagaagcagcagaagaaggacgcgaggaaggcggagaaggcagagcagcgccagcgtcagcagcagcagcagcagcagccggcggacgccgaggacccgttcgcggccaactacggcgaggtccccgtcgaggagatccagtcaaaggccatctccggccgctcgtggtcccatgtcggcgacctcgacgactccgctgggggccgctccgtgcttatccgcggagccgcgcaggccatccgtccggtcagcaagaagatggctttcgtcgtgctgcgccagagtatgagcaccgtgcagtgcgtgctcgtcgccagcgccgaacgccggcgtcagcacgcagatggtgggcttcgccaccgccctcagcaagggagtccatcgtccacggttggggccggcgtctcccctccccaaggagcccctccagggccccccccccagcaggttgagatcc

SEQ ID NO: 54348 - protein, 179 aa, Zea mays
  misc_feature: Ceres CLONE 1479269-F
  misc_feature: SWISSPROT Homolog: EC 6.1.1.12 Aspartate--tRNA ligase
MSSEPPPASSAAAGEELAADLSAATLSKKQQKKDARKAEKAEQRQRQQQQQQQPADAEDPFAANYGEVPVEEIQSKAISGRSWSHVGDLDDSAGGRSVLIRGAAQAIRPVSKKMAFVVLRQSMSTVQCVLVASAERRRQHADGGLRHRPQQGSPSSTVGAGVSPPQGAPPGPPPQQVEI

SEQ ID NO: 54349 - DNA, 768 bp, Zea mays
  misc_feature: Ceres CLONE 1479270-F
  misc_feature: Translation starting site: 349
  misc_feature: SWISSPROT Homolog: EC 2.1.1.33 tRNA (guanine-N(7)-)-methyltransferase
  misc_feature (30)..(30): n is a, c, t, g, unknown, or other
  misc_feature (36)..(36): n is a, c, t, g, unknown, or other
  misc_feature (37)..(37): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
tatgattaaaggggggatttataatctccncttccnnccccgcatnnnnccaaagctggactccccgcggtggcggccgctctatactagtggatcccccgggctgcaggaattcgtctcacccctagaaaaagcgccacacccacacccacaccgcaccaaccaaccccggccggccagccagcccacgagccccatcccgccatccgcccgcgcggcgagcgcagagccgagccgagctgccggaacgcaggcagcggccaccgggaggcctccgaaacgcagcggaacacctgaggaggcggcttcccggcgaatgctctaggaggaggcgcggcgccggcggagatggggtccaagtacacgcgcgggtgctgcggctggctgatcgtggcgctgattgcggcgctggtggccacggccgcgatgttcgccatcatgaaatgcaagcccgggggattgtaaatcaaccctctgaccggagccggggccgcccccgggcccatccactcccagtaacggcgacgccgctcggggtcgacgctccaattcctccctaggtcccaaaaaggtggggaagcctgggaaaacaaccccaatccccggggcgcggtggaactcccccggttaaccccaacgggaaaagaaacccgggactggcatccttttcccaggggaaatggtatgaatgcttgggggcatccacatgcaaccccccaccctttccccgaatgggcattccacgggcaaaccgggggcctccccccg

SEQ ID NO: 54350 - DNA, 666 bp, Zea mays
  misc_feature: Ceres CLONE 1479271-F
  misc_feature: Encodes the peptide sequence at SEQ ID NO. 54351
tggagctccccgcggtggcggccgctctagaactagtggatcccccgggctgcaggaattcgtctcacccctagaaaaagttggacaaggtctagttcggtgttgtgtatggaacggtcgtcactgagtcatgcacgatttggtatccgtgtgtttatgttcgccggtttgaggaaaaagcggcggcaggccaggccagcagagcgcagaggaccgccgctcggaaagtgcggagccgtttcccctctagctgctcatgctctctgcttgcctccgtccactcacagcccacgtccacgcctcgcgctcttctccaggctcccaggtgctccccgatcaatcgcttccgctgctagcgcgcgcgcgatccccgaggtcgcgcgcttgatcgcgctcaacgccatgtcgtccgccccccccgggtatggcggcggcggcggcgcgggaagcggcgccgagccccacggccacgccgacttcctgctgcaccaccatgcacagcacgtcgccgcgcagcagctctaccacgtgccccagcacagccgccgcgagaagctgcggttcccccaagacgacgcgcccccacacgcctccgcttccgtcccgcagcagcacggcggggcggtggcctggacgccgcctccgccgccaccggggttctactcc

SEQ ID NO: 54351 - protein, 88 aa, Zea mays
  misc_feature: Ceres CLONE 1479271-F
MSSAPPGYGGGGGAGSGAEPHGHADFLLHHHAQHVAAQQLYHVPQHSRREKLRFPQDDAPPHASASVPQQHGGAVAWTPPPPPPGFYS

SEQ ID NO: 54352 - DNA, 649 bp, Zea mays
  misc_feature: Ceres CLONE 1479272-F
  misc_feature: Encodes the peptide sequence at SEQ ID NO. 54353
  misc_feature (649)..(649): n is a, c, t, g, unknown, or other
tccccgcggtggcggccgctctagaactagtggatcccccgggctgcaggaattcgtctcacccctagaaaaagtggccctcatcgcctggacctctccttccaccaccgcctcctcctccgccctctccacgaccgtccccagtctctggcgggttccttgcccccaccgtcggccctgcttcttccctctcccctacgtgtgatgcgctcaacgccgtcgctgtctcttcttcaccatcgactcgctcgcctccttcgtcgccgagagccggcccttctccgtatccgtcgccatcacaggcgaatctgcctcccccatgaccgacgaccaacgagagcggcgtgcgacggctttaggcggcgaaggcggcccacaccatgtaaacgacgcacagcggtggaagcacgcaatggcagccgagctcgcggtggaggccgtcgcgcttgtcggcctcccgcgcgaatgactcctcgccggctccgttcgagatgacggtggaggacgcgctgaagctgctcggcgtcgcagagggcgcgtcgttcgacgaaatcctgcgcgccaagaacgccgccctcgcctcctgcaaggacgaccaggacgccgtcgcccaggttcccgagactctccctccccctactcgttattn

SEQ ID NO: 54353 - protein, 52 aa, Zea mays
  misc_feature: Ceres CLONE 1479272-F
MTVEDALKLLGVAEGASFDEILRAKNAALASCKDDQDAVAQVPETLPPPTRY

SEQ ID NO: 54354 - DNA, 636 bp, Zea mays
  misc_feature: Ceres CLONE 1479277-F
  misc_feature: Encodes the peptide sequence at SEQ ID NO. 54355
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (618)..(618): n is a, c, t, g, unknown, or other
tggagctccccgcggtggcggccgctctagaactagtggatcccccgggctgcaggaattcgtctcacccctagaaaaaatcgatcctgtcctgtccagcaaagggagacctgcacaagggaggactggaggagaggaggaggacctacccaacccggcctgcagctctctcgtctcttcctcctcctcgaagctccgatccgatcccccaatgtctgacagcagtcccgctcccggcgcctactactccggccctcccgccgcgccgccgcccgagtctaagcccgttgacggcggccaggtcaacgccgatgttcctggctactactcctccgcccctgctgcgaaatctggcgccggcggccagcagggcagctccgctgctcccaaggaatcgggcttcttcgccagctgctgtgggtgcttctggcggcgaaaccgcgagatagatagattcagtgttggaccgaggaccatgcatggatggatggaacatgcatgcccagtgattgtttgcgccgatgaaagttcaatttgtccggatttattttctctgaaatagtatatgttttttttctcnnnnnnnnnnnnnnnnnnnnnnnnnngnnnnnnnnnaanaaaaaaaaaaaaaaaaat

SEQ ID NO: 54355 - protein, 116 aa, Zea mays
  misc_feature: Ceres CLONE 1479277-F
MSDSSPAPGAYYSGPPAAPPPESKPVDGGQVNADVPGYYSSAPAAKSGAGGQQGSSAAPKESGFFASCCGCFWRRNREIDRFSVGPRTMHGWMEHACPVIVCADESSICPDLFSLK

SEQ ID NO: 54356 - DNA, 657 bp, Zea mays
  misc_feature: Ceres CLONE 1479279-F
  misc_feature: Encodes the peptide sequence at SEQ ID NO. 54357
  misc_feature (632)..(632): n is a, c, t, g, unknown, or other
tggagctccccgcggtggcggccgctctagaactagtggatcccccgggctgcaggaattcgtctcacccctagaaaaaacccgcggcgccggcgatgacgaccgttaacgtgaaccccgtctacgagtggctcgacgacggcgccagccacctcctccgcctcgacctcccagtcccagggttcaagggggaggactttaatgtgtacgtggacggcgaggcccgccggatcatcgtcttcggcagcgacggcaaggcgctgtggctccacaacacgttccagctgcccgatacggccaaccatgacaccatcacctacagcttcgacagcaacgtgctcacgctcaccatgcccaagctgcccgccgcccccgcaccgccccctccgccgcaggccaaggaggaggcgcgagtcgccggcggtaagaagccagctgatcaggagggcaagctgggcgccaaggttggcggtggccatggtggcgcggcgacggaggagcggacgaccgccgaggcggaggagaggacgacgagcttgacggccagtagcaaagaagaagacgagaaggccaggcccacggtgccgccgccgccgccgcctcagtcgaacgagaaggcgcaagatcatcangatggcaaggcgagggccggccaca

SEQ ID NO: 54357 - protein, 187 aa, Zea mays
  misc_feature: Ceres CLONE 1479279-F
  misc_feature (179)..(179): Xaa is any aa, unknown, or other
MTTVNVNPVYEWLDDGASHLLRLDLPVPGFKGEDFNVYVDGEARRIIVFGSDGKALWLHNTFQLPDTANHDTITYSFDSNVLTLTMPKLPAAPAPPPPPQAKEEARVAGGKKPADQEGKLGAKVGGGHGGAATEERTTAEAEERTTSLTASSKEEDEKARPTVPPPPPPQSNEKAQDHXDGKARAGH

SEQ ID NO: 54358 - DNA, 882 bp, Zea mays
  misc_feature: Ceres CLONE 1479288-F
  misc_feature (34)..(34): n is a, c, t, g, unknown, or other
  misc_feature (35)..(35): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (504)..(504): n is a, c, t, g, unknown, or other
gcggggggggtttgtttgtgtccttacctaatcnncggcgaannnnncnnnccaaactggggctccaccgcggtggcggccgctctagaactagtggatcccccgggctgcaggaattcgactcacccctagaaaaaccctccactgggctgcccggctgcctttataacgcggcgagcccagtgcggggaggcagataacccaaggacgcgcctcgcctcgagatccactcggagggccaccgcgaccgctccggtcggttccggcgaggtgccgcgcggtcgtaagtcgtaacagcatcaccagggcatacagagctgcgattttgggggggctgttggcccagccggggttgttggtggagataacccacgttgaagggctggtgctcctcggtacatgttccgccagggcattggattgggtatttgcccccagggtggaaaagatgggaaggtgccgcctggttctttcctttatacgttcatacgggggggccccccnctttcttgggggaagagcctcccaccggggcccgtggctcctttttgcctgtccccctctccgcgcacctaaataccggggccgtctttgggaatctaaaaggaacccattaaaagcccaacatggttgctctaccaacgattgcgcaaccatttttcgtgccccagattaaatatatacccccggtcggggttaaaagctccatcttggctctcggggatcctgggccaaaatatccaaatgtggccgcccctccgccggagagtgagtccccgcttgggcgcatttgctcgggcgcgtaatgtgcccccgagaagaaattttttataggaacccgcccaaacagattcattggctgatccaccaggggccgcccag

SEQ ID NO: 54359 - DNA, 661 bp, Zea mays
  misc_feature: Ceres CLONE 1479290-F
  misc_feature: Encodes the peptide sequence at SEQ ID NO. 54360
  misc_feature (447)..(447): n is a, c, t, g, unknown, or other
tggagctccccgcggtggcggccgctctagaactagtggatcccccgggctgcaggaattcgtctcacccctagaaaaaacttggacttggctattcccaacgccaccccgcaaccgcaacgtctctctagcgtctagcctctgcctgcgctcccacaccagaacaccacaccgctccgcgtgcgtcgcccgcactcctcgcctctgcccgtctgcctaccgtgccgtgccgtgccgtgctccccacccgatgcagccgccgacgcgggccgtgccgagccacagccggagatgagctccaggaaccgttccgccgccgcctcgtccgctgccccggctctccggacaccgcgccgcctgaagcggcggccagttaaggcgtcggcgccggggccgggcagcgggtggttcaaccgcccgcgacgccgctgctgaaatgggacgtcngtggcggcggcgggcgcggtgaggggaggaaggctggcgccgacgaagcgggggacgccgcgcgggcgcgggagaccaatgcgaaggcgacggaggtgtcggtgcggaagctcgcggccggggtttggcggctgcgcccgccggaaggcgtggcccgcggcgggagcggggtccgcgttgggcgtcgagcatatcccaaggcatctaccagtcc

SEQ ID NO: 54360 - protein, 47 aa, Zea mays
  misc_feature: Ceres CLONE 1479290-F
MSSRNRSAAASSAAPALRTPRRLKRRPVKASAPGPGSGWFNRPRRRC

SEQ ID NO: 54361 - DNA, 672 bp, Zea mays
  misc_feature: Ceres CLONE 1479291-F
  misc_feature: Encodes the peptide sequence at SEQ ID NO. 54362
  misc_feature (626)..(626): n is a, c, t, g, unknown, or other
tggagctccccgcggtggcggccgctctagaactagtggatcccccgggctgcaggaattcgtctcacccctagaaaaagccccatctcctcccgttccactcgacgcccaccaccactctctagtctcaccgccccccgtcccgctcattggacgagacgacggacccttcctttctcgcacgggaagagtagcgaggaggcgcggcgcccgtgcggcgtatgcccgtgcctgccgtcgggctccgcctctaggactagggtccgctccagcgccagccgtccgccatgggtgggctcgaggagatcaagaacgaagccgtcgatctggagaacatccccatcgaggaggtgttcgagcagctgaaatgcacccgcgaggggctgagctccagcgagggccagcagcgtctcgagatctttggccccaacaggctcgaggagaagaaggagagcaaggtcctcaagttccttgggttcatgtggaacccgctgtcatgggtcatggagatggctgccatcatggctattgcactcgccaacggtggtggcaagcccccggactggcaggacttcgtcggtatcatcgtgctcttggttatcaactccaccatctccttcattgangagaaacatgccggcaacgccgccgccgcactcatggccaaccttg

SEQ ID NO: 54362 - protein, 128 aa, Zea mays
  misc_feature: Ceres CLONE 1479291-F
  misc_feature (5)..(86): Pfam Name: Cation_ATPase_N Pfam Description: Cation transporter/ATPase, N-terminus
  misc_feature: SWISSPROT Homolog: EC 3.6.3.6 Proton-exporting ATPase
  misc_feature (113)..(113): Xaa is any aa, unknown, or other
MGGLEEIKNEAVDLENIPIEEVFEQLKCTREGLSSSEGQQRLEIFGPNRLEEKKESKVLKFLGFMWNPLSWVMEMAAIMAIALANGGGKPPDWQDFVGIIVLLVINSTISFIXEKHAGNAAAALMANL

SEQ ID NO: 54363 - DNA, 813 bp, Zea mays
  misc_feature: Ceres CLONE 1479292-F
  misc_feature: SWISSPROT Homolog: EC 2.7.10.2 Non-specific protein-tyrosine kinase
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (487)..(487): n is a, c, t, g, unknown, or other
  misc_feature (490)..(490): n is a, c, t, g, unknown, or other
attcctccctttcccttttccccaccccaccccnnnnccgccccnnnncccaatttggagctccccgcggtggcggccgctctataactagtggatcccccgggctgcaggagttcgtctcacccctagaaaaatgtcgctctcgctctcacacgactgggccgccgccgcttggtgctgaggctttccttggtctcttccgctgcaagcaacaaccgcccccatttctgcccaactggctgacggtgaggacatcctcgccttcttgtctgcgacaatggtcctggatgggcccgggctggttttgctggagactatgcacctcgggcggctttccctacccttggggggggtcctcgccaagccggtgacatgctacggttggggaccccttgcaccccaacgttggtgtattatgcccctttcttgacccggggggcggggggcgtgtgttaatgtgttgaatatattaaccacaccccttacnccncacaataccgtattcccatgttgccccccttcccccttttcccccccaacctctcttttttgctccccttagccaccttttccggcgcttgcctacctgttcggtttcccctgtgaccctctagagtttcgtgttccccccccaatgattgtcccctgccttttgtctctcgcgaagtgtcgcttcggccctttgcgcgccccgtgtcccgttttttaactctggtgcctgttgtcccctttggcgcttcggcgtttcaaggtcgttgtttcaggctttggcgctttttcatcgttctatcccttccgctttatctttgttcg

SEQ ID NO: 54364 - DNA, 669 bp, Zea mays
  misc_feature: Ceres CLONE 1479293-F
  misc_feature: Encodes the peptide sequence at SEQ ID NO. 54365
tggagctccccgcggtggcggccgctctagaactagtggatcccccgggctgcaggaattcgtctcacccctagaaaaaaaaaaaaaaatctcctcccgttccactcgacgcccaccaccactctctagtctcaccgccccccgtcccgctcattggacgagacgacggacccttcctttctcgcacgggaagagtagcgaggaggcgcggcgcccgtgcggcgtatgcccgtgcctgccgtcgggctccgcctctaggactagggtccgctccagcgccagccgtccgccatgggtgggctcgaggagatcaagaacgaagccgtcgatctggagaacatccccatcgaggaggtgttcgagcagctgaaatgcacccgcgaggggctgagctccagcgagggccagcagcgtctcgagatctttggccccaacaggctcgaggagaagaaggagagcaaggtcctcaagttccttgggttcatgtggaacccgctgtcatgggtcatggagatggctgccatcatggctattgcactcgccaacggtggtggcaagcccccggactggcaggacttcgtcggtatcatcgtgctcttggttatcaactccaccatctccttcattgaggagaacaatgccggcaacgccgccgccgcactcatggcc

SEQ ID NO: 54365 - protein, 126 aa, Zea mays
  misc_feature: Ceres CLONE 1479293-F
  misc_feature (5)..(86): Pfam Name: Cation_ATPase_N Pfam Description: Cation transporter/ATPase, N-terminus
  misc_feature: SWISSPROT Homolog: EC 3.6.3.6 Proton-exporting ATPase
MGGLEEIKNEAVDLENIPIEEVFEQLKCTREGLSSSEGQQRLEIFGPNRLEEKKESKVLKFLGFMWNPLSWVMEMAAIMAIALANGGGKPPDWQDFVGIIVLLVINSTISFIEENNAGNAAAALMA

SEQ ID NO: 54366 - DNA, 597 bp, Zea mays
  misc_feature: Ceres CLONE 1479294-F
  misc_feature (241)..(241): n is a, c, t, g, unknown, or other
  misc_feature (243)..(243): n is a, c, t, g, unknown, or other
  misc_feature (244)..(244): n is a, c, t, g, unknown, or other
  misc_feature (252)..(252): n is a, c, t, g, unknown, or other
  misc_feature (253)..(253): n is a, c, t, g, unknown, or other
  misc_feature (266)..(266): n is a, c, t, g, unknown, or other
  misc_feature (273)..(273): n is a, c, t, g, unknown, or other
  misc_feature (574)..(574): n is a, c, t, g, unknown, or other
  misc_feature (575)..(575): n is a, c, t, g, unknown, or other
ctccccgcggtggcggccgctctagaactagtggatcccccgggctgcaggaattcgtctcacccctagaaaaaaaccccgcgcgcgggggagcgataaaccctagtcttcgccgtcgtcgcaggaggacccgcgatgtcgcacttcgggaggtcaggcccgccggacatccgcgacaccttctcgctcctgcggtccttcatacatcagtcttccgcaccacgggccgaacgacctcttncnncgctcttnncgagcgctacggncaagggncgtccgaaagttctttcttccccaaagggaaaagggaaggaaccggggaaaccccagggggggtttttcccggggttcggggggggggaaaaatttccccccaaaaagggggcaaaaggggttttataaaccgcgcccccaaagtggcccccggttttgtgggggggggggaaaaaagaaaccctgggggggggggtttttgaaaaaaaaaaggcccccccccctgggtgggtaaaaaaacccccccccccccacccaaagggggggggggggtttaaaaaagggggggggggggggtgtnncaaaacccaccccccccccccc

SEQ ID NO: 54367 - DNA, 657 bp, Zea mays
  misc_feature: Ceres CLONE 1479295-F
  misc_feature: Translation starting site: 233
  misc_feature (657)..(657): n is a, c, t, g, unknown, or other
ctccccgcggtggcggccgctctagaatagtggatcccccgggctgcaggaattcgtctcacccctagaaaaagctagtcggctagtgggtgggaaatccgcagattcccgtcgctacttcggccacatggctgcagcggcggcgtggaccggcgccgcatcccccaactcgctgctgctctcgcgctcgcctccccacgccgccgcgctcgcgccttcgccgggaagctccatgcggaggcggctcctcctcggcgtcggcaccccggccgtggcggcgctggcggccgcggcgccgccagcggtgctgcaggacggagcggtcactgtgctcatcaccgccggcgcctactctcttgtgcgcgtcttcgacgagctcaccgagcggcggctcatcgaaaagagcttgagcaggaaggttgtgcacgtgctatccggcgtcctgttcatgtcatcttggcccctgttcaggtattccctgtccctagcatgcatcgaggttctcagattcataacgtttcacactgcaaagccaccaccaaagcatgctctgcccgcagcaattcgacagaagcacggtatttcgccgcggttgtcccgttcctgaactccatgaggcttctgatatatggactccgtctctacactgatgaagcn

SEQ ID NO: 54368 - DNA, 641 bp, Zea mays
  misc_feature: Ceres CLONE 1479299-F
  misc_feature: Encodes the peptide sequence at SEQ ID NO. 54369
  misc_feature (549)..(549): n is a, c, t, g, unknown, or other
  misc_feature (581)..(581): n is a, c, t, g, unknown, or other
  misc_feature (616)..(616): n is a, c, t, g, unknown, or other
  misc_feature (617)..(617): n is a, c, t, g, unknown, or other
  misc_feature (630)..(630): n is a, c, t, g, unknown, or other
gcggtggcggccgctctagaactagtggatcccccgggctgcaggaattcgtctcacccctagaaaaaatgtgacggtcgtcttgtgtcactcatggactctcctctaatggagcccctactagtgcccaacaaccacagtcccggtccggttgtcgccgccacgccgggagaacacggcggtgctgcggtcgacgagagcagcaccctcgtggatgctgccagtggcacggatgagagccacagggcactcgccgacgccgacgtgaagatgaacgacgatggcgacgtacaaagggacgagctgtccgcgtccgtgcagcgccggctggactagagtatcgccgtggagggggaggatgaagaggaggagattggtgacgacgcggaggccgactacatggcggcgcgcatgggacggcgcctggcggcgctgcccgggaatgcgcatgagagcgagccgttcatcatcttccgcgtggcgtggcccatgcgacgacgcaaccggcacctctacgagccgcagatgatctccatcgggcccatccancgtggagccggtcggcacctcgccgccatggnagagcaacagtggcggtacctcaggactctgcccnncccccgggggggncaatacctggc

SEQ ID NO: 54369 - protein, 80 aa, Zea mays
  misc_feature: Ceres CLONE 1479299-F
  misc_feature (50)..(50): Xaa is any aa, unknown, or other
  misc_feature (61)..(61): Xaa is any aa, unknown, or other
  misc_feature (73)..(73): Xaa is any aa, unknown, or other
MAARMGRRLAALPGNAHESEPFIIFRVAWPMRRRNRHLYEPQMISIGPIXRGAGRHLAAMXEQQWRYLRTLPXPRGGQYL

SEQ ID NO: 54370 - DNA, 650 bp, Zea mays
  misc_feature: Ceres CLONE 1479303-F
  misc_feature: Encodes the peptide sequence at SEQ ID NO. 54371
ctggagctccccgcggtggcggccgctctagaactagtggatcccccgggctgcaggaattcgtctcacccctagaaaaacctagaaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttccccggcgactaccgctgggacaccgccgggctgtccgccgaccccgagaccttctccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtcgag

SEQ ID NO: 54371 - protein, 169 aa, Zea mays
  misc_feature: Ceres CLONE 1479303-F
  misc_feature (61)..(169): Pfam Name: Chloroa_b-bind Pfam Description: Chlorophyll A-B binding protein
MAASTMAISSTAMAGTPIKVGSFGEGRITMRKTVGKPKVAASGSPWYGPDRVKYLGPFSGEPPSYLTGEFPGDYRWDTAGLSADPETFSKNRELEVIHSRWAMLGALGCVFPELLSRNGVKFGEAVWFKAGSQIFSEGGLDYLGNPSLIHAQSILAIWACQVVLMGAVE

SEQ ID NO: 54372 - DNA, 649 bp, Zea mays
  misc_feature: Ceres CLONE 1479305-F
  misc_feature: Encodes the peptide sequence at SEQ ID NO. 54373
ctccccgcggtggcggccgctctagaactagtggatcccccgggctgcaggaattcgtctcacccctagaaaaaaatcgcagccagcagcctcatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatcgtggagcagtcggtgtcgccgggcggcggcgcgtggctgggcgggcagctgttctcggccatggtggtgcgcaagccggcgcacctgttcctggacgagctgggcgtggcgtacgacgaggccgagga

SEQ ID NO: 54373 - protein, 160 aa, Zea mays
  misc_feature: Ceres CLONE 1479305-F
  misc_feature (64)..(160): Pfam Name: Thi4 Pfam Description: Thi4 family
MATAAASSLLKSSFAGSRLPAATRTTPASLVVATGPRGAGAGPICASMSMSSSNPPYDLTSFRFSPIKESIVSREMTRRYMTDMITYADTDVVIVGAGSAGLSCAYELSKDPAVSIAIVEQSVSPGGGAWLGGQLFSAMVVRKPAHLFLDELGVAYDEAE

SEQ ID NO: 54374 - DNA, 614 bp, Zea mays
  misc_feature: Ceres CLONE 1479308-F
  misc_feature: Encodes the peptide sequence at SEQ ID NO. 54375
gctctagaactagtggatcccccgggctgcaggaattcgtctcacccctagaaaaaactagtatctataaacagagtgagagactggtagcagccgcatgtgctagagctagacagaagtcagtctccttcccctctctctagtgctcgccggctctttccgtcgccatggacgtcctcctctgctgctgcctgctgcttctcctggcctccgccgcgtccgccggcagcgagcggtgcgtgcggcaggggaaggcggcctactcttcctcgctctctccggcccctcacggtagcagcagcggagcgtgcgggtacggcgccatggccgccgagatcaatgggggtttcctcgccgccggcgggcccaggcagcaccgcgggggcctcggctgcggccgctgtttccagatgagatgccgagacgcaaggctgtgcagcgccgggggagtgcgggtggtgctgaccgacttccacaggagcaaccgtacggacttcctgctcgccgggccggcgttcgcgggcctagccaagcccgggatggcccaacagttgaacaggcgagacgccctctccgtagagtacaaaaggattccctgcgagtacaaggagaaa

SEQ ID NO: 54375 - protein, 149 aa, Zea mays
  misc_feature: Ceres CLONE 1479308-F
  misc_feature (62)..(139): Pfam Name: DPBB_1 Pfam Description: Rare lipoprotein A (RlpA)-like double-psi beta-barrel
MDVLLCCCLLLLLASAASAGSERCVRQGKAAYSSSLSPAPHGSSSGACGYGAMAAEINGGFLAAGGPRQHRGGLGCGRCFQMRCRDARLCSAGGVRVVLTDFHRSNRTDFLLAGPAFAGLAKPGMAQQLNRRDALSVEYKRIPCEYKEK

SEQ ID NO: 54376 - DNA, 666 bp, Zea mays
  misc_feature: Ceres CLONE 1479310-F
  misc_feature: Encodes the peptide sequence at SEQ ID NO. 54377
acccgcggtggcggccgctctagaactagtggatcccccgggctgcaggaattcgtctcacccctagaaaaaccccagcaagtcagccccgccccgcgccgacgcctctccccgatcccgatctgtgtgcctggctgcctgcaacctccgtgggatggaggcggcgcggcagcagcaggaggagtgcccgtgcggcggggccgaggccgctgaccagttcgagcggctccacgacgcggtgctgctcgacgtcctcaatcgcatcggcgacgtcaaggcgctcggccgctgcgccctcgtctcgcgccgcttccatgcgctcgtgccgctcgtcgactccgtcttcgtccgcgtcggctgcgtcatccctgacgacccgccgccctcgtcctcctcttccgccgcaccaggcacctcgccgcggcaggcgccagccccggccgcgcgcgggcgcggcgcgctcgcgcacatcgcgcgcgtcctgctcggcggcatcgccaggcccatccacgcgctcggccagatcctctcccccgccgccgcggccgtctcccggcgctccgaggcactgcccgcttccccgcgcgcgcccgtcgcggacgtctctcaccactccccctccgaggtgctccgctccttcaaggagctgcggcgccttcacatcga

SEQ ID NO: 54377 - protein, 170 aa, Zea mays
  misc_feature: Ceres CLONE 1479310-F
MEAARQQQEECPCGGAEAADQFERLHDAVLLDVLNRIGDVKALGRCALVSRRFHALVPLVDSVFVRVGCVIPDDPPPSSSSSAAPGTSPRQAPAPAARGRGALAHIARVLLGGIARPIHALGQILSPAAAAVSRRSEALPASPRAPVADVSHHSPSEVLRSFKELRRLHI

SEQ ID NO: 54378 - DNA, 724 bp, Zea mays
  misc_feature: Ceres CLONE 1479315-F
  misc_feature: Translation starting site: 296
  misc_feature: SWISSPROT Homolog: EC 5.1.3.1 Ribulose-phosphate 3-epimerase
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (38)..(38): n is a, c, t, g, unknown, or other
tggtgggtcgggcgggggggttcgnnntgatttttttnggggggggtgtgaagaaataaaggtggggctccccgggggggggggggctctataatagagtatcccccggggtgtagggagttcttctcacccctagaaggggaactcccctacaagccgcctgggcgagagaggcgatgcatccccttccttagtgtactgtgtgctgaccgcgtggggcctgcccccatatctactctgccaccggtccgggggggaatcatcctggcggggagcggacctggtggcggagaatatggcgccgtccatgctctcgtcggactttgccaacctcgcttcggaggctgagcgcatggtccgcctaggcgccgactggctacatatggacatcgtggatgggcacttcggtcctaacctgactattggggctccggtgatccagaggcttgaggaagcataccgaagcatatgtggactgccatcttatggtcacgaagccttctgagtacttagaaccatttggagaggctggcgcttctggattcgcattccatattgaagttgctagagacaactggccggatctcattccaagcgttaaatcaaagggtgtggcgggctgggtgtagtcattgtggtcaggggtactccgcagggcaagaagtttttttcccctgggggaatgcaggaaaattcgggtggaaatgatttttttgggaaggag

SEQ ID NO: 54379 - DNA, 672 bp, Zea mays
  misc_feature: Ceres CLONE 1479318-F
  misc_feature: Encodes the peptide sequence at SEQ ID NO. 54380
ggagctccccgcggtggcggccgctctagaactagtggatcccccgggctgcaggaattcgtctcacccctagaaaaagcaggtacaccaatcgcttcgtccccgcgtctcgccgcgtagcggcgtaggcgccacagaaactcgcacgccgctccccgccgtccggcccgagtcgccgtcgctgccgaatccaatccatggctccgcccgccgcacccaccgcgctgcaccaccgcacgcccctcctcctcccccgccgcaacgtctccttgggtgccaccgccaccgcgcgcgccgccagggccgcttctctcgccgtcagggaccagccggacaccaccgccgcagccgtctccacctccgcgcctgagccggcacccgagttcaagcctccgccggggttcaaggcgcccgagcccaaaaggtacgaggtcaagtccggccaagtgggcagagtcctcggcgcctcgctcgacatcccccttcgcctcgggaccggcgtcttcgtcctcgggtactcaccatctcttgtttctccatcagagataccatcagaccagtatgcactggaatgtggagcttggaaggcgagatacgaatcaaaaataggacagtgctgacgacctgaaaaggctatcgagatatatgaatttgaaagttgtccattttgtg

SEQ ID NO: 54380 - protein, 140 aa, Zea mays
  misc_feature: Ceres CLONE 1479318-F
MAPPAAPTALHHRTPLLLPRRNVSLGATATARAARAASLAVRDQPDTTAAAVSTSAPEPAPEFKPPPGFKAPEPKRYEVKSGQVGRVLGASLDIPLRLGTGVFVLGYSPSLVSPSEIPSDQYALECGAWKARYESKIGQC

SEQ ID NO: 54381 - DNA, 668 bp, Zea mays
  misc_feature: Ceres CLONE 1479320-F
  misc_feature: Encodes the peptide sequence at SEQ ID NO. 54382
  misc_feature (552)..(552): n is a, c, t, g, unknown, or other
tccccgcggtggcggccgctctagaactagtggatcccccgggctgcaggaattcgtctcacccctagaaaaaacttctcaattctcaaccttttcttctgccggcgtgcgctctctctctcctcctcgtgcggccgctgggtgaggtgtccaggtcttcgtcttgtcattcaccagcgacgagactcaccaggtttgcattgatcagtatggtgactgaaaatgcagatgaagaatatgacactggtccagaaaataagttaagacacaattttcgattgggagatataacatgggttaagtacaatggctcttcatggtggccatcccaggtcattgatgaatcatgtgttggtagcaagcctaagaagaaagacaagtatgattgcctagttcggctctatggaacatgtcaatatttatatgtagacccttgggagtctaactcagaattttgaatgatgctgaagcaagaaacaagagcgcaatggaagcattcccgtgagtgcttgagaaggagctctctggcgttacttgcgcagtgattatgangatggttatgaaaaggagatgttcactccaaaggcgtgacaacaaagggactcgaagaagactcctctagaaaagcaaaaaacagagggctgaaccacatttatgggaaggagacc

SEQ ID NO: 54382 - protein, 82 aa, Zea mays
  misc_feature: Ceres CLONE 1479320-F
  misc_feature: SWISSPROT Homolog: EC 2.1.1.43 Histone-lysine N-methyltransferase
MVTENADEEYDTGPENKLRHNFRLGDITWVKYNGSSWWPSQVIDESCVGSKPKKKDKYDCLVRLYGTCQYLYVDPWESNSEF

SEQ ID NO: 54383 - DNA, 651 bp, Zea mays
  misc_feature: Ceres CLONE 1479324-F
  misc_feature: Encodes the peptide sequence at SEQ ID NO. 54384
ctccccgcggtggcggccgctctagaactagtggatcccccgggctgcaggaattcgtctcacccctagaaaaactcctcttcgtcagaccaaccggtacgcacaagtgcacatccactctgagaagaagaaacccaaacgatccagagaggactcccagtccagtctccgtccatgggtgcgggaaagggaggagacggcgaggaggccgcgcagcccgtcgtgctgaagctggacctgcattgcgccggctgcgcgcacaaggtcaagaaggccatcaggcgcgtgcctggtgtcgggtcgatcgtgacggacgtcgcggcgaacagggtcgtcgtggcgggcacggccgacgcgggcgcgctcaaggcgcggctcgaggccaagaccaacaagcccgtggaggtcgtctctgtcggcggcgtccctccaaagcccccctccgctgagccccaacaggacgctggcgccgccgagaagaagggggataagggcgcgaaccccaaggaggaggctaaggagcaacagggcggcggaggaggagaagaagaaacccaaggaggagacggtgctgctcaagatccgcctccactgcgacggctgcggcgaccgcatcaggcgacgcatctacaagttcaaaggcgtgaagga

SEQ ID NO: 54384 - protein, 159 aa, Zea mays
  misc_feature: Ceres CLONE 1479324-F
  misc_feature (16)..(78): Pfam Name: HMA Pfam Description: Heavy-metal-associated domain
  misc_feature: SWISSPROT Homolog: EC 3.6.3.4 Copper-exporting ATPase
MGAGKGGDGEEAAQPVVLKLDLHCAGCAHKVKKAIRRVPGVGSIVTDVAANRVVVAGTADAGALKARLEAKTNKPVEVVSVGGVPPKPPSAEPQQDAGAAEKKGDKGANPKEEAKEQQGGGGGEEETQGGDGAAQDPPPLRRLRRPHQATHLQVQRREG

SEQ ID NO: 54385 - DNA, 663 bp, Zea mays
  misc_feature: Ceres CLONE 1479326-F
  misc_feature: Translation starting site: 215
ctccccgcggtggcggccgctctagaactagtggatcccccgggctgcaggaattcgtctcacccctagaaaaactcgcgggctcccctcccttggcgtccacttcttcctccccacagtcatcactggcgttatcctcttcgttctctcctccctggttgttgttggctgggtgttggctagctgggattacagaccgagaagtggaccggccatgaaaatccagtgcgacgcgtgccaaggcgcggctgccacgggggtgtgctgcgcccaccacgccgcgctgtgcgcgcgctgcgacgtctagatccacgccgccaagctactcgtctgctagcaccggcgcctcacgctcgaggcgctctcctccaagctcccgcgctgcaacgtctgccttgacagagcggcgttcatcttctgcgtggaggatcaggcgctcttctgccattgactgcgacgagcccatccacgtcactgggacgctctccggtaaccaccagcgctacctggacatcgggatccgcgtcagtctctcctcggcttccgcctgcagcgacttctgcgacgcccgcgattactaccaccacgttccgtctatggccaccatcgatgctgctgacgccgtcgtctccgccatggtgcaacaggtggcctcgccgccac

SEQ ID NO: 54386 - DNA, 686 bp, Zea mays
  misc_feature: Ceres CLONE 1479339-F
  misc_feature: Encodes the peptide sequence at SEQ ID NO. 54387
ggagctccccgcggtggcggccgctctagaactagtggatcccccgggctgcaggaattcgtctcacccctagaaaaaagcagccagctcccactcgcaccgcccgtccgcccagaactatctcgctcgtccgcgttcagctcagctactccaatttcgcaacaagttgcaagcaataaccgaccaaggacgacgaacgggtcgatggccacgctctcctcctgcagccgcctgagtagcggcaccggcgccgcggccatccaccggcagccggcccgtgctggagccgtcctcgtcgtcacctgcaggcggagctcctccgcgaccgtccgcgccgcagccgctgccacggcggcggcgccggctgccgtagagctgcagaacaagggggtgtcgctgccaacctgggcggaattcgagctcgggcgggggcgggtctactggaagacaacagcggccctccgccttccccggggagggggtgaccttgtttcaaaaccgggggggaaaaaaatggccccaaaaaagggggtcggggtgggggtttcaaagggcggtttcaaccaacccctttttgggggggggaaaaacccaaagcataaaaaccctttagggagggggggaaaaaaccaaaccgcccctttttaaccccttttgggatccccgcgggcccccacaagggggga

SEQ ID NO: 54387 - protein, 147 aa, Zea mays
  misc_feature: Ceres CLONE 1479339-F
MATLSSCSRLSSGTGAAAIHRQPARAGAVLVVTCRRSSSATVRAAAAATAAAPAAVELQNKGVSLPTWAEFELGRGRVYWKTTAALRLPRGGGDLVSKPGGKKMAPKKGVGVGVSKGGFNQPLFGGGKNPKHKNPLGRGGKNQTAPF

SEQ ID NO: 54388 - DNA, 648 bp, Zea mays
  misc_feature: Ceres CLONE 1479341-F
  misc_feature: Translation starting site: 138
  misc_feature (648)..(648): n is a, c, t, g, unknown, or other
ggagctccccgcggtggcggccgctctagaactagtggatcccccgggctgcaggaattcgtctcacccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggccggactacctcggcaacccgagcctgatccacgcgcagagcatcctcgccatctgggcctgccaggtcgtgctcatgggcgccatcgaggggtaccgcgtcgccggcggcccn

SEQ ID NO: 54389 - DNA, 648 bp, Zea mays
  misc_feature: Ceres CLONE 1479349-F
  misc_feature: Encodes the peptide sequence at SEQ ID NO. 54390
ccccgcggtggcggccgctctagaactagtggatcccccgggctgcaggaattcgtctcacccctagaaaaagagcacgagactgctcggccgacgaaataataaagcgcgcgcgcgcacgcggagaggctcggagagctgagtgagatggcacaagccatggcgtccatgaccggcctctcgcagggcgttctgcccagcaggcgcgccgccaacagggccaggacggccgccgtcgtcagggcgtccgccgaggcgcaggcgcaggcgcaggcgggccgccgcgccgtgctcgggctggtggccactggcatcgtcggcggcgccttgtcgcaggcggtgcacgccgagaccgtcaagaccatcaagatcggagccccgccgccgccctccggtggactccccgggactctgaactctgaccaggcgagggacttcgacctccccttgaaggagcggttctacctgcagccgctgccgccggcggaggcggtggcgagggtgaagacgtcggcgcaggacatcatcaacctcaagccactcatcgacaagaaggcgtggccgtacgtccagaacgacctccgcctccgggcctcctacctgcgctacgacctcaagaccgtcatcgcttccaagcccaaggaggaa

SEQ ID NO: 54390 - protein, 163 aa, Zea mays
  misc_feature: Ceres CLONE 1479349-F
  misc_feature (9)..(163): Pfam Name: PsbQ Pfam Description: Oxygen evolving enhancer protein 3 (PsbQ)
MASMTGLSQGVLPSRRAANRARTAAVVRASAEAQAQAQAGRRAVLGLVATGIVGGALSQAVHAETVKTIKIGAPPPPSGGLPGTLNSDQARDFDLPLKERFYLQPLPPAEAVARVKTSAQDIINLKPLIDKKAWPYVQNDLRLRASYLRYDLKTVIASKPKEE

SEQ ID NO: 54391 - DNA, 624 bp, Zea mays
  misc_feature: Ceres CLONE 1479350-F
  misc_feature: Encodes the peptide sequence at SEQ ID NO. 54392
cccgcggtggcggccgctctagactagtggatcccccgggctgcaggaattcgtctcacccctagaaaaagctccggcagcgaagctcccccctccctgcctccttccccggcgccccgctcttcctccttccgctccggcgatgggcactggccgccgcggcggcggcggcggcggcgtgttccaccgcctcctcgccctctcgtcgctgctgctcctcgcttccggcgaggtcgtcttcgaggagcgcttcgaagatggttgggagactcggtgggtggaatccgactggaataggagtgaagggaaagcaggaaggttcaagcacacagcggggagatactctgcagatcctgatgactaaggaatacaaacgacaatagatgccagacattttgctatctcagcccagttcccggggaatcagtacaagaaaccggacgcttgtgggtccagtactcccattaagtttgagcaggatatttgatgtggcggtggctatattaaggctatgtccggttatgtcaaccaaaaaaaattttttggggaccctccgtacagcttgatggttggaccagaatttttggggtacctcaaaccaagaaaactccctctttaaacccc

SEQ ID NO: 54392 - protein, 73 aa, Zea mays
  misc_feature: Ceres CLONE 1479350-F
MGTGRRGGGGGGVFHRLLALSSLLLLASGEVVFEERFEDGWETRWVESDWNRSEGKAGRFKHTAGRYSADPDD

SEQ ID NO: 54393 - DNA, 694 bp, Zea mays
  misc_feature: Ceres CLONE 1479356-F
  misc_feature: Encodes the peptide sequence at SEQ ID NO. 54394
  misc_feature (170)..(170): n is a, c, t, g, unknown, or other
aaagctggagctccccgcggtggcggccgctctagaactagtggatcccccgggctgcaggaattcgtctcacccctagaaaaaaaaaggcaaaagctccccaacgaagtgcgagcgacccacgtccacacgacacgaaacaccaccaccaacagcagccgcaccacgcnaccagcgcaaagcgatggcgtccctcaccatgatggcgtccttcccccccgtggcggtgggcgcgccctcgcgccgcggcaccttcgccgtggtcaggtccgccaaggtcgaccgctgccaggagcccgccacgctagcagcaaccgaggcaggcccgccgcgacggacgccccccgtcatgctcgcggctgctgcggcgggcgtgggaaccatcgggggggccggcgccgccatggcgggccccaagaacgggacccccgaaggcaaggagaagtacgcggccatctgggtcaccatggcccacggcaaaggtctggcaaacttgagcacgcccgcttttcatcttgcgggccgggggggtgtaatatattaatggacctgcccccggtgtttttttgcccctattggttgggttccaaacttttaaatgcagtccctaaacggagggccgctttttatttgttttcttgaacggccccttggaatttttttaaaaaaattttcaagggggcccctgccaaaa

SEQ ID NO: 54394 - protein, 119 aa, Zea mays
  misc_feature: Ceres CLONE 1479356-F
MASLTMMASFPPVAVGAPSRRGTFAVVRSAKVDRCQEPATLAATEAGPPRRTPPVMLAAAAAGVGTIGGAGAAMAGPKNGTPEGKEKYAAIWVTMAHGKGLANLSTPAFHLAGRGGVIY

SEQ ID NO: 54395 - DNA, 660 bp, Zea mays
  misc_feature: Ceres CLONE 1479362-F
  misc_feature: Encodes the peptide sequence at SEQ ID NO. 54396
  misc_feature (275)..(275): n is a, c, t, g, unknown, or other
tggagctccccgcggtggcggccgctctagaactagtggatcccccgggctgcaggaattcgtctcacccctagaaaaaagacacaccgacgcgtacgtagcacagtccattattgccgtctcccttttgcgtgagcaaagaaagagagcgagaaacagtcgccatgtctgggatcatcccacaagatcgaaggagaagctccccatgggggggcgaccaccagaataagggagaagagcaccacaagaaggccgaggagcaccacaagaagganggaggggagcaccacaagaaggacggcggggagcacaaggagggcatcgtggagaagatcaaggacaagatcaccggcgagcacggggactagtccggcgaccacaaggagaagaaggacaaaaaaaaaaaaaaaacgagacgctcgaggtacccaattcgccctatagtgagtcgtattacgcgcgctccactggccgtcgttttacacgtcgtgactggggaaacccctgggcgtacccaacttaatcgcattgcaacacatccccccttccgcaggttgggtaatagcgaaaagccccccccgatcgcctttccaaaagttgcgcaaccctgatgggcaaatgaaaattgtaacctttatttttttgttaaattcccgttaa

SEQ ID NO: 54396 - protein, 67 aa, Zea mays
  misc_feature: Ceres CLONE 1479362-F
  misc_feature (37)..(37): Xaa is any aa, unknown, or other
MSGIIPQDRRRSSPWGGDHQNKGEEHHKKAEEHHKKXGGEHHKKDGGEHKEGIVEKIKDKITGEHGD

SEQ ID NO: 54397 - DNA, 659 bp, Zea mays
  misc_feature: Ceres CLONE 1479378-F
  misc_feature: Pfam Name: Gar1 Pfam Description: Gar1 protein RNA binding region
  misc_feature (218)..(218): n is a, c, t, g, unknown, or other
  misc_feature (224)..(224): n is a, c, t, g, unknown, or other
  misc_feature (262)..(262): n is a, c, t, g, unknown, or other
  misc_feature (263)..(263): n is a, c, t, g, unknown, or other
  misc_feature (312)..(312): n is a, c, t, g, unknown, or other
ggagctccccgcggtggcggccgctctagaactagtggatcccccgggctgcaggaattcgtctcacccctagaaaagtccgccgcctccctctccgctccgccaagaccctcctcctcactcagctcccctcgagcccagaagcaccgcgcgcaccatgcggccaccgagtgggcgcggcggcggcggccggttcggcggaagtggaggccaaggcngcggcngtggcccgttcggcggcggaggccgtggtggcgggtcnngcgcgggttccgcgacgagggcccgcccgcagaggtcgtcgaggtgtcnacgttcgtgcacgcgtgcgagggagacgcggtgacaaaactcaccaacgagaaggtggcctactttcacgcgcccatatacctgcagaacaagactcaggtcgggcaaggtcgacgagatcttcggccccatcaacgaatcttatttctctgtgaagatgatggaggggatccttgccacctcgtacaaggaaggcaacaagtcctttttcgaccccatggaatggctgccttctttcgggttcctggccaaaccaaagggaacaatctcaagggaccccctaaaggtgggggccctgggggaaaggggttggtgcccaagcccttggtgtttctttccgggggggg

SEQ ID NO: 54398 - DNA, 663 bp, Zea mays
  misc_feature: Ceres CLONE 1479387-F
  misc_feature (366)..(366): n is a, c, t, g, unknown, or other
  misc_feature (420)..(420): n is a, c, t, g, unknown, or other
  misc_feature (430)..(430): n is a, c, t, g, unknown, or other
  misc_feature (476)..(476): n is a, c, t, g, unknown, or other
  misc_feature (516)..(516): n is a, c, t, g, unknown, or other
aaactggagctccccgcggtggcggccgctctagaatagtggatcccccgggctgcaggaattcgtctcacccctagaaaaaacactgacaattgctgctttgtctgtgtgtctgtctccctatcttgcggtgtgatgatgatcagaggatgactatttcaactgcatagagaggggtgtcatggcgtcctcgaggatctcggatttcatgaggaagacactgcagaaggaggtgtccagggatgcctgacctgagtagcaaatgtattagcatgaccgagaagctgaggcgatggcgatggcaatggtgtgtagacagcagctgggtctctagtttagacggcatgtagtcgtgttagaatgaangaggcaatggtgcggtggagtggaggtcaatcggcgtgtgatgccacgcactancttagctgcngatggtttggtggacttttgaggaacagatatgagattgtatgcancgcacgctgaaattttactttgacgccgcccgattaaacnaaaaaaaaaaaaaaaacgagacgctcgaggtaccccattcgccttatagtgagtcgtattacgcgcgctcacttgggccgtcgtttttacaacgtcgtgactgggaaaacccctggcgtacccaactttaatcgcttggcaacactt

SEQ ID NO: 54399 - DNA, 660 bp, Zea mays
  misc_feature: Ceres CLONE 1479403-F
  misc_feature: Encodes the peptide sequence at SEQ ID NO. 54400
  misc_feature (163)..(163): n is a, c, t, g, unknown, or other
  misc_feature (175)..(175): n is a, c, t, g, unknown, or other
  misc_feature (235)..(235): n is a, c, t, g, unknown, or other
tccccgcggtggcggccgctctagaactagtggatcccccgggctgcaggaattcgtctcacccctagaaaaagaggagccttctcaccgtcgcacccggcgatgcagcggcacgtcgcctccggccggccgtcgggcacggacggctccgacttttcttacngcatggtcgtcnaatcccggtaccagagggtcgccgagggcagatcccgcctcgcgcgcctcatcctcgtgnaggcgctgcacctagtggccggaggcttgcttctattgctgtcgttgtccaagggggcggcggggaacaagttcgccgtgctgtccatggccgcgggattcctggctatagggggggggaaatagggcgaatgcggaccatgtcagtgctgcttcggctctacacaacgtgtcatcaattgcgttgcattctctgtgacgtgcattatccggtcagagttgttcttaagggtatgaagcaaaacacagaggccatcacaagctacaaaatgctggatgcgggttcgtgtggctcttgatatcctgcctgcaaaggggtggttatagatacaactacccagactcctggagaattttggtctcctccccaagaaagctttcttggaatggctatgaaattttttagcttttgaatccaaggaataa

SEQ ID NO: 54400 - protein, 85 aa, Zea mays
  misc_feature: Ceres CLONE 1479403-F
  misc_feature (21)..(21): Xaa is any aa, unknown, or other
  misc_feature (25)..(25): Xaa is any aa, unknown, or other
  misc_feature (45)..(45): Xaa is any aa, unknown, or other
MQRHVASGRPSGTDGSDFSYXMVVXSRYQRVAEGRSRLARLILVXALHLVAGGLLLLLSLSKGAAGNKFAVLSMAAGFLAIGGGK

SEQ ID NO: 54401 - DNA, 660 bp, Zea mays
  misc_feature: Ceres CLONE 1479411-F
  misc_feature (547)..(547): n is a, c, t, g, unknown, or other
aagctggagctccccgcggtggcggccgctctagaactagtggatcccccgggctgcaggaattcgtctcacccctagaaaaaaggacgacgacgatcaagtgcaatcgactagtggtagttaggttccgccgtgccttggatgtgctattaccatcaacatgttttttctgcttcttgctttgtgtaactagccatgtctaaagctgttgggacttgcaatgatgctataatgcgtgcttaactgctgacgaacctttttcctctacaaaaaaaaaaaaaaaaacgagacgctcaaggtacccaattcggcctatagtgagtcgtattacgcgcgctcacatggccgtgggtttacacgtcttgactgggaaaaccctggcgttctcaattataatcgcttgaaccacatccccctttcctcagctggcgtaataaccaagaggccgcaccgatcgcccttcccacaattgcacagcctgaatggcgaatggaaattggaggccttaatattttgttaaaattcgcgtgaaatttttgttaaaccngctcattttcttaaacaataggccgaaatcgggcaaaagtccttatatatcacaagaatataccgagatactgtctgagagttcgttccagatgggaacaggagtccactatt

SEQ ID NO: 54402 - DNA, 603 bp, Zea mays
  misc_feature: Ceres CLONE 1479422-F
  misc_feature: Encodes the peptide sequence at SEQ ID NO. 54403
  misc_feature (369)..(369): n is a, c, t, g, unknown, or other
  misc_feature (414)..(414): n is a, c, t, g, unknown, or other
  misc_feature (513)..(513): n is a, c, t, g, unknown, or other
ccccgcggtggcggccgctctagaactagtggatcccccgggctgcaggaattcgtctcacccctagaaaaaaagatgcatcgaggactgttcttcttcttcctcaagctgtagcctgtgggaggagaggccggagaggcctcccatggagttccccccactcatcacttcttggttggtccctgctagctgttcgttccctcagcaggtagctagagatgatcttgcttttattttgtgctgatctcttcctcgtcgtgtacgctcatatgcatggggcgacggatttgtctctgatcgttcccatgccggctcttgtatcttgacttggatctatatatcaatgcaaataaatcatcgatgggtgancatcgatcaaaaaaaaaaaaaaaacgagacgctcgaggtacccanttcgccctatagtgagtcgtattacgcgcgctcactggccgtcgttttacaacgtcgtgactgggaaaaccctggcgtacccactttatcgccttgcancacatcccccttcgccagctgggtaataacgaagaaggcccgcacgatcgcctttccaaaaattggcccacctgaatggcaaatggaatt

SEQ ID NO: 54403 - protein, 32 aa, Zea mays
  misc_feature: Ceres CLONE 1479422-F
MEFPPLITSWLVPASCSFPQQVARDDLAFILC

SEQ ID NO: 54404 - DNA, 640 bp, Zea mays
  misc_feature: Ceres CLONE 1479425-F
  misc_feature (465)..(465): n is a, c, t, g, unknown, or other
  misc_feature (466)..(466): n is a, c, t, g, unknown, or other
  misc_feature (470)..(470): n is a, c, t, g, unknown, or other
  misc_feature (475)..(475): n is a, c, t, g, unknown, or other
  misc_feature (476)..(476): n is a, c, t, g, unknown, or other
tggagctccccgcggtggcggccgctctagaactagtggatcccccgggctgcaggaattcgtctcacccctagaaaaaagaatcaggtccgtctccaactcactagtactcagccgccgcaatcaggggggcaggtagctcgagcgcgcgctccacctgcgccgacgcgatgcgggccaagtggaagaagaagaggatgcggaggctcaagaggaagcgccggataatgaggcagagatctaagtaggcgcatcttgtgaccgaggatggcgagcttctcctgcaccatggctgtgacgcgttgggatgattgtctccctttgtagacgtgctttgctgtagacgtaggcgatgtaaaccgtcctttttgattaattctagtatgttctgagactgggtttatattgcactttgagatactatatgatgctctaggttattgatcttcctggtcactcgataanntaanaaaanngcccgaccgatcgccccttcccaactttgccctccctgaattgcaaaagaaaattacccgaggcgctcgagggccccatttcgccctaaagtggggctaaatcccccctctccgtgcccgcctttttacaacggccgggatggggaaaacccgggggtaaccaa

SEQ ID NO: 54405 - DNA, 606 bp, Zea mays
  misc_feature: Ceres CLONE 1479438-F
  misc_feature: Encodes the peptide sequence at SEQ ID NO. 54406
  misc_feature (337)..(337): n is a, c, t, g, unknown, or other
  misc_feature (404)..(404): n is a, c, t, g, unknown, or other
  misc_feature (416)..(416): n is a, c, t, g, unknown, or other
  misc_feature (426)..(426): n is a, c, t, g, unknown, or other
ggagctccccgcggtggcggccgctctagaactagtggatcccccgggctgcaggaattcgtctcacccctagaaaaaggaaaccccgccgccgcaacatccctagtcgctcgtcagatcctccagcaccacagcaccttcgccgccgccgccgccgccgccgccatgggtaaggttcacggatcgctggcccgcgctgggaaggtgcgcgggcagacgcccaatggttgcaagcaggacaagaagaagatgccccgcggccgcgctcacaagcgcatgcaaatacaccgccgcttcgtcaccgccgttgttggatttcggcagaagcgcggccccnactcatcggagaagtagatctagctatgggcttgtgttttatccccactagtttcctcactgatggncacttgctgaangactatgctnatatctgtatcgatggtactggcatactggttagtacgatatatgcatcgtttagttgatcaaaaaaaaaaaaaaaacgagacgctcgagggtacccaatccgccctatagtgagtcgtataacccccgcctcctggccgtcggtttaaaacgtcgtgactgggaaaaccctggcggtac

SEQ ID NO: 54406 - protein, 62 aa, Zea mays
  misc_feature: Ceres CLONE 1479438-F
  misc_feature (3)..(61): Pfam Name: Ribosomal_S30 Pfam Description: Ribosomal protein S30
  misc_feature (58)..(58): Xaa is any aa, unknown, or other
MGKVHGSLARAGKVRGQTPNGCKQDKKKMPRGRAHKRMQIHRRFVTAVVGFRQKRGPXSSEK

SEQ ID NO: 54407 - DNA, 654 bp, Zea mays
  misc_feature: Ceres CLONE 1479440-F
  misc_feature: Encodes the peptide sequence at SEQ ID NO. 54408
  misc_feature (372)..(372): n is a, c, t, g, unknown, or other
  misc_feature (374)..(374): n is a, c, t, g, unknown, or other
  misc_feature (402)..(402): n is a, c, t, g, unknown, or other
  misc_feature (421)..(421): n is a, c, t, g, unknown, or other
  misc_feature (464)..(464): n is a, c, t, g, unknown, or other
  misc_feature (522)..(522): n is a, c, t, g, unknown, or other
  misc_feature (523)..(523): n is a, c, t, g, unknown, or other
  misc_feature (526)..(526): n is a, c, t, g, unknown, or other
  misc_feature (527)..(527): n is a, c, t, g, unknown, or other
  misc_feature (531)..(531): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
ggagctccccgcggtggcggccgctctagaatagtggatcccccgggctgcaggaattcgtctcacccctagaaaaaagcagatctaagctccaggcagcgtcgcgacagagtgagctagtgagtagcacgacaacaacaatggcttccctgaaagccgcgaagcccagcggagttgcggcgcagggcaaggagccggcgccccagctcagcgagacggcgacgaagccgtcagccgcgaagagcggcggcgttaagaaggctgagcagaggccccgggaaaccaaaaggaaggtgaagagcagcaaacaggcggcggcggccaaaaagtgacgtacagtacgtgtggagtgtaatggagcttccatccatnantgaatccatgcccatgtatgaatctagnccttccctttctggatctncctgggacgcggcgtgtgcgtcccctcatgtgtgatgatgccngatgatactacaaataagacgttgttgtgactgtgtgccaaaaaaaaaaaaaaaaaannaannaaanccccccnnnaaaaaaaaaaaccgggccgctcgggggaccccaattcccccctaaagggggagcgtatttacccccccttccccggcgcgtctttttttacaccgcgcgtgctggggaaaaacc

SEQ ID NO: 54408 - protein, 63 aa, Zea mays
  misc_feature: Ceres CLONE 1479440-F
MASLKAAKPSGVAAQGKEPAPQLSETATKPSAAKSGGVKKAEQRPRETKRKVKSSKQAAAAKK

SEQ ID NO: 54409 - DNA, 643 bp, Zea mays
  misc_feature: Ceres CLONE 1479454-F
  misc_feature: Encodes the peptide sequence at SEQ ID NO. 54410
  misc_feature (346)..(346): n is a, c, t, g, unknown, or other
gcgggaattcgtctcacccctagaaaaaagcttgtgcatcttcgatctcctccatctcccttcatcctctctctcgctgtttgaggagaactgcctgcccctggtccctcttcggctcctccccgcgccccgctcgccatccccagacttcatttcagggcgggatggacgactacgccccgggaggatgatggagctcaagacgctcgtcacccccaccctcaagaagaagggcgtcctcgccaagattagggctgagctaagagcaagcgtgtttgaacccattgaagagagagatcgggtgggaaatgatgatgggagggatccttgctttgcttgggacctncaattacccgagctaaccacctcccctccctcccccctttcggggaggttactaactggccctttgaatccaataccttgggagggggccccacctaagtcccccaagggaaaggttttacttgccaagagggggaccctgcccaaggggcctcggggaaaaattgaactgaaagactttccctaaacaaaatcgggacccttaaggggaccagggaccgcctaaaaggcggccccaatcgttttaaaatgttccccccagggttattctcgaaaattcgaaaaatttttcccacaa

SEQ ID NO: 54410 - protein, 114 aa, Zea mays
  misc_feature: Ceres CLONE 1479454-F
MMELKTLVTPTLKKKGVLAKIRAELRASVFEPIEERDRVGNDDGRDPCFAWDLQLPELTTSPPSPLSGRLLTGPLNPIPWEGAPPKSPKGKVLLAKRGTLPKGPRGKIELKDFP

SEQ ID NO: 54411 - DNA, 670 bp, Zea mays
  misc_feature: Ceres CLONE 1479456-F
  misc_feature: Translation starting site: 114
  misc_feature (220)..(220): n is a, c, t, g, unknown, or other
  misc_feature (393)..(393): n is a, c, t, g, unknown, or other
  misc_feature (396)..(396): n is a, c, t, g, unknown, or other
ggagctccccgcggtggcggccgctctagaactagtggatcccccgggctgcaggaattcgtctcacccctagaaaaaacccaatccaaaccagacaagcaaggaatcccccgatggctcatcgcgttctcctcctcctctctctcgcgtcggccgccgcggttgccgccgccgtcgacgcggaggacccgctgatccggcaggtggttcccggtggagnatgacacgatctggagctgaacgcggagtcccacttcttgagcttcgtggagcgggttcgggcagtcctacaaggacgcggacgagcacgcgtaccgggtggcccgttttcagggccaacctggggcggggggggcgggcaccacctgctgggacccgtcgggcggaacaccnccntcccctaagttctccgacctccccgccgggggaagtccggccgggacctcctcgggcctccggaaggtcccggggcgcttctcctcaaaaaactcgggggaggcgggccaacaggggccccgtgctcccacccggagggtctcccccaccatttcgagggggggggaccacggggccccccggccccgtaaagaaacaggggttcggggggggtcgtggctggtccttcagcggggctgggggcgcctggggggtccccccctcccccccaccg

SEQ ID NO: 54412 - DNA, 704 bp, Zea mays
  misc_feature: Ceres CLONE 1479460-F
  misc_feature: Translation starting site: 240
  misc_feature: Pfam Name: Pterin_4a Pfam Description: Pterin 4 alpha carbinolamine dehydratase
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (28)..(28): n is a, c, t, g, unknown, or other
  misc_feature (50)..(50): n is a, c, t, g, unknown, or other
  misc_feature (51)..(51): n is a, c, t, g, unknown, or other
  misc_feature (83)..(83): n is a, c, t, g, unknown, or other
  misc_feature (84)..(84): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (431)..(431): n is a, c, t, g, unknown, or other
gggtgaggccaaggagcnnntnnnnncnttgagggttttcgggggggttnncaaacagcgaggccctttgaaaaaaattaaanntttcataaagggggccccnnncnnnagggttccttaacaggggagaaaaaatggtctccccctacgctgcttcgcggagacatcttcgctcgcgcgctccagaagaaatcaccggctccgcttcgcggcagttgcaaccacgggacgatgtagtgatggtgaggctgtcgccggcggcggaggacgtgaagagcttggccgtcacctggttgggggcctcgaacgccagggccgccggggcgtggccggcgccgtggagcgcggcgttgatcctggcgatgagctcctggccgcaggtcttgtcgcgcaccttccagacgcactgcagccgcgcgggacgctgctcntcgccgtcgccgtcgccgccggagaggacgagcctccacccgacgaccttgaagaggagcctgcgcgcgtcgtcgagggagagcggctccgcgttgggctgcagcaggaggttcgaaaccgcgcacagggtaatcgtagagtcccaaggtctagtcagcgcggccatctatcctccacctctccacattttcagtgtgagttttcttgattcccttcatcccttttgtgcttcggcactaaggacgctatcaccagttcatcactcgctaatt

SEQ ID NO: 54413 - DNA, 628 bp, Zea mays
  misc_feature: Ceres CLONE 1479461-F
  misc_feature: Translation starting site: 219
  misc_feature (389)..(389): n is a, c, t, g, unknown, or other
  misc_feature (513)..(513): n is a, c, t, g, unknown, or other
  misc_feature (559)..(559): n is a, c, t, g, unknown, or other
ggagctccccgcggtggcggccgctctagaactagtggatcccccgggctgcaggaattcgtctcacccctagaaaaaagcttgcttgctctctaacacgcacagacacagtcacacagcgttgcgcgagagagcttattgcaaattactctgtggaccgaaccggtcggtcggaagtcggaacaataagcagcagatagagagagagagagagagagatggggaagctgacgctggggcaccgcggcgaggcgtcagagccggacttcttcaggggcgtcctcggcgagctcgtcctcaccttcctcttcgtcttcatcggcgtcggagccgccatgaccgacggagcgacgacgaagggtagcaccgctggaggcgacctgacggcngtggcgttggggcaggcgctgggtgtggcggtgatcgcgacggcggggttccacatctccggcggccacgtcaacccggccgtgacgctgtcgctggccgtcggcgggcacgtcacgctgtccngctcctccctgtacatcgcccgccagatgctcgccctcctcgcggnctgcttcctgctcaggtggctcacgggcgggctggccacgccgtgcacgcgctggcggagggcgtggcc

SEQ ID NO: 54414 - DNA, 662 bp, Zea mays
  misc_feature: Ceres CLONE 1479462-F
  misc_feature (184)..(184): n is a, c, t, g, unknown, or other
  misc_feature (186)..(186): n is a, c, t, g, unknown, or other
tccccgcggtggcggccgctctagaactagtggatcccccgggctgcaggaattcgtctcacccctagaaaaaactcgccgcctcctccccactgcctcgtgtggccgtcgtctcccgttcggaacgccaagccccccctccggcgaaatggcccccaagcgaggtggcaggggcgcggtgccngncaagagaagacgggataagtgacgaaccctctattcgagaagaggccgaagcagttcggcatcggcggcgcgttgccgccaaagaaggacctgcaccggttcgtcaggtggcccagggtcgtgcgtatccagcggcagcgccccatcctcaagcagcgcctcaaggtaccaccggcgctcaaccagttccacccgcaccctcaacaagaacctcgctacaaacctgtttaagatgctcctcaagtacgggcctgaagacagggctgccaagaaggagaggcttctgaagagggcccaagctgagaaatgaaggaaaaactgttgagtccaaagaacccattgggtgggaaagtatgggccttaaccattgggacttaccctcattggagcaaaacaaggggtcccctttgtggccctcccctcacgacgggggaacccaaacgaaacttggttgggggggcttccccggcccgggg

SEQ ID NO: 54415 - DNA, 636 bp, Zea mays
  misc_feature: Ceres CLONE 1479463-F
  misc_feature: Translation starting site: 141
  misc_feature: Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
  misc_feature (210)..(210): n is a, c, t, g, unknown, or other
ggagctccccgcggtggcggccgctctagaactagtggatcccccgggctgcaggaattcgtctcacccctagaaaaaacaggacgacccaagcaagcaagcaagcagcgagtacatacatactaggcagccaggcagccatggcgcccaccgtgatgatggcctcgtcggccaccgccgtcgctcccgtccaggggctcaagtccaccngcagccctcccgtcgcccgccgctccctcagaagcctcggcacgtcagcaacggcggaaggatccggtgcatgcaggtggtggccgggctacggcaacaagaagttcgagacgctgtcctacctgcccgcgctgtcgacggacgacctgctgaagcaggtggactacctgctgcgcaacggctggataccctggctcgagttccaacaaggccggctttcctgtacgggaagaactcacctccccgggctactacgacggcccctactggaccatggggaaactccccattgtcgggttcaacaaccccccccaggtggaaaaggagactgggggaggccttaaaatcctacccgggaaccctttcacccgggtttttggttttcaaaaaaataaaaaaaaaacgaggggggtgctctttcccccg

SEQ ID NO: 54416 - DNA, 593 bp, Zea mays
  misc_feature: Ceres CLONE 1479466-F
  misc_feature: Encodes the peptide sequence at SEQ ID NO. 54417
  misc_feature (360)..(360): n is a, c, t, g, unknown, or other
  misc_feature (361)..(361): n is a, c, t, g, unknown, or other
  misc_feature (445)..(445): n is a, c, t, g, unknown, or other
gctccccgcggtggcggccgctctagaactagtggatcccccgggctgcaggaattcgtctcacccctagaaaaaatccgcaagcctgtggacgcgagtgagtgaacaccagccgtattgtcccgaccccgaccgatcctcgcctgctgcagccatggcgacctccgcggcgctctctaccgccgccaatcccacccagctctgccggtcccgcgcttcgctgggcaagccggtgaaggggcttggcctgagcatgggccgcgagcgcgccccagcgagcattgtgtgccagggcgcgagcagcatctccgccgaccgcgtccccgacatggagaagcggaagctgatgaacctcctccnntctcgcgccatctcgttgccaaccgtcggcatggtcgtcccctacggcgccttcttcgtccctggcgggctccggaaacgcggnggcgggacctacccgaaggacaagctgggcaacgaatcccggtggaggggtgggttaaaaggaaggtcccaaaaaccgacgcttcgggaggggctcaagttgaccccccttccctggggtggaagaaggaaaaaaccctggccccctc

SEQ ID NO: 54417 - protein, 146 aa, Zea mays
  misc_feature: Ceres CLONE 1479466-F
  misc_feature (54)..(92): Pfam Name: CytB6-F_Fe-S Pfam Description: Cytochrome B6-F complex Fe-S subunit
  misc_feature: SWISSPROT Homolog: EC 1.10.99.1 Plastoquinol--plastocyanin reductase
  misc_feature (69)..(69): Xaa is any aa, unknown, or other
MATSAALSTAANPTQLCRSRASLGKPVKGLGLSMGRERAPASIVCQGASSISADRVPDMEKRKLMNLLXSRAISLPTVGMVVPYGAFFVPGGLRKRGGGTYPKDKLGNESRWRGGLKGRSQKPTLREGLKLTPLPWGGRRKKPWPP

SEQ ID NO: 54418 - DNA, 661 bp, Zea mays
  misc_feature: Ceres CLONE 1479468-F
  misc_feature (364)..(364): n is a, c, t, g, unknown, or other
  misc_feature (375)..(375): n is a, c, t, g, unknown, or other
  misc_feature (498)..(498): n is a, c, t, g, unknown, or other
ctccccgcggtggcggccgctctagaactagtggatcccccgggctgcaggaattcgtctcacccctagaaaaaatagcaggcgcctggtttccggtttccctgcagtgaaggaagaggaagcccaaccccaaggacagcagcgtacaatcaggctgatgcttgttggaactcagctgttgatgcttgtaagcctcgctgcctggctgcgtcctgtgctgtagatacgagatcccgcagcgttcgtttgttgcacttgcaccggcttgctgctagcttgcgacaggactaggaggagctagccgaggaggaagtgtgtgactccatggacgcgggccagcaggatgcgtgggactgggactggnaggtcctgctngcagacacaggagctcatcctccgtgcgccacccacacggcagcaacaataatacccttgacgatcaagaagaagcagaagagctcgacctgctgctgcctgccccagaaggggacgaactcnttgacccgccaaccaccaatgcaagaacttcggggtcctgccggaacaaaaagcccaaaaatccctcctcgttccggcctaaggttgccccccggaaaccaacaattgctccctccaagggcccctggaaaccaaagaaccccttccaaaccctgaaaacccc

SEQ ID NO: 54419 - DNA, 722 bp, Zea mays
  misc_feature: Ceres CLONE 1479469-F
  misc_feature: Encodes the peptide sequence at SEQ ID NO. 54420
  misc_feature (37)..(37): n is a, c, t, g, unknown, or other
  misc_feature (53)..(53): n is a, c, t, g, unknown, or other
  misc_feature (635)..(635): n is a, c, t, g, unknown, or other
ggggttggttggtccctctccccccccgaggctcttncccatatttatcattntcaaatgggactccccacggtggcggccgctctagaatagtggatcccccgggctgcaggaattcgtctcacccctagaaaaatcttgtcttgatcctctggtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaagcgaagctgaaggtggccatcaacgggttcggccgcatcgggcgcaacttcctgcggtgctgggacgggggcggcaacgcctcgcccctcgacgtcatcgccatcaacgacaccggcggtgtcaagcaggcgtcccacctgctcaagtacgactccacgctcggcatcttcgacgccgacttcaagcccgtcggggaacaacgccatctccggtcaacgggcaaggtcatcaaaggtcgttgtccgaaccgcaacccccagcaaacctgtccgttngggccgaagctcggaaatcgaaccttcgtcattcgaggggcaaccgggggttccttccgtccaacccgcaaaggggccccggagaaa

SEQ ID NO: 54420 - protein, 186 aa, Zea mays
  misc_feature: Ceres CLONE 1479469-F
  misc_feature (68)..(172): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
  misc_feature (157)..(157): Xaa is any aa, unknown, or other
MASSMLSATTVPLQQGGGLSEFSGLRSSASLPMRRNATSDDFMSAVSFRTHAVGTSGGSRRAPTEAKLKVAINGFGRIGRNFLRCWDGGGNASPLDVIAINDTGGVKQASHLLKYDSTLGIFDADFKPVGEQRHLRSTGKVIKGRCPNRNPQQTCPXGPKLGNRTFVIRGATGGSFRPTRKGAPEK

SEQ ID NO: 54421 - DNA, 652 bp, Zea mays
  misc_feature: Ceres CLONE 1479470-F
  misc_feature: Encodes the peptide sequence at SEQ ID NO. 54422
  misc_feature (642)..(642): n is a, c, t, g, unknown, or other
ggagctccccgcggtggcggccgctctagaactagtggatcccccgggctgcaggaattcgtctcacccctagaaaaagataagcatcggctaactctgtgccagcagccgcggtaagacagaggatgcaagcgttatccggaatgattgggcgtaaagcgtctgtaggtggcttttcaagtccgccgtcaaatcccagggctcaaccctggacaggcggtggaaactaccaagctggagtacggtaggggcagagggaatttccggtggagcggtgaaatgcattgagatcggaaagaacaccaacggcgaaagcactctgctgggccgacactgacactgagagacgaaagctaggggagcaaatgggattagagaccccagtagtcctagccgtaaacgatggatactaggtgctgtgcgactcgacccgtgcagtgctgtagctaacgcgttaagtatcccgcctggggagtacgttcgcaagaatgaaactcaaaggaattgacgggggccccgcacaagcggtggagcatgtggtttaattcgattcaaagcgaagaaccttaccagggcttgacatgccgcgaatcctcttgaaagaagagctccctgcttttgtcagacttcagagcccttccntctgtggtcg

SEQ ID NO: 54422 - protein, 40 aa, Zea mays
  misc_feature: Ceres CLONE 1479470-F
MQALSGMIGRKASVGGFSSPPSNPRAQPWTGGGNYQAGVR

SEQ ID NO: 54423 - DNA, 655 bp, Zea mays
  misc_feature: Ceres CLONE 1479471-F
  misc_feature: Encodes the peptide sequence at SEQ ID NO. 54424
  misc_feature (655)..(655): n is a, c, t, g, unknown, or other
ctccccgcggtggcggccgctctagaactagtggatcccccgggctgcaggaattcgtctcacccctagaaaaaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaagtgatgatgctttcaacaccttcttcagtgagactggtgctgggaagcacgtgccccgtgctgtttttgttgaccttgaccccactgtcatcgatgaggtgaggactggcacctaccgccagctcttccaccctgagcagctcatcagtgggagggaggatgcagccaacaactttgcccgtggtcactacaccattggcaaggagattgttgacctatgcccttgatcgcatcaggaagcttgccgaacaactgcacttggtctcccagggtttcctcgtctttcaaccgctgttggggggaggaaacgggcctctgggcctttggttccccn

SEQ ID NO: 54424 - protein, 119 aa, Zea mays
  misc_feature: Ceres CLONE 1479471-F
MRECISIHIGQAGIQVGNACWELYCLEHGIQADGQMPGDKTIGGSDDAFNTFFSETGAGKHVPRAVFVDLDPTVIDEVRTGTYRQLFHPEQLISGREDAANNFARGHYTIGKEIVDLCP

SEQ ID NO: 54425 - DNA, 653 bp, Zea mays
  misc_feature: Ceres CLONE 1479472-F
  misc_feature: Translation starting site: 279
  misc_feature (413)..(413): n is a, c, t, g, unknown, or other
ggagctccccgcggtggcggccgctctagaactagtggatcccccgggctgcaggaattcgtctcacccctagaaaatcccaccgcactttcctctctcctcccctgttttcgctcccctcgagacccccaaagcaccgaaagggggaggagcggagggagagagagagagagcggcggggttcaagaacgccgcggccatccggagccaggattctcccgatacccccctcgttcccagctcttcagtggcgccgatttggagttccagagacggcgatggggctcgggatctctgctcaaggtcttcgccaacaacttcgacgtccttgcagggcctttggtggcattggcttatcctttgcttcctttctgggccttcatgaaatgatctttatttgctggcttgtcttngcatacttcagtggtgcagcctatgtgtaccagaataatgtgagacctgccttcataaaagaacagatggtcaaacatttggtatgtccctcagaaaaaaggcctttctgggaaatctgatgactccctcaccgcactgtgataagtccattgaagaaaatggggactgaacccgctaaagaaatgggcgaacaaggcagggaagccatttaaacggtctggggaagtcatctaaggata

SEQ ID NO: 54426 - DNA, 647 bp, Zea mays
  misc_feature: Ceres CLONE 1479474-F
  misc_feature: Encodes the peptide sequence at SEQ ID NO. 54427
  misc_feature (334)..(334): n is a, c, t, g, unknown, or other
  misc_feature (401)..(401): n is a, c, t, g, unknown, or other
ctccccgcggtggcggccgctctagaactagtggatcccccgggctgcaggaattcgtctcacccctagaaaaacactggcttcttcttcttcatgtggtacttcctcaacgtcatattcaacatcctcaacaagaagatctacaactacttcccctatccatactttgtgtccttgatccatctagtagtgggtgtcgtatactgcctcatcagctggagtgtcggtctccccaagcgagcgccctatcatggcacgctcctgaagcttctctttccagtcgccctgtgccatggtattggtcacatcactagcaatgtgtccttcgctgctngtgcagtctcatttgccacactatcaaagctctggagccctttctcagcgcagctgctactcagttnatcctgggacagcaagtccctttctctcgggggcttccccttgcccctgttgcatcgggggttcaatggcatccccttatggacctctctattcaacggggatggcgtttcataaaaggccaggaaattaaaaattttttatttctcctttaaggggaggtttttttccccaaaaaaacccttggtttggaattgggataacccccccgcggggggagcctaacaatttaaaaaaaattgccccct

SEQ ID NO: 54427 - protein, 140 aa, Zea mays
  misc_feature: Ceres CLONE 1479474-F
  misc_feature (81)..(81): Xaa is any aa, unknown, or other
  misc_feature (103)..(103): Xaa is any aa, unknown, or other
MWYFLNVIFNILNKKIYNYFPYPYFVSLIHLVVGVVYCLISWSVGLPKRAPYHGTLLKLLFPVALCHGIGHITSNVSFAAXAVSFATLSKLWSPFSAQLLLSXSWDSKSLSLGGFPLPLLHRGFNGIPLWTSLFNGDGVS

SEQ ID NO: 54428 - DNA, 644 bp, Zea mays
  misc_feature: Ceres CLONE 1479479-F
  misc_feature: Encodes the peptide sequence at SEQ ID NO. 54429
  misc_feature (343)..(343): n is a, c, t, g, unknown, or other
  misc_feature (352)..(352): n is a, c, t, g, unknown, or other
  misc_feature (395)..(395): n is a, c, t, g, unknown, or other
  misc_feature (400)..(400): n is a, c, t, g, unknown, or other
tggagctccccgcggtggcggccgctctagaactagtggatcccccgggctgcaggaattcgtctcacccctagaaaaaacacacagacacacaggtacgcaaggcacagcccaagaccaccgcaccgcacctgcacaccgccagggatggcggcaaccgcgcacctcaccggtgtcctcggcgtgtcgtcgccgcctctcgctccgtccactgcagctgcagcggcgcaagaagcagagctgctctctgcgtcaggggcggcagcagaggaagcgcctccgcgtcgcccgcgccgtcgaggtggacgcgccttccgccggcgcaccggagcccgaagaggcngaggagccntccgtcgacttccctttcgtcagcccgcggctgctgccggacnggacnccggacgtgcactaccggacggggcgcggggggcagaaactcagggacatcatgctcgacggctacatcgacctctacggcgcctagaataaggttcttctcacctgctccaggggggcgcttgtccggaacctccatcgtcaaaggtggttaagggcaaggaaatcctttcccccaaaaactgatgtggaaaaaggagttcctcaaaaggaaaacccaaaaccgtgaaaattcgccctggccc

SEQ ID NO: 54429 - protein, 161 aa, Zea mays
  misc_feature: Ceres CLONE 1479479-F
  misc_feature (132)..(132): Xaa is any aa, unknown, or other
GAPRGGGRSRTSGSPGLQEFVSPLEKTHRHTGTQGTAQDHRTAPAHRQGWRQPRTSPVSSACRRRLSLRPLQLQRRKKQSCSLRQGRQQRKRLRVARAVEVDAPSAGAPEPEEAEEPSVDFPFVSPRLLPDXTPDVHYRTGRGGQKLRDIMLDGYIDLYGA

SEQ ID NO: 54430 - DNA, 650 bp, Zea mays
  misc_feature: Ceres CLONE 1479483-F
  misc_feature: Translation starting site: 142
  misc_feature: SWISSPROT Homolog: EC 2.7.8.23 Carboxyvinyl-carboxyphosphonate phosphorylmutase
  misc_feature (302)..(302): n is a, c, t, g, unknown, or other
ggagctccccgcggtggcggccgctctagaactagtggatcccccgggctgcaggaattcgtctcacccctagaaaaaatccctctccagccaccttcctccgctcgccgtgcttctgcttcctccgccaccaccgccggcatggctgcgcgctgcccctacttcgccgtcgaggagtcctcccgcggcatccgctcgggggagtccccggccgcggcgctccgccggatcctcgcgacgcctggtgcgcaccaggcgccctgctgctacgacgcgctcggcgcgcgcctcgtcgagcgcgncggggtttccgatcgggttcatgggcggttttctgtgttctgccgcgcgacttggcttggctgatgttggcctcatttcctatggagaaatggtagatcaagggcgtctcatcaatggagctgtttcaatcccagtgatgggtgatggagacaatggttacggaaactctatgaatatcaagagaaccataaagggtatatcaatgctggttttgctgggaatatgcttgaggatcaggtggcccctaagcatggtggactactgaagggaagaaagtcctatccgggggaggaagtgtcatgcacataaaaactgctgtagatgctaggaaagagaggggtcttaat

SEQ ID NO: 54431 - DNA, 629 bp, Zea mays
  misc_feature: Ceres CLONE 1479488-F
  misc_feature (381)..(381): n is a, c, t, g, unknown, or other
  misc_feature (546)..(546): n is a, c, t, g, unknown, or other
ctccccgcggtggcggccgctctagaactagtggatcccccgggctgcaggaattcgtctcacccctagaaaatgactatgacctaaagcagttgcggttttctagtgatctcttgttggaaataggagctgggatagaattaactactgctgcattccctcagtttttcttgcctatggcttgcgtagccaatgttgtaaaaacgtcgctgctgttacatcaacttcaactcgcactccaatctataaggcctatgctagaggagaaaatattggagatgtcactgctaaaggcgaatctgttgggaacattgcagatctgctcggtactggtttgagtatctttatctcaaaaaggatccctcactggtgacttcgttngccttcctttcctgtgatatctcctgagtcatatcaagaggtaggtctgttgtgctgaataccctaaacagggcaaggtttacgtcgcagtggattcttcattaaaactggcacattccctccttgagggaggaaactccaggagacgatatttatccacctggncggcatgagccagtcgcaataggtcaaggtttggagagcatttcagaggcagcttcattcttgccatacgacctcggtttgag

SEQ ID NO: 54432 - DNA, 643 bp, Zea mays
  misc_feature: Ceres CLONE 1479489-F
  misc_feature: Encodes the peptide sequence at SEQ ID NO. 54433
  misc_feature (325)..(325): n is a, c, t, g, unknown, or other
  misc_feature (330)..(330): n is a, c, t, g, unknown, or other
tccccgcggtggcggccgctctagaactagtggatcccccgggctgcaggaattcgtctcacccctagaaaattccaaaacccaacgcggcaaacggcttcctcatccccctcccctcgccatggccgtccccacctccacctcctccccgctacccctcctcttcctccatcgctgcaccgcaaactctagcccctcggttctctccttcccgtcctccctccgcggcgcgtccctccgctcccgggccgcggccgcaccgcccgcagagaccctctctgccgacggcatccccgacgcgccaccggaaggggcgggaacgggnatccngttgccatcgtcgatgggggatgatggggagcagcttgcaccccagcagaagatcagaaatcagctgcggtcctactgggtgccgttgatagaggactcgtgcaagaagataccgaagctgcaaaacaacaacgcaaagaccatgggtcccgttcctctgcccactaagaggagagtctattgtgtgctaaactctctcacgtgcaacaggactcacgggttccttttcgagatccggacgcatcagcgggctgatggatatcatgtatccaactgccccaaacaatgattcgttgatgcaactccagctccg

SEQ ID NO: 54433 - protein, 165 aa, Zea mays
  misc_feature: Ceres CLONE 1479489-F
  misc_feature (87)..(156): Pfam Name: Ribosomal_S10 Pfam Description: Ribosomal protein S10p/S20e
  misc_feature (70)..(70): Xaa is any aa, unknown, or other
MAVPTSTSSPLPLLFLHRCTANSSPSVLSFPSSLRGASLRSRAAAAPPAETLSADGIPDAPPEGAGTGIXLPSSMGDDGEQLAPQQKIRNQLRSYWVPLIEDSCKKIPKLQNNNAKTMGPVPLPTKRRVYCVLNSLTCNRTHGFLFEIRTHQRADGYHVSNCPKQ

SEQ ID NO: 54434 - DNA, 612 bp, Zea mays
  misc_feature: Ceres CLONE 1479491-F
  misc_feature: Encodes the peptide sequence at SEQ ID NO. 54435
  misc_feature (277)..(277): n is a, c, t, g, unknown, or other
ctccccgcggtggcggccgctctagaactagtggatcccccgggctgcaggaattcgtctcacccctagaaaaactcatcgtcacaacgcgtcctcgaataaaaatccagacgaaacccagaatccccaccgaacgcaacctaaaatctccccatccctcctcgatccagccccgcggagaagagccatggtcgattccggaaccaacgacgcccccctggtcgccagcaaccagcccacggaggaggaggtgacggtggagagggccgcggcgacngaggagcaggacgaggagaggctgcggtacctcgagttcgtgcagcaggcggcggcgcaagcgctggtgctggcggccgcggcttacgcgtacgccaagcagggcgccggaccgctccgccgcggggtcgatcaggtcgagggcacagtgaaggccgtcgtcggccccgtctacgaccgtttgcacgccgtcccgctcgacctcctcaagtcatcgaccgcaaggttggtgagtccgttgaggagatagaccagcctcgtccctccagtggtgagggaagcccccagcatcggcctgctcggctgcaaaggaaggtcgccagggcaggactggtg

SEQ ID NO: 54435 - protein, 112 aa, Zea mays
  misc_feature: Ceres CLONE 1479491-F
  misc_feature (29)..(110): Pfam Name: REF Pfam Description: Rubber elongation factor protein (REF)
MVDSGTNDAPLVASNQPTEEEVTVERAAATEEQDEERLRYLEFVQQAAAQALVLAAAAYAYAKQGAGPLRRGVDQVEGTVKAVVGPVYDRLHAVPLDLLKSSTARLVSPLRR

SEQ ID NO: 54436 - DNA, 658 bp, Zea mays
  misc_feature: Ceres CLONE 1479494-F
  misc_feature: Pfam Name: DnaJ_CXXCXGXG Pfam Description: DnaJ central domain (4 repeats)
  misc_feature (377)..(377): n is a, c, t, g, unknown, or other
tccccgcggtggcggccgctctagaactagtggatcccccgggctgcaggaattcgtctcacccctagaaaacagcgaaggggagaggatgtggttcatcctctgaaggtttctctggaggatttgtacaatggcacatcgaagaagctctctctgtcccgcagtgttctctgctccaagtgcaatggtaaggggttcaaagtctggagcttcatcgaggtgtgctggttgccaaggttctggctttaaggtccaaatccggcagttggggcctggaatgatccagcaaatgcagcatccttgcaacgagtgcaagggttctggagagacaatcagcgacaaagatagatgcccacagtgcaagggtgataaagttntccaggaaagaaaggtttttgaagtgtttgtgcaaaaaggcatgcaaaatgggcagaagatcactttccctggtgaggctaatgaagcccctgacactgtcactggaaaatatccttctttgttctccagcagaaaggagcttcccaagtttcaaaaaaaaggggggattaaccctttttttacaaaccacccctggaccttgactgaatcccctgggggggttcccgtttgttggggacccccttgggaaaaacgggccccttctagacaaaaacaaaag

SEQ ID NO: 54437 - DNA, 667 bp, Zea mays
  misc_feature: Ceres CLONE 1479496-F
  misc_feature: Translation starting site: 175
  misc_feature: SWISSPROT Homolog: EC 1.6.5.4 Monodehydroascorbate reductase (NADH)
  misc_feature (356)..(356): n is a, c, t, g, unknown, or other
tggagctccccgcggtggcggccgctctagaactagtggatcccccgggctgcaggaattcgtctcacccctagaaaaaggatctccaggccggcagaagttgagcggactgactggtcactgtagttcgatcgaatccgagtagggctgatacagttcgattcggcgggaggcatggcgtccgaaaagcacttcaagtacgtcatccctcggcggcgcgtcgcggcggggtacgcggcgcgggagttcgcaagcagggagttaagcctggggagcttgcaatcatctccaaggagctgtggctccttacgagcgtcctgccctaagcaagggttacctctttcctacgaatgctngcagactcccaggatttatgtatgtgtgggaagtggtgaaaaaaactattgcctgagttgtactcagagaaagcattgagctgatccttagtacaaaaattgtcaaagctaatcttttcaccagactctgactagtgcagctggaacaaactttacatatgagatcttgctcattgctactggctcccccggccataagcctcacccattttgggccccacagggacctgaattctaacaactttcctttttcttaaggggaatttgatgattgctgaccagcttggtttcccacttatcccaggaaaaag

SEQ ID NO: 54438 - DNA, 674 bp, Zea mays
  misc_feature: Ceres CLONE 1479498-F
  misc_feature: Encodes the peptide sequence at SEQ ID NO. 54439
  misc_feature (163)..(163): n is a, c, t, g, unknown, or other
  misc_feature (206)..(206): n is a, c, t, g, unknown, or other
  misc_feature (311)..(311): n is a, c, t, g, unknown, or other
aagctggagctccccgcggtggcggccgctctagaactagtggatcccccgggctgcaggaattcgtctcacccctagaaaaagctcacttcgctcccctctttcttccccacgaaaccagagcaaattccggcgagccggtgcggtgcggcggaggaagccnagggagacgccggcgcgagaaggagcatcaggagggagcagcngagatggatccggactcggtgaagtcgacgctctctaacctggccttcggcaacgtcatcgccgccgccgcccgcgacctcaaaaggaaatggtggctaaagacnaggctcaagcagcacctgcaagccatgatgaagttgatcttgatgagctgttggatgacccagaacttgagaaagtgcacgcagagagaatggctgcccttaagaaaagaggtgagaggcgtgaagtgctaaaaagcaagggcatgggtgatacagggagataactgaagggggacctcctcggggaggttactggcagtgaaaaagcatatgccattttttacacccgtaatttttaccgttgcaggatcatggaataagctttggaaggcccttgcctcagttctacgggggaaaaaaaatcccgccagggctggatgctaaaaagtgctcctttcctttgggggccaaccttggcaatca

SEQ ID NO: 54439 - protein, 59 aa, Zea mays
  misc_feature: Ceres CLONE 1479498-F
  misc_feature (6)..(6): Xaa is any aa, unknown, or other
MVAKDXAQAAPASHDEVDLDELLDDPELEKVHAERMAALKKRGERREVLKSKGMGDTGR

SEQ ID NO: 54440 - DNA, 821 bp, Zea mays
  misc_feature: Ceres CLONE 1479500-F
  misc_feature: Encodes the peptide sequence at SEQ ID NO. 54441
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (59)..(59): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
gggatggggggccccccccttttttatnnncatatannnnnnnnatcgnnnnnnaaaanctgggactcaccgcggtggcggccgctctagaactagtggatcccccgggctgcaggaattcgtctcacccctagaaaaaagcctgagcactccatccactactttactcaaagtctagagctagctttttgctttgctcaccagacaaaccgccgcagatggcgtcaacgatcatggccgccacctcccgcatcgtcgcggccaagaccccgtttcttggcaagggtggggccgcggccgccgccgccaatgccagccccctccgcaactccccccccccccctggtggggggccggatcacatggggcaacgacgtgtggtaccgccccggaaccgggtcaagtagcttggggccccttcttcggcccagagtggggtnnnaaactgaaccgggcaaaattcccccggggaaataaaaacccccccccccgggggggggtgcgccccccaaaaccggggggggggtttcccccgcgagaaaaagggccggtctggggaggtggcccccggcgggccgggcgggggacaaatcctggggggtggccctggggagtgcgcattcccggccggggggggggggctcgcaccaaagggtgggtgcgggcttcccgaccttgcacggggaggcccgggggggggtcgcgggagggccggcggcccgccatgagtgcgggctcgcagagggggacggtcgacggagactaccgtgggggagagcccgcggcgacccccgaggcccgcgcgcgcgcgggcgcaggtc

SEQ ID NO: 54441 - protein, 62 aa, Zea mays
  misc_feature: Ceres CLONE 1479500-F
MASTIMAATSRIVAAKTPFLGKGGAAAAAANASPLRNSPPPPGGGPDHMGQRRVVPPRNRVK

SEQ ID NO: 54442 - DNA, 1751 bp, Zea mays
  misc_feature: Ceres CLONE 1479506
  misc_feature: Encodes the peptide sequence at SEQ ID NO. 54443
accacttctcgttcgcgtcctccttccgtcggccatcgcccactactcctcgccgtcccaccgccccgcaccacccaggcacccacacccaccactcacttccattccatcccacctccgcgctcccgcaattcgcgtcgccgacaccccgcccccgctcggcgctggagaacaaagagcgcgacgagcgcgcggcggcgggcgtagccatgctccacaagttcgcgctcgcggtcaagaccaagaccatcgagttcttcgccgaggaggacgaggacgaggacgaggacgccgaccggttcgcgcgctctctgttgccgggggcggacggggtacttgccgggcagcgggttgtcgtgctgaagcccgacccgccgaaccctaaccctagcgcggatggggacgggaaggcggcgtccgggcaggaggccgccgtcgccgcggcgctcgcgacggcctcgtcgttccaggcggcgtacctgcacctgcaggccgcccacacgccgttcctgccggacgcggcggcggccgcggacgccgccgcggtgtcgcacctccggcggctgtcggagttgaagcggatcgcgagggacgggccggtggacccgcacggcggcgggagcgggaccaccctcacggcgcacctcgaggcccaggtgcgcgagaaccaggcgctgctgcggtccttggacgccgtggtgaaccgcctgcaggccgcgctggacgccaaggacgccgcggccgccgcgctgcggctggacctcgaggcgctggacggcggcaacgcgcggctcgcgggccgcctcgaccgcgcgctggcgcccccgccgccgccgggcggcggcggtggcgacgccgtgggcgcgatgctgtccgcgggcgtcttcgactcggtcctccgcgacgccctccgcgtggcgcaccggttcgcccgcgcgctcgccgaggtcctccggcgcgccggctgggacctggccgcggctgccgaggccgcctaccccggtgtctcctactccaaggccggccactgccgctacgcgctcctctcccgcgtctgcctctccatgttcgacggattcgactcgcaccaattcggcgccacagctggcacggcagagctcggaggagccgacccggcaagccttagaaacgagtcgttgcggcaattcatcgagcactcggacgcagaccccatggagctggtgaactcgagcccggactgcgagttcgcccagttctgcgaccgcaagtacaagcagttgatccatcctggcatggagtcctcgctgttcgggaacgcaggctgcgggacgctgccggtgatgagcgtggccggcccactctacgagctgttcgtcgcaatggcaagctcggtctggacgctccacaggctagcctgggcgtatgacccagcggtcggcgtattccaggttggccgaggcgcagagttctcgatggtgtacatggagaacattgtccggtcgtccaagggtctcgcggggagcagggagcccgggaagccggcgcgacgaccgaaggtcgggttcaccgtggtgccgggcttccggctcggagggacggtgatccagtgtagggtgtatctagatcacgggaagaggggagaggaaactattatagactcgatttgaggtgaagcgaaactttatatatatgtatgtatagtcaaagaaagaaactgtacattcgaaaacgaaaggaggttattatatgtgcaaaaaaaaaaaaaaaaa

SEQ ID NO: 54443 - protein, 479 aa, Zea mays
  misc_feature: Ceres CLONE 1479506
  misc_feature (59)..(199): Pfam Name: DUF641 Pfam Description: Plant protein of unknown function (DUF641)
MLHKFALAVKTKTIEFFAEEDEDEDEDADRFARSLLPGADGVLAGQRVVVLKPDPPNPNPSADGDGKAASGQEAAVAAALATASSFQAAYLHLQAAHTPFLPDAAAAADAAAVSHLRRLSELKRIARDGPVDPHGGGSGTTLTAHLEAQVRENQALLRSLDAVVNRLQAALDAKDAAAAALRLDLEALDGGNARLAGRLDRALAPPPPPGGGGGDAVGAMLSAGVFDSVLRDALRVAHRFARALAEVLRRAGWDLAAAAEAAYPGVSYSKAGHCRYALLSRVCLSMFDGFDSHQFGATAGTAELGGADPASLRNESLRQFIEHSDADPMELVNSSPDCEFAQFCDRKYKQLIHPGMESSLFGNAGCGTLPVMSVAGPLYELFVAMASSVWTLHRLAWAYDPAVGVFQVGRGAEFSMVYMENIVRSSKGLAGSREPGKPARRPKVGFTVVPGFRLGGTVIQCRVYLDHGKRGEETIIDSI

SEQ ID NO: 54444 - DNA, 670 bp, Zea mays
  misc_feature: Ceres CLONE 1479520-F
  misc_feature: Encodes the peptide sequence at SEQ ID NO. 54445
  misc_feature (326)..(326): n is a, c, t, g, unknown, or other
  misc_feature (358)..(358): n is a, c, t, g, unknown, or other
  misc_feature (418)..(418): n is a, c, t, g, unknown, or other
  misc_feature (474)..(474): n is a, c, t, g, unknown, or other
agagctggagctccccgcggtggcggccgctctagaactagtggatcccccgggctgcaggaattcgtctcacccctagaaaacctccggctgtctcatcgctccgcgtagtaaactcttgttacaaaaggccagctgctcgtttgctccgccgcgcgccgtcggttggctgctcgctcgctctggctgggcggcgtcggtggctcggctgagtcccggccgggggcgagcaatgcacattgccacctgcctgtggcaaggagaagcgtccgccggcggcatggggggagctgctgctgctactgctggaggcggctgcccccgcngaaagtggggcgccgccccccccaaggtggcntccgcgctgggcgtggccgggtgcgcgctcaactgcgcgggtgagcttcgtggtgttctncgcgctggacatgctggacgtggtgctttgcctcgtgtacaagctggtggactacncgccggaggcggagtggaaatcttgctactgcgcgggggcgtccggcccggcggggggggcaattgcccctcggcgcggggccaccgggggggggcgggcccaaggtggtgcggttgtccgcttcttccgccaaacttccacttgaagaacttttcgaacccccttgtacgttggggccgtcccttgctggccaaa

SEQ ID NO: 54445 - protein, 146 aa, Zea mays
  misc_feature: Ceres CLONE 1479520-F
  misc_feature (32)..(32): Xaa is any aa, unknown, or other
  misc_feature (81)..(81): Xaa is any aa, unknown, or other
MHIATCLWQGEASAGGMGGAAAATAGGGCPRXKWGAAPPKVASALGVAGCALNCAGELRGVLRAGHAGRGALPRVQAGGLXAGGGVEILLLRGGVRPGGGGNCPSARGHRGGAGPRWCGCPLLPPNFHLKNFSNPLVRWGRPLLAK

SEQ ID NO: 54446 - DNA, 680 bp, Zea mays
  misc_feature: Ceres CLONE 1479521-F
  misc_feature: Encodes the peptide sequence at SEQ ID NO. 54447
  misc_feature (307)..(307): n is a, c, t, g, unknown, or other
  misc_feature (319)..(319): n is a, c, t, g, unknown, or other
  misc_feature (408)..(408): n is a, c, t, g, unknown, or other
  misc_feature (680)..(680): n is a, c, t, g, unknown, or other
agagctggagctccccgcggtggcggccgctctagaactagtggatcccccgggctgcaggaattcgtctcacccctagaaaaaaccgcatcgaccggacggtctctctctcgtctctcccgacgcgcctccacggccggccccgccccggctcgctagcctcctcccactcccagtaccagcccccgcccctccagcaccaccagcagctcgccttcggaccatgagacgggtcggaggagacctgcagggcgacggcacgacgcctcggtccgcggcggcggggcaggccatgatggagcttcanggcaacgggtcngccgccgtcggggggcgcatgggtggtggggctcaccccgctcagcgaggccctgtggcgggacagcaaggcgctccccgcgggggccnggccccgccgcgctcatcggggacgtgtccgccaggctcacgtggaaggacctctgcgtcacgtggctctggggccccgggaagacccagaccgtgctggacgaactcacccggtacgcggaacccggggtcctgaaccccgctccatggggccctcggggtccgggaaatccacccttggtcaaagccctcgccggggcgccttggccgcaaaggctttcctctccggggaaggtggctccttaaaggggcggaagggcaaagctctcctn

SEQ ID NO: 54447 - protein, 42 aa, Zea mays
  misc_feature: Ceres CLONE 1479521-F
MGPSGSGKSTLGQSPRRGALAAKAFLSGEGGSLKGRKGKALL

SEQ ID NO: 54448 - DNA, 674 bp, Zea mays
  misc_feature: Ceres CLONE 1479522-F
  misc_feature: Encodes the peptide sequence at SEQ ID NO. 54449
  misc_feature (411)..(411): n is a, c, t, g, unknown, or other
  misc_feature (417)..(417): n is a, c, t, g, unknown, or other
  misc_feature (458)..(458): n is a, c, t, g, unknown, or other
aaagctggagctccccgcggtggcggccgctctagaactagtggatcccccgggctgcaggaattcgtctcacccctagaaaaaaagcctgagcactccatccactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctcccgccagacgccctcgtacctgaccggcgagttccccggcgactacngctggnacaccgccgggctgtccgcggaccccgaaggcgtcgcgcgnaacagggcgcctgaggtgatccacgcggcgtgggcgatgctgggtgccctgggctgcatcccccggaagtgcttgaaaatgggtgcccctggacttcaagaaccccggtggtcaaggcgggccgcaaatcttccggaggccggctggacaactggggaaccccaacctggtgaccccccaaaaatcctggcctggcccggtttcaaggaatctcac

SEQ ID NO: 54449 - protein, 170 aa, Zea mays
  misc_feature: Ceres CLONE 1479522-F
  misc_feature (69)..(169): Pfam Name: Chloroa_b-bind Pfam Description: Chlorophyll A-B binding protein
  misc_feature (83)..(83): Xaa is any aa, unknown, or other
  misc_feature (85)..(85): Xaa is any aa, unknown, or other
MASTIMAATSRIVAAKTPFLGQGRAAAAAANASPLRDVAAAAAGGRITMGNDLWYGPDRVKYLGPFSRQTPSYLTGEFPGDYXWXTAGLSADPEGVARNRAPEVIHAAWAMLGALGCIPRKCLKMGAPGLQEPRWSRRAANLPEAGWTTGEPQPGDPPKILAWPGFKESH

SEQ ID NO: 54450 - DNA, 699 bp, Zea mays
  misc_feature: Ceres CLONE 1479523-F
  misc_feature: Encodes the peptide sequence at SEQ ID NO. 54451
aaagctggagctccccgcggtggcggccgctctagaactagtggatcccccgggctgcaggaattcgtctcacccctagaaaaagttactctagggataacaggctgatcttccccaagagtccacatcgacgggaaggtttggcacctcgatgtcggctcttcgccacctggagctgtaggtggttccaagggttgggctgttcgcccattaatgcggtacgtgagctgggttcagaacgtcgtgagacagttcggtccatatccggtgtgggcgttagagcattgagaggacctttccctagtacgagaggaccgggaaggacgcacctctggtgtaccagttatcgtgcctacggtaaacgctgggtagccaagtgtggagaggataactgctgaaagcatataagtagtaagcccaccccaagatgagtgctctctcgtgcacgcactcccaatggcacccggcggcggcggcggcatcagagccccttcgccagacctcccagtcccagcccggcaaaagttcgcaaactcgacgagaagaccacgggcttattccgctgccagtgcgctaccgagactcccacggcctcagtcgatcagacgcggagccgtggtggtagtggtagcatgcgcccgcggaagcgagcagcaatcctctccggccgtcgcggcaaaggtgcggcccgagcccggc

SEQ ID NO: 54451 - protein, 81 aa, Zea mays
  misc_feature: Ceres CLONE 1479523-F
MAPGGGGGIRAPSPDLPVPARQKFANSTRRPRAYSAASALPRLPRPQSIRRGAVVVVVACARGSEQQSSPAVAAKVRPEPG

SEQ ID NO: 54452 - DNA, 690 bp, Zea mays
  misc_feature: Ceres CLONE 1479529-F
  misc_feature: Encodes the peptide sequence at SEQ ID NO. 54453
ctggagctccccgcggtggcggccgctctagaactagtggatcccccgggctgcaggaattcgtctcacccctagaaaataatatgatagcagaggccatgagcaaggtcggtcggaagggtgtggttaccctcgaagaagggaggagttctgaaaactttctctatgttgtggaggggatgcaatttgatcgtggttatatctctccgtactttgtaacagacagtgagaaaatgtctgccgagtatgagaactgcaagctacttttggttgacaaaaagatcaccaacgcaagggatcttatcaatgttttggaagaagccatcagaggtggatacccaatcctgataattgctgaggatattgagcaggaggctcttgctacccttgttgtcaacaagctcagaggatcattgaagattgctgccatcaaagcccctggttttggagagcgcaagactcagtacttggatgatattgccatccttactggagcaactgtaatcagagatgaagttgggctgtcacttgacaaggctgacaaatcagtccttggaacagcagcaaaggttgtccttactaaagagtcgacaacaattgttggtgatggcagcacccaggacgaagttactaagagggttgcacagattaaaaatctcattgaggcagcagaacaagaatatgaaaagg

SEQ ID NO: 54453 - protein, 229 aa, Zea mays
  misc_feature: Ceres CLONE 1479529-F
  misc_feature (1)..(229): Pfam Name: Cpn60_TCP1 Pfam Description: TCP-1/cpn60 chaperonin family
GAPRGGGRSRTSGSPGLQEFVSPLENNMIAEAMSKVGRKGVVTLEEGRSSENFLYVVEGMQFDRGYISPYFVTDSEKMSAEYENCKLLLVDKKITNARDLINVLEEAIRGGYPILIIAEDIEQEALATLVVNKLRGSLKIAAIKAPGFGERKTQYLDDIAILTGATVIRDEVGLSLDKADKSVLGTAAKVVLTKESTTIVGDGSTQDEVTKRVAQIKNLIEAAEQEYEK

SEQ ID NO: 54454 - DNA, 685 bp, Zea mays
  misc_feature: Ceres CLONE 1479532-F
  misc_feature: Encodes the peptide sequence at SEQ ID NO. 54455
  misc_feature (554)..(554): n is a, c, t, g, unknown, or other
tggagctccccgcggtggcggccgctctagaactagtggatcccccgggctgcaggaattcgtctcacccctagaaaaaatagacacagatagatagctagaacacgagcagaggatggctaggcctaggccgtcggtcgtcgtcctcgcggtggccgtcgccgtggcgtccctcgcgcagcccggcgcggccgacctgaagcaggactactacgcgagcacctgccccaacgtggaggccatcgtgcgcggcgtggtgcagcagcgactgcaggccaccatccgggccgtcggctccaccgtccgcctcttcttccacgactgcttcgtcgagggttgcgacggctcggtgctgatcgaatccacgcccggcaaccaggccgagaaggacgcctccgacaacaagtccctcgcgtccgaaggcttcgacaccgtgcggagcgccaaggccgccgtcgaggccgcctgcccggacacggtctcctgcgccgacgtgctcgccatcgccgctcgggacgccatctccatgagtggcgggcctttcttcccagtgnagctgggcaggctggacggcctgatctcaacgccagcagcgtgcaggccagctccccgaggccaccagacctggacaactgctggcagtcttcagggacacggcttcaactgtccgacttcgtcccgttct

SEQ ID NO: 54455 - protein, 190 aa, Zea mays
  misc_feature: Ceres CLONE 1479532-F
  misc_feature (44)..(190): Pfam Name: peroxidase Pfam Description: Peroxidase
  misc_feature: SWISSPROT Homolog: EC 1.11.1.7 Peroxidase
  misc_feature (147)..(147): Xaa is any aa, unknown, or other
MARPRPSVVVLAVAVAVASLAQPGAADLKQDYYASTCPNVEAIVRGVVQQRLQATIRAVGSTVRLFFHDCFVEGCDGSVLIESTPGNQAEKDASDNKSLASEGFDTVRSAKAAVEAACPDTVSCADVLAIAARDAISMSGGPFFPVXLGRLDGLISTPAACRPAPRGHQTWTTAGSLQGHGFNCPTSSRS

SEQ ID NO: 54456 - DNA, 691 bp, Zea mays
  misc_feature: Ceres CLONE 1479535-F
  misc_feature: Encodes the peptide sequence at SEQ ID NO. 54457
agagctggagctccccgcggtggcggccgctctagaactagtggatcccccgggctgcaggaattcgtctcacccctagaaaaaacagacccccgcccacgaccacacgcaggcagcaagcagcagccgcgcgctcgcctaggactaccgactacgagtagtgctcagctagcctccatcctcagcgcgcgagtggctgctgcgcattcctctctttatccgtctctgtgcttgtttaatttgtgttcgttcgtgagtaggcggccggcacatatggcagcgcagtccatgctcatgtcgaccagcgtcaacggcggccgcgcgctgccgtctcttcaggccgaccggccggctccatacccgcggctaccgctgccgtcatcgtcatcctcgtcaggctacaggcactccaagtccgtctccgtgaagacgctcgccctgttcggcaaatccaaggtcaagaccgcaccggcgaagaaggctgctgcgcccaagcccaaaccgaacgttgaggatggtatcttcggcacgtccggcgggatcggattcaccaaggagaacgagctgttcgtcggccgcgttgccatgcttggctttcgcgcatcgctacttgaagaggccattacagggaccggcatccttgctcagctgaacatcgagacggacatccccatctacgaggcggagcctc

SEQ ID NO: 54457 - protein, 139 aa, Zea mays
  misc_feature: Ceres CLONE 1479535-F
MAAQSMLMSTSVNGGRALPSLQADRPAPYPRLPLPSSSSSSGYRHSKSVSVKTLALFGKSKVKTAPAKKAAAPKPKPNVEDGIFGTSGGIGFTKENELFVGRVAMLGFRASLLEEAITGTGILAQLNIETDIPIYEAEP

SEQ ID NO: 54458 - DNA, 653 bp, Zea mays
  misc_feature: Ceres CLONE 1479540-F
  misc_feature: Encodes the peptide sequence at SEQ ID NO. 54459
  misc_feature (446)..(446): n is a, c, t, g, unknown, or other
  misc_feature (481)..(481): n is a, c, t, g, unknown, or other
ctggagctccccgcggtggcggccgctctagaactagtggatcccccgggctgcaggaattcgtctcacccctagaaaaaacagagcagccacttggatccggtgctcagcggaacagctagctatagcctgtagctagcagctagcttcagtcacaggccggacggtcggctcacacacagctagccgccgccgctgctagcttagccaccagtagtccgatctgatctacaggcagggggccagcaggggcagctagctagctagccgcgcgccggcgccatgatgaacctgaacctgaagcagcctctggtgctgcccgcgcaccacagcaatgtcgtcggctcgcgcctgtcgtcgccgtcgccctcggcggccgcccgcagcaggaggaccggcggcggcgtgtcctcccggtccggctccccgcggcccgtgcggctggngaggatcagctgcagcgccaccgaagaggtcagcngcgccgtgtcgtccgtcaccggtgaagagatgctgacggtgacggcgtcggtggaggcctcccccggccatcggcagatgtactttcagcgcgccgtcgacgacgtcggcgaactattcgggaagacgctgctgctggaactcgtcagctccaaactcgaagcaaagtcggg

SEQ ID NO: 54459 - protein, 123 aa, Zea mays
  misc_feature: Ceres CLONE 1479540-F
  misc_feature: SWISSPROT Homolog: EC 1.13.11.12 Lipoxygenase
  misc_feature (55)..(55): Xaa is any aa, unknown, or other
  misc_feature (67)..(67): Xaa is any aa, unknown, or other
MMNLNLKQPLVLPAHHSNVVGSRLSSPSPSAAARSRRTGGGVSSRSGSPRPVRLXRISCSATEEVSXAVSSVTGEEMLTVTASVEASPGHRQMYFQRAVDDVGELFGKTLLLELVSSKLEAKS

SEQ ID NO: 54460 - DNA, 653 bp, Zea mays
  misc_feature: Ceres CLONE 1479541-F
  misc_feature: Encodes the peptide sequence at SEQ ID NO. 54461
ggagctccccgcggtggcggccgctctagaactagtggatcccccgggctgcaggaattcgtctcacccctagaaaaaaacctcatcttctctccttttgctcggaacgcacacaccgcccggtctccgatctccgatccccgatcccctcgtcgatccaagatgcagatcttcgtcaagactctcactggaaagactatcaccctcgaggtggagtcctctgacaccattgacaacgtcaaggccaagatccaggacaaggaaggcattcccccggaccagcagcggctcatcttcgctggcaagcagctcgaggacgggcgcacacttgccgactacaacatccagaaggagagcaccctccaccttgttctccgcctcaggggaggcatgcaaatcttcgtcaagaccctcactggaaagactatcaccctcgaggtggagtcttctgacaccatcgacaacgtcaaggccaagatccaggacaaggagggcatccctccggaccagcagccgctcatttttgctggcaagcagctcgagaacgggcgcacgctggccgactacaacattcagaaagagagcccccctccacttggtgttgcggcccagggggcggcatgccaaacttcggggaaaactctgactgggaa

SEQ ID NO: 54461 - protein, 163 aa, Zea mays
  misc_feature: Ceres CLONE 1479541-F
  misc_feature (6)..(74): Pfam Name: ubiquitin Pfam Description: Ubiquitin family
  misc_feature (82)..(143): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQPLIFAGKQLENGRTLADYNIQKESPPPLGVAAQGAACQTSGKTLTG

SEQ ID NO: 54462 - DNA, 1061 bp, Zea mays
  misc_feature: Ceres CLONE 1479545-R
  misc_feature (1061)..(1061): n is a, c, t, g, unknown, or other
tttgttttggcttgggctgcaacatcagggcgagacccaaacgatctggatttcagaaaatactatacctcacattgcactatccttttccttagcatggccaattcagagtcgccgtgtgttaacaaccctcataaaacttctccccgactcccggtgatggtcatgactggatacttttcttttcatccagaactatgcgaccagagggcgtagaaccaccgacatatggcgaacactaaaacacgataactaagaatatttatggttactgaagctcgatctagtggccaaagcaaactccatgtcatggtgggtgcccttactgtgcccacttatttggctgtgttgttgtttttgtagggggtggaaacaaattccttgccagcccccccaccaccccccaggttttagtaactgccgccaaccgccgggggaactacccactttttgtttcccctttagtacaaaggttcccatccccccccctaggggaaaaacacaggggtcaaaagggtgtgttctcctttttgtcaaaactttgttattcctccctcttcttgtttcccccgccaagaacttttgttgtatgccgtggaaggccgctttagagcggttacaaggcccgtgggggcgttggcgccctgacattgaaccgggcaggcgaaaacacacgcacgactttctgttgtgtcgagtcttatagtgcctcctacccttcctcccgatctgtttcttcccctgaggacgtgcataaaacccctccttctcagtttggcctcactcttcgctttctattatttaaatttcgtggcttacaagacttgccaggtggagagtagtgcaggtttgtctccgctgtatgtgggggagggtgtatatgctacccctttcatactcctctatcttttgtattcccgtttgtttcttcggtggctatgttctctcatacacgcgcgaaccgcgtatttatcgtattcttgccaaatgagcgggatcacaccacatctcttccccgccatatacgtctgtgacaaacaccgcggcactgcactcctttn

SEQ ID NO: 54463 - DNA, 660 bp, Zea mays
  misc_feature: Ceres CLONE 1479547-F
  misc_feature: Encodes the peptide sequence at SEQ ID NO. 54464
  misc_feature (295)..(295): n is a, c, t, g, unknown, or other
aaagctggagctccccgcggtggcggccgctctagaactagtggatcccccgggctgcaggaattcgtctcacccctagaaaaattgaaatcaatcgtgttcctcgcctgcacgacgagagcccgagaccaatccagccgccgcctccgccttcgcctcgcctagtattccctccgattcagaggccgatggagtgcatcgccgagatgccccgcgcgccgctggacagcaggctgcgcaagcgtcagcgtctcggctgggacgtcggccctgccgagatgtataagggcgtgcngccgcggcacgggtgggacgtcggccccgccgagatgtatcagttagaactttgtgggacagaagttgtgaatgccatcagtgctgcagcgttgggcctttcgtcgggctgtgtttcttctcaagtcaaacaagagcagcttcatgatggttcccctctctgagagaaatgacagggatgggcattatgtttttgctgttggagataactcacatctcgctatagatcaatgcaaaatggggagaagtacctttggcaggttgttgagtgttgggacaggaaaggaaagaatgggtggctatcaaatctttaggggattaaaaagaccgggatgctgcaatgatccaaatgggctgctccaacag

SEQ ID NO: 54464 - protein, 89 aa, Zea mays
  misc_feature: Ceres CLONE 1479547-F
  misc_feature (36)..(36): Xaa is any aa, unknown, or other
MECIAEMPRAPLDSRLRKRQRLGWDVGPAEMYKGVXPRHGWDVGPAEMYQLELCGTEVVNAISAAALGLSSGCVSSQVKQEQLHDGSPL

SEQ ID NO: 54465 - DNA, 694 bp, Zea mays
  misc_feature: Ceres CLONE 1479548-F
  misc_feature: Encodes the peptide sequence at SEQ ID NO. 54466
aaagctggagctccccgcggtggcggccgctctagaactagtggatcccccgggctgcaggaattcgtctcacccctagaaaaacccaagtcctaagctagccagctgagctcgctcccagtccaagcgccggcgccaccaccgcagctgctcgctggtcaccatgagcaaggagaagcaccaccgcgactggatcctccggcgctgctgtggctccctcgccgcctgcatcctgacgctggccgccgtcgtcggcttcatcgtgctcgtcatcttcctggcgctgcgcccctccaagccgtccttctacctgcaagacgtgcagctgcgctccatcgacctcagcgacccggcgctctccctcgacctccaggtgacgatcgcgtcgcggaacccgaacgagcgggtgggcgtgtactacaatacgctggacgcgttcaccacgtaccgcgacgaggcggtgacggtccccgtgtcgatgccggcgatctaccagggccacaaggacatgtcggtgtggtcgccggtcatgtcgggcgacgcggtccccgtggcgcattacgtggcggacgccatgaagcacgacatcgaggcgggatacgtgctgctccacatcacgttggactgccgcatcaagtggaaagtcggcagctgggtctcggagcatctacacctcctcgttcacttgccccgg

SEQ ID NO: 54466 - protein, 177 aa, Zea mays
  misc_feature: Ceres CLONE 1479548-F
  misc_feature (38)..(173): Pfam Name: Hin1 Pfam Description: Harpin-induced protein 1 (Hin1)
MSKEKHHRDWILRRCCGSLAACILTLAAVVGFIVLVIFLALRPSKPSFYLQDVQLRSIDLSDPALSLDLQVTIASRNPNERVGVYYNTLDAFTTYRDEAVTVPVSMPAIYQGHKDMSVWSPVMSGDAVPVAHYVADAMKHDIEAGYVLLHITLDCRIKWKVGSWVSEHLHLLVHLPR

SEQ ID NO: 54467 - DNA, 662 bp, Zea mays
  misc_feature: Ceres CLONE 1479560-F
  misc_feature: Encodes the peptide sequence at SEQ ID NO. 54468
  misc_feature (80)..(80): n is a, c, t, g, unknown, or other
  misc_feature (326)..(326): n is a, c, t, g, unknown, or other
aaagctggagctccccgcggtggcggccgctctagaactagtggatcccccgggctgcaggaattcgtctcacccctagnaaagacccctctcgcttggatccggacggcccggtccctccgccctcccatgcgcacggcgccgccgccgccgacatgacgctcgcctccctcgcccgcgccctcggccggtccgcgcgctcctcccgcccgcgccagggtttccagctcgggggcctccggcagccgcccgcgccaccgctaccgccgcctgtccacggcggtgagggtggggcggcaggatttgttcgcagctacctgactgcngtctcgtcggcagctcttcggaagccatccgcgggcaagaccgtggattggagatatgtcctcgccagcccacattttcgacgcctcctctccgacgggtcaagaaggactacgagaactattacccccagggtaagagggaggtgcctaaaggagatggtacaaacagtctgaatctaagcagggatcccatacagatgaaggatggaattttcgggataatgcttgaaacacatgcagaattcccttgcccttttattgatctgggcctgaagcttcatccatgtcctctacctccgcagaccaaaaaggaataagctccaaggagttcaagaa

SEQ ID NO: 54468 - protein, 114 aa, Zea mays
  misc_feature: Ceres CLONE 1479560-F
MTLASLARALGRSARSSRPRQGFQLGGLRQPPAPPLPPPVHGGEGGAAGFVRSYLTAVSSAALRKPSAGKTVDWRYVLASPHFRRLLSDGSRRTTRTITPRVRGRCLKEMVQTV

SEQ ID NO: 54469 - DNA, 703 bp, Zea mays
  misc_feature: Ceres CLONE 1479562-F
  misc_feature: Encodes the peptide sequence at SEQ ID NO. 54470
  misc_feature (415)..(415): n is a, c, t, g, unknown, or other
  misc_feature (553)..(553): n is a, c, t, g, unknown, or other
agagctggagctccccgcggtggcggccgctctagaactagtggatcccccgggctgcaggaattcgtctcacccctagaaaaaacgaatcccgtcttcttcctttcttggccttctccacctcatcgccgagacgagatctctcccacacgaggaagggagagatgggcgggcgggtggatcacgagtactcctacctgttcaagatggtcctcatcggagacagcggcgtcggcaagtccaatatcctctctcgcttcacgcgcaaccacttctccctcgactccaagtccaccatcggcgtcgagttcgccaccaagtccctgcagatggacggcaaaacaataaaggctcagatctgggacacagctgggcaggaaaggtacccgtgcatttacagtgcctactaccgtgnagccgtaggagccctccctgtgtacgacatcacaaaggagcagagcttcgatcatgttcacaggtggcttcgtgaactccgcgaccatgctgactccagtattgtgatcatggatggcgggaaacaattctgacctantccacctggaaagctatcctctaaagatcaaaggccaaaccgttgcctgaaaaagaaggggtttgtttttcctcgaaactttccctttgggggcttaaaaacggggggaaaccttctcaaaattttttagaaggggttctttggggtttt

SEQ ID NO: 54470 - protein, 127 aa, Zea mays
  misc_feature: Ceres CLONE 1479562-F
  misc_feature (14)..(128): Pfam Name: Ras Pfam Description: Ras family
  misc_feature: SWISSPROT Homolog: EC 2.7.11.1 Non-specific serine/threonine protein kinase
  misc_feature (84)..(84): Xaa is any aa, unknown, or other
MGGRVDHEYSYLFKMVLIGDSGVGKSNILSRFTRNHFSLDSKSTIGVEFATKSLQMDGKTIKAQIWDTAGQERYPCIYSAYYRXAVGALPVYDITKEQSFDHVHRWLRELRDHADSSIVIMDGGKQF

SEQ ID NO: 54471 - DNA, 368 bp, Zea mays
  misc_feature: Ceres CLONE 1479564
  misc_feature: Encodes the peptide sequence at SEQ ID NO. 54472
taaaaagaagaatcaatggattcatgattaaacccctcctacttcttgtattttcatacaattttgattaagtgagggatcaaatagaaatatgtagtcgactttatttgaaggtagtttggaggattataaatatgaatattgctttccaattacctgtttttgcattaattgcgacttccttagttttagtaattagtgtaccccttgtatttgcttctcctgatggttggtcaaataataaaaacgttgtattttccggtacatcattatggattggattagtctttctggtagctattctgaattctcttattccttgaatttgcttagtatttagtaacccgataccaaaaaaaaaaaaaaaa

SEQ ID NO: 54472 - protein, 62 aa, Zea mays
  misc_feature: Ceres CLONE 1479564
  misc_feature (4)..(62): Pfam Name: Ycf9 Pfam Description: YCF9
MNIAFQLPVFALIATSLVLVISVPLVFASPDGWSNNKNVVFSGTSLWIGLVFLVAILNSLIP

SEQ ID NO: 54473 - DNA, 706 bp, Zea mays
  misc_feature: Ceres CLONE 1479571-F
  misc_feature: Pfam Name: Lir1 Pfam Description: Light regulated protein Lir1
  misc_feature (385)..(385): n is a, c, t, g, unknown, or other
  misc_feature (420)..(420): n is a, c, t, g, unknown, or other
  misc_feature (421)..(421): n is a, c, t, g, unknown, or other
  misc_feature (440)..(440): n is a, c, t, g, unknown, or other
  misc_feature (472)..(472): n is a, c, t, g, unknown, or other
  misc_feature (477)..(477): n is a, c, t, g, unknown, or other
  misc_feature (607)..(607): n is a, c, t, g, unknown, or other
  misc_feature (609)..(609): n is a, c, t, g, unknown, or other
  misc_feature (610)..(610): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (653)..(653): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
tggagctccccgcggtggcggccgctctagaactagtggatcccccgggctgcaggaattcgtctcacccctagaaaaaaagcgtttcagatcgtactggaccaatctgccaccacactttgatcacactccgacactggaagttgagatcacaaaaatgcgggctgccgctactgccgccgggttctaggccgtgctgcccgccaagggaaggcctcgggagaggagcatggtggtggcccatatccccgccacaaggaagagggtccgcgcagctgccgtcttctagaccgaggacccgcacatcgactacaggtcaagcgtctcggtggtccccaaggaggcctgctatctagttcgcggcgaaaagcggcaggggaccctnttcccagaagcaaaatctgtttccccccccccccnnccaaaaacgagaatgggangggggggaagggactacctttctttcaaaaancacanaaatttcttcacgggtgagccccgcaaaacaaccaaccgcgcgaggtcccgggggcccagaaaaggcaccaactactcagagcaagggaaccccggatggacgaaccccaaccacggcccgttattctancnngaccccccactctttgcgtgaatatatnnnnaatcatcatatncgcccccccgcacctcaccctcnnnatatcctccaattgttaccccactcgcc

SEQ ID NO: 54474 - DNA, 677 bp, Zea mays
  misc_feature: Ceres CLONE 1479575-F
  misc_feature: Encodes the peptide sequence at SEQ ID NO. 54475
  misc_feature (406)..(406): n is a, c, t, g, unknown, or other
  misc_feature (677)..(677): n is a, c, t, g, unknown, or other
agaagctggagctccccgcggtggcggccgctctagaactagtggatcccccgggctgcaggaattcgtctcacccctagaaaaaatcgcagcagcacgagcagcacgtcgtgccgctccaaccatctcgcttccgtgcttagcttcccgccgcgccatggcgtcgaccaaggctcccggccccggcgagaagcaccactccatcgacgcgcagctccgtcagctggtcccaggcaaggtctccgaggacgacaagctcatcgagtacgatgcgctgctcgtcgaccgcttcctcaacatccttcaggacctccacgggcctagccttcgcgaatttgtccaggagtgctacgaggtatcggccgactacgagggcaaaggagacacgacgaaactgggcgagctncgcgccaagctcacggggctggcccctgccgacgccatcctcggtgcgagctccatcctgcacatgctcaacctcggcaacctggccgaggaggtgcagatcgcgcaccgccgcccgcacagcaaaactcaggaaaggtggcttcgcccacgaaaggctcccccaccaccgagtccgaaatcgaggagacgctcaagcgccctcgtgtccgaggtcggcaaatccccccgaggaggggtgtcgaggcgcctcaaaaaccagaaccgtccan

SEQ ID NO: 54475 - protein, 173 aa, Zea mays
  misc_feature: Ceres CLONE 1479575-F
  misc_feature: SWISSPROT Homolog: EC 4.1.1.31 Phosphoenolpyruvate carboxylase
MASTKAPGPGEKHHSIDAQLRQLVPGKVSEDDKLIEYDALLVDRFLNILQDLHGPSLREFVQECYEVSADYEGKGDTTKLGELRAKLTGLAPADAILGASSILHMLNLGNLAEEVQIAHRRPHSKTQERWLRPRKAPPPPSPKSRRRSSALVSEVGKSPRGGVSRRLKNQNRP

SEQ ID NO: 54476 - DNA, 653 bp, Zea mays
  misc_feature: Ceres CLONE 1479579-F
  misc_feature: Encodes the peptide sequence at SEQ ID NO. 54477
  misc_feature (533)..(533): n is a, c, t, g, unknown, or other
  misc_feature (534)..(534): n is a, c, t, g, unknown, or other
ctccccgcggtggcggccgctctagaactagtggatcccccgggctgcaggaattcgtctcacccctagaaaaagtcttcttctcccatctcatcgtcccatcccatcccatctcgaactcgtctcacttgtccattcatccgtgttgcttcaccgccttctcttcggattgggattgtaatcagaatcggattgcatcgttacacactcaaggcacatacagcagcaccaatgatgagcgacgcgtggccgtcatccccctactcctcgtcggcgcccgacggggaggtcctgcgctccctgcaccgcctggcgcgggacctgtcggcggccgaggcgccggcgccgttccctgcggcggtcttcgcagcggtggccaggcgggcgcgcctgctggcccgcgtgttcaacgacctgctgctgtgcgttgcggccgcgggcccgctgctgctgctgccgcgctccgcgtccctgtgcctccgggagctcctgctcgtgctgcaagcgttcaaggcgctcggtgggcgattgcnncacgcgcagccgcacgcgcctgctgcttcattcggacaaggtggccgcccgggcccgggaactccaaccgacctcgccacgttgatcgacctgtccccggccgggaattcggttcctta

SEQ ID NO: 54477 - protein, 140 aa, Zea mays
  misc_feature: Ceres CLONE 1479579-F
  misc_feature (101)..(101): Xaa is any aa, unknown, or other
MMSDAWPSSPYSSSAPDGEVLRSLHRLARDLSAAEAPAPFPAAVFAAVARRARLLARVFNDLLLCVAAAGPLLLLPRSASLCLRELLLVLQAFKALGGRLXHAQPHAPAASFGQGGRPGPGTPTDLATLIDLSPAGNSVP

SEQ ID NO: 54478 - DNA, 669 bp, Zea mays
  misc_feature: Ceres CLONE 1479583-F
  misc_feature (282)..(282): n is a, c, t, g, unknown, or other
  misc_feature (304)..(304): n is a, c, t, g, unknown, or other
  misc_feature (406)..(406): n is a, c, t, g, unknown, or other
aaagctggagctccccgcggtggcggccgctctagaactagtggatcccccgggctgcaggaattcgtctcacccctagaaaaactttttccccttcacagccccgtactactatccccgctaccgctagccgccgcgctgctcatctggtggcggctcgcctccctccccccatccgccgccgccggctcctcctctagctccctccttaccccgagctttaagctcgtgctacctgcctacctatccgtagggagagagagagagaggggagaaggttcngtcggtcggtcgggggctctcngatctcgccgctgcctccccgtttcttcgttgggatctcgctcgcttcgcgccatggccgccgtcgggacgccacggggcccccgcccccgccgcgccgggnacgggtatccccaccccctgctgctccggctcccgtcaccgtcccccctgccgaggaccaaaccacggatctcctgaaaaagttgtcgctgaatccccaccccaaggcggggggggccacaaaaccttgttgttgcttgccctgcccccaaggagggtgctttaaaaaaaccagcccgctgaggtgggcccatcccccccaaagggggtctattccgccggggggcttaggggacttttaggggccccccacctgtgtcctac

SEQ ID NO: 54479 - DNA, 644 bp, Zea mays
  misc_feature: Ceres CLONE 1479586-F
  misc_feature: Encodes the peptide sequence at SEQ ID NO. 54480
  misc_feature (491)..(491): n is a, c, t, g, unknown, or other
  misc_feature (536)..(536): n is a, c, t, g, unknown, or other
  misc_feature (539)..(539): n is a, c, t, g, unknown, or other
  misc_feature (551)..(551): n is a, c, t, g, unknown, or other
  misc_feature (578)..(578): n is a, c, t, g, unknown, or other
  misc_feature (584)..(584): n is a, c, t, g, unknown, or other
  misc_feature (587)..(587): n is a, c, t, g, unknown, or other
ctccccgcggtggcggccgctctagaactagtggatcccccgggctgcaggaattcgtctcacccctagaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaagcggcggcggtgggtacggtggtggccgtggagggcggcgctacngcggtggcgggcgccgtgatggcggtggcggctacggcggtggcngcngctacggtggcngcggcggctacggtgggtggtgcggcngctacngcnggtgcaaccgtgcgggggctacggcaactccgacgggaactggagaactgagcggtg

SEQ ID NO: 54480 - protein, 157 aa, Zea mays
  misc_feature: Ceres CLONE 1479586-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (107)..(107): Xaa is any aa, unknown, or other
  misc_feature (122)..(122): Xaa is any aa, unknown, or other
  misc_feature (123)..(123): Xaa is any aa, unknown, or other
  misc_feature (127)..(127): Xaa is any aa, unknown, or other
  misc_feature (136)..(136): Xaa is any aa, unknown, or other
  misc_feature (138)..(138): Xaa is any aa, unknown, or other
  misc_feature (139)..(139): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGSGGGGYGGGRGGRRYXGGGRRDGGGGYGGGXXYGGXGGYGGWCGXYXXCNRAGATATPTGTGELSG

SEQ ID NO: 54481 - DNA, 784 bp, Zea mays
  misc_feature: Ceres CLONE 1479587-F
  misc_feature: Encodes the peptide sequence at SEQ ID NO. 54482
ggagctccccgcggtggcggccgctctagaatagtggatcccccgggctgcaggaattcgtctcacccctagaaaaaacagcatctcaagccaccatcgaccttcaagtctcgctacgtagcagtggcaataaaaaaagcagccgcaatggcgaggagaccatgggccctcttctccccgggcctttccggggaaggcgtgaaaagtgccttctcctccccctttggggaggcccccggtacatttataaaaataggtgtaaaagcacacccccggcggggtttttgggaccccgggggtcctcccaccccccgcgttttatgtgggtttttttgtgggggtattttttttattttcgtgggtgtgtgttccccccccccccccctctttttcttccccgtgcgcgggtttgaccccaccccccccctttctttccaaacaaagggcaagatggttcttttcctacctcttgtcttccaccgccatcacatttttggtaccctttattttatgctttgcggaggaacccccccccccccacctcctaccccctcagttattatcccttcgttcccttctttattatccccccccaacctcttgtgtgccttaatttagggccccaaacccccctctcccccgacccttaatttccccttattttttgttttacaaccccccctcccttcgcccagtacatttttcagatagaggccgttaaaacaacccccacaagactacacctctccatttttgggtttcttttttgttcccgcacctctgg

SEQ ID NO: 54482 - protein, 156 aa, Zea mays
  misc_feature: Ceres CLONE 1479587-F
MARRPWALFSPGLSGEGVKSAFSSPFGEAPGTFIKIGVKAHPRRGFWDPGGPPTPRVLCGFFCGGIFFIFVGVCSPPPPLFFFPVRGFDPTPPLSFQTKGKMVLFLPLVFHRHHIFGTLYFMLCGGTPPPPPPTPSVIIPSFPSLLSPPNLLCALI

SEQ ID NO: 54483 - DNA, 636 bp, Zea mays
  misc_feature: Ceres CLONE 1479596-F
  misc_feature: Encodes the peptide sequence at SEQ ID NO. 54484
  misc_feature (265)..(265): n is a, c, t, g, unknown, or other
  misc_feature (288)..(288): n is a, c, t, g, unknown, or other
  misc_feature (340)..(340): n is a, c, t, g, unknown, or other
aagctggagctccccgcggtggcggccgctctagaactagtggatcccccgggctgcaggaattcgtctcacccctagaaaaagccagctcgctcctcgccccgcccccttctctcagcggcgacgcctcgggcgttcctaccctgccccctctccggaccccccacgccgtcggcgaagcagccgggcaagagcccgatccagaccccgcgagcaatccttgatatacctgatggctatgattgatgagcctctgtacccattngctgtactgattgatgagcttangaatgaggacatccagttgcgtctaaactccattagaagactttcgacattngcacgggctcttggagaagaaagaaccaggaaggagctgattccctttcttagtgaaaacatgacgatgaagatgaggtgcttcttgcatgggctgaggattgggtgtgttcatccttatgttggggggtgtagacatgctcatgttttgcttcccccttggaaacattggtacagtagaagaacttgggtcgtgataaagcagttgatctctgtgcgtatgggtcacaatgaaggaactgaatagtcgactggtcattcagtaaaaagaggctacagctgggagtggttacagtc

SEQ ID NO: 54484 - protein, 117 aa, Zea mays
  misc_feature: Ceres CLONE 1479596-F
  misc_feature (11)..(11): Xaa is any aa, unknown, or other
  misc_feature (19)..(19): Xaa is any aa, unknown, or other
  misc_feature (36)..(36): Xaa is any aa, unknown, or other
MAMIDEPLYPXAVLIDELXNEDIQLRLNSIRRLSTXARALGEERTRKELIPFLSENMTMKMRCFLHGLRIGCVHPYVGGCRHAHVLLPPWKHWYSRRTWVVIKQLISVRMGHNEGTE

SEQ ID NO: 54485 - DNA, 682 bp, Zea mays
  misc_feature: Ceres CLONE 1479598-F
  misc_feature: Translation starting site: 109
  misc_feature: SWISSPROT Homolog: EC 5.4.3.8 Glutamate-1-semialdehyde 2,1-aminomutase
  misc_feature (461)..(461): n is a, c, t, g, unknown, or other
aaaagctggagctccccgcggtggcggccgctctagaactagtggatcccccgggctgcaggaattcgtctcacccctagaaaaagcgcgagacgagcaagcccaagtatggccggagcagcagcagccgccgtggcgtccggggtctcggcccggccggccgcgccgatgagggcttctgcgggacgccgcgctcggctgtcggtggtgcgggccgcgatatccctcgagaagggcgagaaggcgtacacggtgcagaagtccgaggagatcttcaacgccgccaaggagctgatgcctggaggtgttaactcgccagtccgtgccttcaaatctgttggtgggcagccagtagtgttcgactctgtaaagggttctcgtatgtgggatgttgatgggaatgagtacattgattacgttggttcctggggtcctgcaatcatcggccatgcagatgatanggttaatgctgcattgattgaaactctgaagaaaggactagctttggtgctccatgtttgctggagaacgtattggctgagatggtcatctctgccgtgcaaggtatcgaaatgttccgcttttgtcactccaggacagaagcctgcttgggagcgcctccgcctcgtgcgcgcattctccggggcggggagaagatcatcaaggttcgaaaggctgcttc

SEQ ID NO: 54486 - DNA, 725 bp, Zea mays
  misc_feature: Ceres CLONE 1479600-F
  misc_feature: Encodes the peptide sequence at SEQ ID NO. 54487
aaagctggagctccccgcggtggcggccgctctagaactagtggatcccccgggctgcaggaattcgtctcacccctagaaaaatcctccgctgccctcctcgcctccctcgattcagggttcagcgaattccgacagaacccggagtgtccgtgtcgaccgacccgtccccctgcaagtctgcgacgagtctgctgccgctcttcccggccgggcgaaatggacggtgtcgttgtcaagagggtcatcccttcggataacagttgcctcttcaacgctgtgcgctacgtgatggagcacaaccgatataacgcttctgagctcagacaggtcatatcagcaacagtcactggtgatcctgataaatcaatgaagtgtatcttgacaactcaatgagacgtattgtgcttagcatttcgaatcgtgaaaagtgggtgaggaggcattgacctctctatgctatctgagtactacggggcgtgaaatcccaaacttatgacatccaaaccaaccgcttgtgatttctttgggccggtagaagaatttcggggaaagggccattgcccatttagaaggggttgacataaagaggcatccccaatggttcccggctaaaaggacccccgaaaaaatttgccaaaacaccttcccccttaaaaaaaacctctccctttggcccgccaaaagcccttgccctctttttatggggggagccctaaagcaaa

SEQ ID NO: 54487 - protein, 58 aa, Zea mays
  misc_feature: Ceres CLONE 1479600-F
MDGVVVKRVIPSDNSCLFNAVRYVMEHNRYNASELRQVISATVTGDPDKSMKCILTTQ

SEQ ID NO: 54488 - DNA, 751 bp, Zea mays
  misc_feature: Ceres CLONE 1479603-F
  misc_feature: Encodes the peptide sequence at SEQ ID NO. 54489
  misc_feature (415)..(415): n is a, c, t, g, unknown, or other
  misc_feature (417)..(417): n is a, c, t, g, unknown, or other
aagctggagctccccgcggtggcggccgctctagaactagtggatcccccgggctgcaggaattcgtctcacccctagaaaaaattgggggcatttgctacaccaccacacccacaccccatcccagcacacaacaagcagcctggtttacggtagctgctagcaaaacaatggagaaccctgctccgagcatcgtagtggccatcgccgcacccgtggcggcggagttcgtgaaactcaccttccgtgccctgtatatgcgccgggctggtcctggcagcagggagatgactgtgccgggaaggccatccgaccagctgggcaggagagtcgtcactgacagccccgtgtacgacggccgtggcgccgacgcccgcctcgtggctcgcatacagggagtcacggtccctggccngnaacgcagacgcccttgtcaccattggtgttcgaaactgacaggctaaaaggctccacgctcgtcatcaacggaatggccacggatgggtcagaacaaatggccaatctacggcggaacccggggtggtcccccatggcccccggggccatgaaaagaaaaaaactttgccggcgggaaccacaacgggaactttgaaaaagtttccccggaaaatttttttcccggggtttggcgcacccccccccacccctttgagagggcgggggggccccctccccccccccaccaaaaaaataatattgggggccaaaagaagggttccccaaagaaaat

SEQ ID NO: 54489 - protein, 97 aa, Zea mays
  misc_feature: Ceres CLONE 1479603-F
  misc_feature (82)..(82): Xaa is any aa, unknown, or other
  misc_feature (83)..(83): Xaa is any aa, unknown, or other
MENPAPSIVVAIAAPVAAEFVKLTFRALYMRRAGPGSREMTVPGRPSDQLGRRVVTDSPVYDGRGADARLVARIQGVTVPGXXRRRPCHHWCSKLTG

SEQ ID NO: 54490 - DNA, 699 bp, Zea mays
  misc_feature: Ceres CLONE 1479606-F
  misc_feature: Translation starting site: 236
  misc_feature (699)..(699): n is a, c, t, g, unknown, or other
aagctggagctccccgcggtggcggccgctctagaactagtggatcccccgggctgcaggaattcgtctcacccctagaaaaaaactaaccatattggccgtgcgtccgtggctttgcatctgcaaccccgcccgatcaatcttcctcgttccgccgctccctcgcctccggcagcgaggtgaggccaccgatcggaccttccctagcggcggcgcctaccaacctcaaggagcgatggctctgtctgcgacgctacggatttctcttagcgtcgcgttctttggggttctggcgttcgtgcttggtgtcatcgccgaaaacaaaaagcctgcttccgggactcctatcctaggaaaggatgtcgtcatctgcacgtttccaagtgatccgactcttgcgatggggagcccccccattgtggcacttgtggtagctgccatcgtaggccatgttgccatcttctttcatactcgggcaagtcagttcctcgtggagcgctgtttcaaagcaccagcttgacagtgttctttgttgttgctgagcttgtcttcacccctggctcttgcaatggccctggtgggccactgtcaccgaagggtcttccccgcacccatgaacatcccccccgacatgggactccccggggcccccctgcccaaaacccggcccttgttcggggggcccctttattcctcccn

SEQ ID NO: 54491 - DNA, 715 bp, Zea mays
  misc_feature: Ceres CLONE 1479611-F
  misc_feature: Translation starting site: 179
  misc_feature: SWISSPROT Homolog: EC 1.11.1.11 L-ascorbate peroxidase
  misc_feature (422)..(422): n is a, c, t, g, unknown, or other
  misc_feature (453)..(453): n is a, c, t, g, unknown, or other
aaagctggagctccccgcggtggcggccgctctagaactagtggatcccccgggctgcaggaattcgtctcacccctagaaaaagacgcaggcaccccagcagctcttgcggtcgtccctcagccgcgtcgcaccgcatcgcattctacgattcgaagctctctgctcgcaggggaccatggcgaagaactacccaaccgtgagcgccgagtacagcgaggccgtcgagaaggccaggcgcaagctccgcgccctcatcgccgagaagagctgcgcacccctcatgctccgcctcgcgtggcactccgcggggacgttcgacgtgtcgtcgaagaacggcggtcccttctgtactatgaagtgccggagcgaactgactcacggcgccaacgcgaggctggacatcgcggtgcggctgctcnagcccatcaaggaggagtccccaccctcttntatgccgacttctacagcttgcccgagttgggcccttcaaggtcaccggtggggctgaaatcccctttcacccaggcggggaggaaaaagcctcacccccccctgagggccgtcttcctaatgcccccagggttttaaacccctggggcaatttttgcaaaccaaagggttttaaggtaaaaagaacctttcccccttccggggggccccccctggggaagggcccacaaaagggccctgggttttaggggcccgcaaaccc

SEQ ID NO: 54492 - DNA, 685 bp, Zea mays
  misc_feature: Ceres CLONE 1479614-F
  misc_feature: Translation starting site: 423
aaactggagctccccgcggtggcggccgctctagaactagtggatcccccgggctgcaggaattcgtctcacccctagaaaaatcggagcgccagcccatcggtacggcggcgcagggcacggacgacaaggactactaggagcccccgccggcgccggtcttcgagcccggggagctcaagtcctggtccttctaccgcgccggcgatcgccgagttcgtcgccgccttcctcttcctctacatctccatcctcaccggcgtgggcgtctccaagtccacctccaagtgcgccaccgtcggcatccaaggcatcgcctggaccttcggcggcatgatcttcgccctcgtctactgcaccgccggcatctccggcgggcacatcaacccggcggtgaccttctggctgttcctcacccccaaatgtccctcaccacggcggtgttttacatcatcatgcagtgcctgggcgccatctgcggcacgggggtcgtcaaggggttccagcaggggctgtacatgggcaacggcggcagcacctacgtcgtcgcgcccggctacaccaagggcgacagcctctgcgccgatatcgtcggcaccttcatcctcatctacgccgtcttctcctccaccgacgccaagatgaacgccagggactcccatgtgccgatcctcgcccctcttca

SEQ ID NO: 54493 - DNA, 680 bp, Zea mays
  misc_feature: Ceres CLONE 1479615-F
  misc_feature: Encodes the peptide sequence at SEQ ID NO. 54494
aaagctggagctccccgcggtggcggccgctctagaactagtggatcccccgggctgcaggaattcgtctcacccctagaaaaaacttccactcccacccacccacacgcacggccgcaggcagcagcaccatgtggtcggcagtcaacggcggcggaggcgcgcgcggagtccgtgtccccagacccggcgccttctctcctcagcggccggcgcggcgggtcgcggggcggccggaggtcggtgtcggtgcgcaacacggtgtgggacttcgtgggcggcgacctgctgcggccggacctgagcaaatggctggacgacgtgtagaagcacaaggcgctggccatctacccgccacacgagggcggctacgatggccgctacctgaaccgcctccgttaccagggctactacttcctcgacctctccgcgcgggggctcggcgacccggagaccacgctcaccaaggtccaccccgtctgcccgcctatcctcggcaggcagccggtggcgcggtggtacttcccgccggaagtggactacaggctcagcctgctgcacccggacgccgaacgcctcgtcttctggatcatcgaagccaaggttctgtccaaggctgagctgcaagtcctgggcatgctcccggacatccgcccaaaagtcagggtgatcccacggtg

SEQ ID NO: 54494 - protein, 108 aa, Zea mays
  misc_feature: Ceres CLONE 1479615-F
KAGAPRGGGRSRTSGSPGLQEFVSPLEKTSTPTHPHARPQAAAPCGRQSTAAEARAESVSPDPAPSLLSGRRGGSRGGRRSVSVRNTVWDFVGGDLLRPDLSKWLDDV

SEQ ID NO: 54495 - DNA, 751 bp, Zea mays
  misc_feature: Ceres CLONE 1479641-F
  misc_feature: Encodes the peptide sequence at SEQ ID NO. 54496
  misc_feature (268)..(268): n is a, c, t, g, unknown, or other
  misc_feature (332)..(332): n is a, c, t, g, unknown, or other
aagctggagctccccgcggtggcggccgctctagaactagtggatcccccgggctgcaggaattcgtctcacccctagaaaaagcaaccagctattgagctactgcctctgaccaagtcccaagctgcgctgcgcctgctatgtcgtcgtcctcgcccgtatcggcggtctcatcagccactgcgccgcacgtcgtggacgactgcctcggcatcgtgcagcttcttagcgatggcaccgtgacgcgctccgcggactactccgacantcctctcctgggcgaggtgccgtccacctgcccgtccagtgaaggacgtcgtctacgacctcgngaacgggctccgccttcgcatgtacaggcccaccgacacgaaggggggagggaggacaacaaaaaagttgccgggcccccccaccttcacagggggggggtttctcatttggaggttttaaaaagcccccctttccccccgggggggttctccctccccccccaattcccgggggtttggggttttccccaaaaatacccccgggggcccaaaaacccccccccccccggggccccccgaacccacaagggccttttgtttttggttcccccccccaagcaagaccccaccccgtgttttttcaacacccgctaaaaaagggggggtgttttttttttttggagaaacccgcgccggggggaatttttggcccaaacatatccccccaaaagggggggggggccccctctccccccctg

SEQ ID NO: 54496 - protein, 33 aa, Zea mays
  misc_feature: Ceres CLONE 1479641-F
MYRPTDTKGGGRTTKKLPGPPTFTGGGFLIWRF

SEQ ID NO: 54497 - DNA, 657 bp, Zea mays
  misc_feature: Ceres CLONE 1479653-F
  misc_feature: Encodes the peptide sequence at SEQ ID NO. 54498
  misc_feature (522)..(522): n is a, c, t, g, unknown, or other
  misc_feature (605)..(605): n is a, c, t, g, unknown, or other
  misc_feature (612)..(612): n is a, c, t, g, unknown, or other
aagctggagctccccgcggtggcggccgctctagaactagtggatcccccgggctgcaggaattcgtctcacccctagaaaaaagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacgcctgcggctgcggtagcagctgcaagtgcgacccctgcaactgctgatcacatcgatcgacgaccatggatatgattattatctatctagcttgtgggtggtggttgaacaataataagcgaggccgagctggctgccatacataggtattgtgtggtgtgtgagaaagagagaaaaacanagttcttcagtttgctatctctctctctgcatggttggcgtcagtctttgtgctcatgtacgtgtgtctacatgcatggtggntgatccngatgcgtctgctgtaacatatattaatggtccacgatgatatgat

SEQ ID NO: 54498 - protein, 76 aa, Zea mays; identical to SEQ ID NO: 42649
  misc_feature: Ceres CLONE 1479653-F
  misc_feature (1)..(76): Pfam Name: Metallothio_2 Pfam Description: Metallothionein

SEQ ID NO: 54499 - DNA, 688 bp, Zea mays
  misc_feature: Ceres CLONE 1479658-F
  misc_feature: Encodes the peptide sequence at SEQ ID NO. 54500
  misc_feature (688)..(688): n is a, c, t, g, unknown, or other
aagctggagctccccgcggtggcggccgctctagaactagtggatcccccgggctgcaggaattcgtctcacccctagaaaaacccatctcacggctagctagcacaagcatagtgcaggggcttgccacctaagtaaggcccgcctgagagccatggcatccaaggccgtcctcttcttggctctcaacctcctgttcttcacggtggccaacgcctgcggcaactgcccgaccccaacgcccccggtcgagccaccgccgccgcctcctgctgctaccccacccccttcgtccagcggcaagtgcccgctgaacgcgctcaagttcggcgtgtgcgccgatgtgctcggcctcgtcaaaggcgaggttggcaaggtgcctgccgagccatgctgtaccctcatcaaaggccttgcggacttcgaggccgccgtctgcctctgcacggccatcaaggccaacgtgctcggcgtcgtcgtcgatgtccccatcaagctcagcgcgctcgtcaactactgtggcaagtgcgtgcccaagggctacatgtgcgcgtaagcagctccgggcggttacacgctcgtagctgttcacgtacgagattatatatgcacgcaccctgcatggcacgaatgcatgcattgtgtccgctgatatatctctcctgtctcagttgtgcacctagctttn

SEQ ID NO: 54500 - protein, 133 aa, Zea mays; identical to SEQ ID NO: 52393
  misc_feature: Ceres CLONE 1479658-F
  misc_feature (51)..(132): Pfam Name: Tryp_alpha_amyl Pfam Description: Protease inhibitor/seed storage/LTP family

SEQ ID NO: 54501 - DNA, 731 bp, Zea mays
  misc_feature: Ceres CLONE 1479663-F
  misc_feature: Encodes the peptide sequence at SEQ ID NO. 54502
  misc_feature (407)..(407): n is a, c, t, g, unknown, or other
  misc_feature (468)..(468): n is a, c, t, g, unknown, or other
  misc_feature (469)..(469): n is a, c, t, g, unknown, or other
  misc_feature (505)..(505): n is a, c, t, g, unknown, or other
  misc_feature (529)..(529): n is a, c, t, g, unknown, or other
  misc_feature (530)..(530): n is a, c, t, g, unknown, or other
  misc_feature (534)..(534): n is a, c, t, g, unknown, or other
aagctggagctccccgcggtggcggccgctctagaactagtggatcccccgggctgcaggaattcgtctcacccctagaaaaaagccggcgaggccgttccaatccgttcccccggttctcattcccaccccgcctcctattctcctcgctcgcgctgacgggctcccacacgcaccccccctctgtgccgccacaccaaaaccgcactccaccgccacagtccccgcctccgcgtcgctgtcgtccgtcatcggtgccgtcgcttccccagcacggtacccctagcgccagcgcacgctataaggcaccgcggtctagccatggcgcccgcaccggcatcgctctccgcgcccaacgccctctccctgcccgcgcctgctagagtcacctccgggaggtggaacangagcctgtctgtctccgccgctgcgcggtccgtgtcccgggtggtgtctgtcgcgtccgcnngcagcgtcacggcgcaaaggaagctggtcgccgcgncagccgccacggaaaatgcccctnncgcnacgggggaaggagggaagcaagccctcctggaagaaatgcgggcggtccccataaacctgccaaccaaggaccaagcccgcaagggggaaaaggaaccttcggggccccccggtcccacaggggaacccccccccaaggggtacctcccaaattctcgctaaaggaaggttcttttttaaaaactttagggcccttt

SEQ ID NO: 54502 - protein, 124 aa, Zea mays
  misc_feature: Ceres CLONE 1479663-F
  misc_feature (29)..(29): Xaa is any aa, unknown, or other
  misc_feature (50)..(50): Xaa is any aa, unknown, or other
  misc_feature (62)..(62): Xaa is any aa, unknown, or other
  misc_feature (70)..(70): Xaa is any aa, unknown, or other
MAPAPASLSAPNALSLPAPARVTSGRWNXSLSVSAAARSVSRVVSVASAXSVTAQRKLVAAXAATENAPXATGEGGKQALLEEMRAVPINLPTKDQARKGEKEPSGPPGPTGEPPPKGYLPNSR

SEQ ID NO: 54503 - DNA, 705 bp, Zea mays
  misc_feature: Ceres CLONE 1479668-F
  misc_feature: Translation starting site: 166
  misc_feature (403)..(403): n is a, c, t, g, unknown, or other
  misc_feature (404)..(404): n is a, c, t, g, unknown, or other
  misc_feature (434)..(434): n is a, c, t, g, unknown, or other
  misc_feature (445)..(445): n is a, c, t, g, unknown, or other
ctggagctccccgcggtggcggccgctctagaactagtggatcccccgggctgcaggaattcgtctcacccctagaaaaaaaccgagacaccgcgtgcgaaccaagcagaccccagcagaagaagcgaagtcgtcgccggagcaggaggaagagcgaggagcaacatgtcgtggcaggcgtacgtcgatgaccacctgctgtgcgacatcgaaggccagcacctcagcgccgccgccatcgtcggccacgacggcagcgtctgggcacagtccgagaacttccccgagttaaagcctgaggaggttgctgggatgataaaggacttcgatgaacctggaactcttgcaccaactggtcttttttgtggaggtacgaagtacatggtgatccaaggtgacctgnnagtgtcatcccgagaaagaaggcactggangcattactatncagaaaactggcatgtccctgattatccggatctatgatgaggccatgactccagggcaatgcattatggttgtgggaaaggttcggcaattacttgatcgaacagggcttctaaggggtgttttggtttgaggaaccctccctccaaaagggggggggcctcagggacccttccccaaattggggggaaaacccccttcccctttttggcccccacccctttaagggaaggggggggagggggccccccttctccctcc

SEQ ID NO: 54504 - DNA, 684 bp, Zea mays
  misc_feature: Ceres CLONE 1479679-F
  misc_feature: Encodes the peptide sequence at SEQ ID NO. 54505
aaagctggagctccccgcggtggcggccgctctagaactagtggatcccccgggctgcaggaattcgtctcacccctagaaaaagacacttccatcaccgcccatcgaaatccttctaccgccccgctccgtcatccatggctcgtctgctcgcggcgcgagcccttgcgctggcccgcccctcggggacgccatccgccctacgcttctgcccctcccgtgcgctgtcggacgaggtggagttcgtcgagatcgacctatccgaggagtcccctgcctcttcatccggaggggaaggcgagggcgactcagccacggttcaggcgcagatggggtcgcggcgcctggaggacgccatctatggggtgctcgtgcgccgggcggcgcccgaatggctccccttcgtgcccggggcatcctactgggtcccgccgttgccgcggccgctcggggtggcgagtctcctcggcgcggctgtgtacaccgcgaggggcgccacggcgatgacggaggaggaggcgttcagcttcactaccgtacgggggtgtccatccgcggcgtactttgtgggaggaaaatttctgcgtccagtgaagaaatcaagggaagatgctactcaaactgacgatggtgatgaaagctaattctatgctgcttcacctggggctcctaccgaagagggct

SEQ ID NO: 54505 - protein, 168 aa, Zea mays
  misc_feature: Ceres CLONE 1479679-F
MARLLAARALALARPSGTPSALRFCPSRALSDEVEFVEIDLSEESPASSSGGEGEGDSATVQAQMGSRRLEDAIYGVLVRRAAPEWLPFVPGASYWVPPLPRPLGVASLLGAAVYTARGATAMTEEEAFSFTTVRGCPSAAYFVGGKFLRPVKKSREDATQTDDGDES

SEQ ID NO: 54506 - DNA, 684 bp, Zea mays
  misc_feature: Ceres CLONE 1479687-F
  misc_feature: Pfam Name: Herpes_gG Pfam Description: Glycoprotein GG/GX
  misc_feature: SWISSPROT Homolog: EC 3.2.1.18 Exo-alpha-sialidase
agagctggagctccccgcggtggcggccgctctagaactagtggatcccccgggctgcaggaattcgtctcacccctagaaaaaactgctcgagctcagctcaagtaaccacagaaaatggcgtcacttctccgccctctcgtcctcgtgctcctgatcgcctcctgcacagcgcagcagtcaccgccggcgcagcccccgccaacgccgaacgcgccaccggccaactcgccgccccaggcgcctccagccggcaacccgccgccggcaggcaacccgccacccgcgcccaccgccactccacctccggccccgaccactccgcccccggccccgaccactcctcccccggctcccacaacgccgcccccggcgccgacaactccacctccggcccccaccacgccgcctccgtccccaccagcgtcgccaccgcccgctcccaccactccgccaccgtctcccccggcaagcccgccgcccgctcccgccaccccgccaccgtctccgcccatggcgccacctcccgccacgccccctccacccgccaccccgccgccaccggccgcgcccacgccggccccgagcgtggccccgactcccccgcccgtggcgacaccggctgcgtcccccaagagccccaagacgccgagccccgccgccgcgacgtccccggcgccatcg

SEQ ID NO: 54507 - DNA, 660 bp, Zea mays
  misc_feature: Ceres CLONE 1479704-F
  misc_feature: Encodes the peptide sequence at SEQ ID NO. 54508
aagctggagctccccgcggtggcggccgctctagaactagtggatcccccgggctgcaggaattcgtctcacccctagaaaaaatcatgaaagtgacagtgattggacttggtttcgtgaaagctgaaggtgtggttaactccatgactaggcatggagaccgcagagaacttctcaagggcccgctgtattatgcctgtgctataactctgacaacaatagttttctggaggacatctcccatctcaatcgcggtgatctgcaatttgtgtgccggagacggtgttgctgacatagctgggagacgattcgggcatgttaagctccctcacaaccctgaaaaatcatatgccgggagcatcgcaatgttcttggcaggtttcatcgcatcagtactgttcatgtgctacttcacattttcgggtttgttgagaagagctggagcatggttgctgcctttggtgtgatatccctggctgcagcagttgtggagtcactcccgatcagcacacgccttgacgacaatcttgacgtttctgtcccatcagtgcttagtggcgccctttgttttctatttccattgggaccagaaacctgtgctgcctgaccaccgaagtcagggaaaagtatccccagccaaccgttggaaatggtgttttc

SEQ ID NO: 54508 - protein, 154 aa, Zea mays
  misc_feature: Ceres CLONE 1479704-F
AGAPRGGGRSRTSGSPGLQEFVSPLEKIMKVTVIGLGFVKAEGVVNSMTRHGDRRELLKGPLYYACAITLTTIVFWRTSPISIAVICNLCAGDGVADIAGRRFGHVKLPHNPEKSYAGSIAMFLAGFIASVLFMCYFTFSGLLRRAGAWLLPLV

SEQ ID NO: 54509 - DNA, 675 bp, Zea mays
  misc_feature: Ceres CLONE 1479728-F
aagctggagctccccgcggtggcggccgctctagaactagtggatcccccgggctgcaggaattcgtctcacccctagaaaaaaaggccgggacgaaagcaagagggctgtacctactgcaaaaggacaagcacttgctgatgagtacgggatcaagttttttgaaacgagtgcgaagacaaacctgaatgtggagcaagtgtttttctccatcgcacgtgacatcaagcagaggcttgcggagactgattcaaagccagaggacaaggcaatcaaaattaacaagccagaccagggttccgaggcaccagctgcccagcgatctgcttgctgcggctcataagcagatgcacgatggccatagcctttggttatttgacattatttatttcccgcttggctgttataggaaggatttgaagaagccacttatgatataccgatgtggttgtactcgtggttgcttccattctttgaagcaaccacctcttgctgttgacgtagctattgctattgctgggagctattgcactcttgcattgggatccgttggaaaaactctcccctccctacagtgtgtaatgaatgaaatccatgtcgttgggtttgcatggaataacgtgtcgctcctgtgtgtgtgttttaagtgtcgccgtccttgataatcgaatttgt

SEQ ID NO: 54510 - DNA, 818 bp, Zea mays
  misc_feature: Ceres CLONE 1479732-R
  misc_feature: Translation starting site: 471
  misc_feature (654)..(654): n is a, c, t, g, unknown, or other
  misc_feature (725)..(725): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
tttacaattgggtacctcgagcgtctcgtttttttttttttttttatttttttttttttttttttttttttttttttttttaagcacaacagctttgtgcaagtgctattacatttaaacaatcaagaatcgaacattttaagagaaagtaacaatatctgctcatattattccactgcaaatacatgatggtgcagtttccagtttttgctacatacttctcttgatatcatcataccaactggccctattcaacatctgcttaaaaatgttagcgtatggtagtaggcctgatacattatttttctccattcttgaacagggcagctaaacccagccgccaattgaacttcatagacatctcttgcctcgccaccttcgaagcctctgcgaacgctgcggcggaggcggaacccctagggggcggcggcggaggcaggtgaacgcacgagacggcggctgcttcggcgatggtggagaagccctggcgctgcttgtgcttggcgttggccgtgcattggacaaagacgattccccggcgcttcaccaccttgcagaaccggcacaggcgcttcaccgccgcacggaccttcatcttcttctttgatcccccgctcgcctcggggccttctcgtcttccttccgtcctttttntttttttgtttgtttttttttttttttttttttttgttttgttgtttttgtaatttaattttttttttttntttttttnnnnnnacccgggggggaaaaaaattccggcccccgggggagaacccttattttagaagggcccccccccgggggggaaccccctt

SEQ ID NO: 54511 - DNA, 648 bp, Zea mays
  misc_feature: Ceres CLONE 1479745-F
  misc_feature: Encodes the peptide sequence at SEQ ID NO. 54512
tggagctccccgcggtggcggccgctctagaactagtggatcccccgggctgcaggaattcgtctcacccctagaaaaactgatctctcataggcgggtaggatctctcatcaagctcttgcccatctaccgaccggcgaaggccaaacaggcgctacgagctagcgagagaggcaggcacctgcattccagggaacatggtgccgcacgcagcagtttggcagtggtgcgccacagccgaggcggtgcttgaagctcgctggccgcctgcgacgtagatacgcggccatcaggtgctcacaggaggcgacagccatagggccctgcgatcttctactcgcgcggcctgtgctcagagacctccatgctgctgctgcatcgagaacatggagcctcagcgagctcgaccgcagcagcgtcgaccgtaacgccgcctgtaactgcgtcaataacgccgccgccggcgtctacggcctcaacgccggtaacgccgccataatcccctccgagtgcggactcagcatctcctacaccatgcggacctccaccgactgctccagggtgaaactgaaccctacacgacgacgtacggcgccccgcggggccccccctggaaaaaagaatgcccatttcccattcccccccccc

SEQ ID NO: 54512 - protein, 38 aa, Zea mays
  misc_feature: Ceres CLONE 1479745-F
MRTSTDCSRVKLNPTRRRTAPRGAPPGKKNAHFPFPPP

SEQ ID NO: 54513 - DNA, 696 bp, Zea mays
  misc_feature: Ceres CLONE 1479758-F
  misc_feature: Encodes the peptide sequence at SEQ ID NO. 54514
  misc_feature (688)..(688): n is a, c, t, g, unknown, or other
  misc_feature (696)..(696): n is a, c, t, g, unknown, or other
aagctggagctccccgcggtggcggccgctctagaactagtggatcccccgggctgcaggaattcgtctcacccctagaaacccctttcttcccgaagctgtctgtcctgctcctgcgcgcgttggaggaaggaagcctaggaaagccaccgctcaccttctcgctcgctcccccaccgaacgcctcttggtgggagaagaattggccgaaaagcttccggttggctggccgggatctcttcgtctttaattaccggacccctggggggattgcctgctgcctcattagaccagaccagacagggagagggttgagttgagggggaggagaggagagagacacagacaacgggtggtcgctgggaagaggaagaagaggcccgcggggaagcggagggatccagaagaagatgacgcactgggtcctggccgtcgccattctcgccgctgcttcggcggcggcgctcctcctcggggccgaggcccagcagcagggccaccagacagagaggatctcaggaagcgccggcgacgtgctggaagacaaccccgtcgggaggctgaaggtgtacgtgtacgacctccccagcaagtaccacaacgagctgctgaagaaggaccccaggtgccctgaccacatgttcggcgcggagaacttcatgcactggttcctggtggccaacgccgntccgaccn

SEQ ID NO: 54514 - protein, 95 aa, Zea mays
  misc_feature: Ceres CLONE 1479758-F
  misc_feature (93)..(93): Xaa is any aa, unknown, or other
MTHWVLAVAILAAASAAALLLGAEAQQQGHQTERISGSAGDVLEDNPVGRLKVYVYDLPSKYHNELLKKDPRCPDHMFGAENFMHWFLVANAXPT

SEQ ID NO: 54515 - DNA, 714 bp, Zea mays
  misc_feature: Ceres CLONE 1479771-F
  misc_feature: Translation starting site: 170
  misc_feature (714)..(714): n is a, c, t, g, unknown, or other
aagctggagctccccgcggtggcggccgctctagaactagtggatcccccgggctgcaggaattcgtctcacccctagaaaaaaacccagccgcccattgccggcattgctcgcagcgctagcttcttgcgctcatcactcgtctccgaccaagatcagcaaggacggcatggctctcgaagcagcgtacgactacctgcacgtcgccgtcgtccagtgcacgcccacacaagcagcagcagtcctcggcgtcctcctcctcctcgccatccggctagccgcggcggcgaggagctcgtccgcgacgtcccccaatggaagcagcacaggctgcccgcgacgcctccggggaagctccccatcatcgggcacctccacctcatcgggttcccaccggaggtctcccttccccaacctcccacgccagtacgggccacaacgggctaatgctggggccaggtcggccccgggcccaccatcggggggccccccccccaagccccccaaggccgggtcccaaacccaaaacaaggggtggggtccccccccgggaacccccgccccaaaatttttcgtttaaattcccaggaaaggggcttttcccccttaggggaaaatttgggcccccggcccgaaagggggaaacaatccttcccccccccccaaaaagggtcctcccacacgggggagaacaagagagaagagggtcccccn

SEQ ID NO: 54516 - DNA, 698 bp, Zea mays
  misc_feature: Ceres CLONE 1479788-F
  misc_feature: Encodes the peptide sequence at SEQ ID NO. 54517
  misc_feature (337)..(337): n is a, c, t, g, unknown, or other
  misc_feature (420)..(420): n is a, c, t, g, unknown, or other
  misc_feature (422)..(422): n is a, c, t, g, unknown, or other
  misc_feature (424)..(424): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
aaagctggagctccccgcggtggcggccgctctagaactagtggatcccccgggctgcaggaattcgtctcacccctagaaaaatacacagagccactggccacaggtaggcaggcaggaggacgagtcggcaaggaagctgcctgctttcagaaagagtcatatagatagttattaagatggcgttgcttcggctgcttgccctctccctgctcttcgcagtggccactcctgtcagggacatcgcccacgatgcctgctcgtcagaagtgaaggatttccagcacctgagcaacagctcggggctccacctgacgctgcaccacccgcagagccnctgctccccggcgccgctgcccgccgacctccccttctccgcggtgctcgcccacgacggcgcgtgcatggggccccccaccncncncctcaccaagacgccgacctctcggcccaccctgtttgacgagaacccgcccgggatcgtcatcacgccccccatgagagcctcgggccgtgcgctggactggaagtccgtcgctcggaatactctcccatggctcggccccgccaatgactcttgcggaaagggcttaccagggcnnnnccnnnnnncccccgcgcaattcagtggnnnnnnnnnnnnnnnnnnnnnnnnnnnnnncnnnnnnnnnnnnnnnnnnnnnnnnnnnnnnnnnnng

SEQ ID NO: 54517 - protein, 151 aa, Zea mays
  misc_feature: Ceres CLONE 1479788-F
  misc_feature (53)..(53): Xaa is any aa, unknown, or other
  misc_feature (81)..(81): Xaa is any aa, unknown, or other
  misc_feature (82)..(82): Xaa is any aa, unknown, or other
  misc_feature (141)..(141): Xaa is any aa, unknown, or other
  misc_feature (142)..(142): Xaa is any aa, unknown, or other
  misc_feature (143)..(143): Xaa is any aa, unknown, or other
  misc_feature (144)..(144): Xaa is any aa, unknown, or other
  misc_feature (145)..(145): Xaa is any aa, unknown, or other
MALLRLLALSLLFAVATPVRDIAHDACSSEVKDFQHLSNSSGLHLTLHHPQSXCSPAPLPADLPFSAVLAHDGACMGPPTXXLTKTPTSRPTLFDENPPGIVITPPMRASGRALDWKSVARNTLPWLGPANDSCGKGLPGXXXXXPAQFSG

SEQ ID NO: 54518 - DNA, 714 bp, Zea mays
  misc_feature: Ceres CLONE 1479792-F
  misc_feature: Encodes the peptide sequence at SEQ ID NO. 54519
  misc_feature (364)..(364): n is a, c, t, g, unknown, or other
ctccccgcggtggcggccgctctagaactagtggatcccccgggctgcaggaattcgtctcacccctagaaaaaactgcccccccatcacgccgcccgccctttctcggccgttgccgcgagctcgcttcgacccaccgccgatggcgacggcgatgggcgcgatggccgccacctgcatggcctcgatcccggccgccgctacgttccccggtgatctcggcgtcggacgacgccgagcggttgtaccagggtggcgcgccggtgggagacggctgcgtgcgacgccgcctgcccggaggccgttcctgttctcgccgaagggcgtttcggactcgcggagctcgcaaacgtgccttgatccngacgccagcacgagtgttcttgggatcatccttggagggggtgctgggaccaggctgtatccactgactaagaagaggggcgaaccagcagtgcccgttggcgcccactaccggctccaagattttccctggcaagaactgtctcaaacagtaacgttttcaaaaattttgtgctaaacaagtttaaatttggttttttttaaaccgccccctttgaaggccccttggaaacaaatttggcggggcaaaaaaagaggatctcttaaagccttttcccccccaagggcccaaaaaacccccgtgtttttggggaaccacaaaaccccgccctaaatttgggggtttttggg

SEQ ID NO: 54519 - protein, 132 aa, Zea mays
  misc_feature: Ceres CLONE 1479792-F
  misc_feature: SWISSPROT Homolog: EC 2.7.7.27 Glucose-1-phosphate adenylyltransferase
MATAMGAMAATCMASIPAAATFPGDLGVGRRRAVVPGWRAGGRRLRATPPARRPFLFSPKGVSDSRSSQTCLDPDASTSVLGIILGGGAGTRLYPLTKKRGEPAVPVGAHYRLQDFPWQELSQTVTFSKILC

SEQ ID NO: 54520 - DNA, 674 bp, Zea mays
  misc_feature: Ceres CLONE 1479798-F
  misc_feature: Encodes the peptide sequence at SEQ ID NO. 54521
aagctggagctccccgcggtggcggccgctctagaactagtggatcccccgggctgcaggaattcgtctcacccctagaaaactaaccctaacttcttttctattctcctccccagccgccattcacatccggccgccaggaagcaccggcgcctggccgacggcgagcctcccttttcccttctctgtcttctgttttcgttctatcagctgcgcagaacttcagccgccaaggaactctttcttggccgaccgcgcgctgcttcttcctctctgttttttttctttgccgcgctcgtccggccgcaaggaggctcctggctgaccgcgacgtggttatcctgaccgagcggttccctggctgaccgagtgatctctctctgttctttttcttaaaaaaatgagcatggccgaccgcacttgttgctctaattatgtcttttctttctttccctgtctttgtttttgtgcgttctctagcatctggccactagttcactggagcacatgcagttcattcgttacaccactggccatacagccatatgcctcacggtccctttttttttgcatcacttgaactcagccgaaaaataccgtggtgctcatggcccgtttttggttacacttgtactcatatcccagctcatgtattcgatccctctcttctgtgc

SEQ ID NO: 54521 - protein, 59 aa, Zea mays; identical to SEQ ID NO: 44720
  misc_feature: Ceres CLONE 1479798-F

SEQ ID NO: 54522 - DNA, 680 bp, Zea mays
  misc_feature: Ceres CLONE 1479806-F
  misc_feature: Encodes the peptide sequence at SEQ ID NO. 54523
  misc_feature (358)..(358): n is a, c, t, g, unknown, or other
ggcggccgctctttactagtggatcccccgggctgcaggaattcgtctcacccctagaaaaaaacacaaagtcaaagcgcagcgcagccagagtaagcacagagttgcatttggggaaaaaattaccgtgcttcttcagttcttcttcctagcatgcactcgcttgtgaggcgtggcaatggctacggctacggatatggtggttacggcagcagcaatccccatatgaactatcaccaccaaaacaccgagtccgtgaccaccgtcgtcacgaagatgaaccgaatgggcgtcgaccacaagccctgctacggcttcggcgtgcacaagctggcctgcaaggtggaggcgttccacnaacacaactaaccctacaacggcgccgtggtcttccaccacaaccactcctccttctatgacgacaaggaggacgcgcgcggcgctgctgccgccgtcagaagctggcacgactagttatacacggcagagaatgatgagaagcacgtcttcgacatcgaatacggagaccgctacagggggtggcgccccccaactgaaaaaaaccgggcctacaactaacaaccaaaacgtaggcctacctgtgaagatcgataggtgaatggttaccggctaagggtcaccccgcgcatcggcttgttttgaaaacaacccaagcactg

SEQ ID NO: 54523 - protein, 71 aa, Zea mays
  misc_feature: Ceres CLONE 1479806-F
  misc_feature (69)..(69): Xaa is any aa, unknown, or other
MHSLVRRGNGYGYGYGGYGSSNPHMNYHHQNTESVTTVVTKMNRMGVDHKPCYGFGVHKLACKVEAFHXHN

SEQ ID NO: 54524 - DNA, 704 bp, Zea mays
  misc_feature: Ceres CLONE 1479807-F
  misc_feature (371)..(371): n is a, c, t, g, unknown, or other
atagctggagctccccgcggtggcggccgctctagaactagtggatcccccgggctgcaggaattcgtctcacccctagaaaaaacacgaggctgaacgcttgaacctgaacctccaaagcagcaaccccagcagctttagctcctcctcatcgcagccgcagcgccgtcccctactcttccagcgaccaactgctgtctctccggcgacggcagaaccgtctctgcaggtgcagggagggacccgggagatgagtctggggctgctcaacacagagcgcaaccaccttctctcctcgaagccgcagagccctcgggatgccgccgtgtcgtcactgctgaggacacccagggcgtcctgcggctcctgcnccaaagcccccagccgaagcccaccaagatggcgcaccccccccctggagcgctcgctcaacttcaagaactggggaggcggacgacagccggggcgggaatcaaacgaacgcgcccggggcgccttggcgcttgcacaccggaaaaccccccggcgcgtgggtcttcgggtcccccccgggccccgggccaggtctaaaacactctcccccctcccccccccggggagattgggaccggggggccccccaccttttaaaaaaaaattcaagggggcggggaaagacccccaaaccttccccaagggggccctttctgcgaaaaaaagtgggg

SEQ ID NO: 54525 - DNA, 668 bp, Zea mays
  misc_feature: Ceres CLONE 1479812-F
  misc_feature: Translation starting site: 213
  misc_feature (592)..(592): n is a, c, t, g, unknown, or other
  misc_feature (668)..(668): n is a, c, t, g, unknown, or other
ctggagctccccgcggtggcggccgctctagaactagtggatcccccgggctgcaggaattcgtctcacccctagaaaaaccgagccccccttctcctcgctgactcggctcccctcctccgccgtcgccggaggcgaagcaagtggggaccacagaagcattagctgggtgaacccactcaaagggggcagggaattgtgtgctagtttgaatggctgctacaaagcttcaggccctttggaaccacccggctggccccaaaaccattcatttctgggcgccaacattcaaatggggcatcagcattgccaacatagccgactttgctaaaccacctgaaaagatatcttaccctcagcaagttgctgttgcatgcactggactcatttggtcaagtacagcttggctatcacaccgagaaactggaaccttttcagtgttaacgttgcaatgacgggtacaggcctgtatcagctgtcacggaagatcaggcaagattacttatccgatgagaaagatgctgcttcacaactgggagcatagataatggacacagggcaagaaatacgtattgcaaagcctgcatcctangagcctactcttgatttttttttttctgggcaagcaaagaaataacggatgggtcatgtttgtttttctggttatn

SEQ ID NO: 54526 - DNA, 755 bp, Zea mays
  misc_feature: Ceres CLONE 1479814-F
  misc_feature: Encodes the peptide sequence at SEQ ID NO. 54527
  misc_feature (323)..(323): n is a, c, t, g, unknown, or other
aagctggagctccccgcggtggcggccgctctagaactagtggatcccccgggctgcaggaattcgtctcacccctagaaaaattcttcactctccttcttcctcggtcctctcctctccgcatttcgggcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcgtctgcttcgtgctctccgacgcggactcgcgggcatctgcngcgcgcaacgatggcgagcgccttccgcttgactcccggctcacggggggtctggcccgacttcgcgttcaactggccggtgggtggtcccccccccccctccgggtccctggtttccccgtttggcaacctttcgccgcgctcgggggaagggggaaattttcggggccaaggttaaaccctccccggggggttttaaaaaaaaaaacccgcccccccgcttcctccaaaagccttaaaccccggggggcccttgccccctcctccgttttggaaaaacccctcggggggttccccccaccacccaaggggggccccccctttattcaacaaaaaagtgcggcgttgtacttttcgcaacaccatattttttttctcccggttacacccccggggggaaagatctccccgcgtttctttcccgcttgggct

SEQ ID NO: 54527 - protein, 55 aa, Zea mays
  misc_feature: Ceres CLONE 1479814-F
MASAFRLTPGSRGVWPDFAFNWPVGGPPPPSGSLVSPFGNLSPRSGEGGNFRGQG

SEQ ID NO: 54528 - DNA, 647 bp, Zea mays
  misc_feature: Ceres CLONE 1479825-F
  misc_feature: Encodes the peptide sequence at SEQ ID NO. 54529
  misc_feature (338)..(338): n is a, c, t, g, unknown, or other
  misc_feature (340)..(340): n is a, c, t, g, unknown, or other
  misc_feature (377)..(377): n is a, c, t, g, unknown, or other
ctccccgcggtggcggccgctctagaactagtggatcccccgggctgcaggaattcgtctcacccctagaaaaagccaacggcgccacggcggcgacgagaagtggcgagccccgagagcgggtttagttagaggctacgggcggtcgggcgcggcggcggcggcggccatgagcagcgggagcgagagcactaccgccagcaggtggcccgagctggccacgctgcgcgccctggcgcgcgacgccgcggagcagctgcggctgccgcgggccggcacgtcggcgtcggcgtcggcgtcctcctcgccgtggcgcgggcgcgaagaccacctccacngncaacgcaagacggccaaggtgatgcacctgctgctcntggggacccagtgaagcggcgagaggcaccgtaccgccggcggtgctcgttttgctctgcctggcatcccgcccgaacggactgtactgtactgtaccctttcccctattttctacgacgtgcacctgttcaagtctacaacgtgctgcttgtaccatataataataagggggcggggggccccttgcctttttgggtggaaaattggccccaccccccccccttttttttttcccaaaaaaaaaaaaatttttccccgttggggccccg

SEQ ID NO: 54529 - protein, 73 aa, Zea mays
  misc_feature: Ceres CLONE 1479825-F
  misc_feature (57)..(57): Xaa is any aa, unknown, or other
  misc_feature (70)..(70): Xaa is any aa, unknown, or other
MSSGSESTTASRWPELATLRALARDAAEQLRLPRAGTSASASASSSPWRGREDHLHXQRKTAKVMHLLLXGTQ

SEQ ID NO: 54530 - DNA, 658 bp, Zea mays
  misc_feature: Ceres CLONE 1479830-F
  misc_feature: Encodes the peptide sequence at SEQ ID NO. 54531
aaagctggagctccccgcggtggcggccgctctagaactagtggatcccccgggctgcaggaattcgtctcacccctagaaaaagtcgagagagtcgtccccccgcgtgctctccgcctgcggcctctgtatcccgcaaccaaaaactacccccaaaaaaagaagaaaaccccaaatcctcgagatctatcagtatcgagcgacttaccaatccgattgctagggtttagtttcgaaaaaatctgaaaaaaaattctggtcgaggggaggaggcgatgtcggcgcaagtggcggtggtgcctaatgggggcccgggcgctgtccccgcggtggtgtcgccgggagctgtcggcgtggctcagcctctcccgaccacgtcgctctacgtgggcgacctggagggggccgtctcggactcgcagctgtacgaactcttcagccaggcggggcaggtggtgtcggtgcgcgtctgcagggatgtcacctcgcgccgctcgctcggatacgcctacgtcaactacagcaatcccttggatgctgcgagagcattggaagtgctgaactttgctgctcttaacaacagcctatccgggtgaatgtatcaaaccgtgatccaagcagccgcaggagtggatctgcttacattttcataaaaaac

SEQ ID NO: 54531 - protein, 106 aa, Zea mays
  misc_feature: Ceres CLONE 1479830-F
  misc_feature (36)..(107): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSAQVAVVPNGGPGAVPAVVSPGAVGVAQPLPTTSLYVGDLEGAVSDSQLYELFSQAGQVVSVRVCRDVTSRRSLGYAYVNYSNPLDAARALEVLNFAALNNSLSG

SEQ ID NO: 54532 - DNA, 1940 bp, Zea mays
  misc_feature: Ceres CLONE 1479832
  misc_feature: Encodes the peptide sequence at SEQ ID NO. 54533
cagatcccgcactcctcgctcgcgttctccctccaccgcccccaactcctcgccgtcccaccgccccgaaccacccacacccaccactcacctccatcccccacctctgcactcccgcaattcgcgtcgccgacaacccgccccgctcggcggcggagacaaagagcgcgccgagcgcgcggcggcgggcgtagccatgctccacaagttcgcgctcgcgttcaagaccaagaccatcgagttcttcgccgaggaggacgaagacgaggacgccgaccggttagcgcgctctccggcgccgggggcggatggggtccttgcctggcagcgggtggtcgtgctgaagcccgacccgccgaaccctaaccctagcgcggatggggaggggaaggcggcgtccgggcaggaggccgccgtcgccgcggcgcttgcgacggcctcgtcgttccaggcggcgtacctgcacctgcaggccgcccacgcgccgttcctgccggatgcggcggcggccgcggacgccgccgctgtgtcgcacctccggaggctgtcggagctcaagcggatcgcgaggagcgggccggtgggcccgcccgtgacggacggtggcggggccctcacggcgcacctcgaggcccaggtgcgcgagaaccaggcactgctgcggtcgttcgacgccgtggtgaaccgcctacaggccgcgctcgacgccaaggacgccgcggccgccgcgctgcggctggacctcgaggcgctcgacgacgccaacgcgcggctcgcgggccgcctcgaccgcgcgctcgcgcctccgccgggcggggacgccgtcggcgcgatgctgtccgcgggcgtcttcgactccgtcctacgcgaggcgctccgcgtcgcgcaccggttcgcccgcgcgcttgccgaggtcctgcggtgcgctgggtgggacctggccgcggccgcagaggccgcttaccctggcgtcgcctactccaagtccggccactgccgctacgcgctcctctcccgcgtctgcctctccatgttcgacggcttcgactcctaccagttcggcgccacagccgacaccacggagcttggaggaacccagctggcagcccgcaggaacgagtcactgcagcaattcatcgagcactcagatgcagatcccatggagctgatgaattctagcccggactgtgactttgcccgattctgcgaccgcaagtacagacagctgatccatccaggcatcgagtcctcactgttcgggaactcagagtgcgggacactgccggtggtgagcgtggccggcccactctacgagctgttcgtcgcaatggcaagctcgatctggacactccacaggttagcctgggcatacgaccccgcagtcggcatattccaggtcggccggggcgcagagttctcgacggtgtacatggagaacattgtccggtcgaagaagtgttttgcggggagcaaggagcccgggaagccggtgcggccgaaggtcgggttcacggtggtgccgggcttccggctcggagggacagtgatccagtgtacggtgtatctggatcacgggaagagggaagaagacattacagattcggtttgagctggagtggaaactatacaggcaaagaaaggaaactgtacattcccaaagaaaaaggaggttatgtaaaggcgatcaagaacagtgcgtggaaataacctgcaggatcgaagtcgctgctcgatgatgagtataaagaaagctatttatcttttgatttagttttgttttttttgtgggctgtacaaaggtcaacgggtgaagagagctttgtgttctaacagagtcgaagggttattaccatctgatcttgggtaacttaattatttgtgtgtaggtcgattccatctgtaaatgtatatttatgagggagtaaaaaaaaaaaaaaaaa

SEQ ID NO: 54533 - protein, 470 aa, Zea mays
  misc_feature: Ceres CLONE 1479832
  misc_feature (57)..(197): Pfam Name: DUF641 Pfam Description: Plant protein of unknown function (DUF641)
MLHKFALAFKTKTIEFFAEEDEDEDADRLARSPAPGADGVLAWQRVVVLKPDPPNPNPSADGEGKAASGQEAAVAAALATASSFQAAYLHLQAAHAPFLPDAAAAADAAAVSHLRRLSELKRIARSGPVGPPVTDGGGALTAHLEAQVRENQALLRSFDAVVNRLQAALDAKDAAAAALRLDLEALDDANARLAGRLDRALAPPPGGDAVGAMLSAGVFDSVLREALRVAHRFARALAEVLRCAGWDLAAAAEAAYPGVAYSKSGHCRYALLSRVCLSMFDGFDSYQFGATADTTELGGTQLAARRNESLQQFIEHSDADPMELMNSSPDCDFARFCDRKYRQLIHPGIESSLFGNSECGTLPVVSVAGPLYELFVAMASSIWTLHRLAWAYDPAVGIFQVGRGAEFSTVYMENIVRSKKCFAGSKEPGKPVRPKVGFTVVPGFRLGGTVIQCTVYLDHGKREEDITDSV

SEQ ID NO: 54534 - DNA, 692 bp, Zea mays
  misc_feature: Ceres CLONE 1479837-F
  misc_feature: Encodes the peptide sequence at SEQ ID NO. 54535
aaagctggagctccccgcggtggcggccgctctagaactagtggatcccccgggctgcaggaattcgtctcacccctagaaaaagccgcagcagtagaaggtagaacaccttcttgacccgaattcaatccgtgcgcacgcaccctccgccggcgacggctcacgcatcgctcggcgcccgccccgcgtccccgagacgacgaccggcagagcgcgccctcgcggcgctacccgacacctgcgacgaaacgccccgagtccactagtcgaggagtgcgtcgacgcaggggctcgggaacgcggtgtcgccatcgcggagccctagcgagatcgtcgggaaggtccgaaggcgagcacgtgtttgtgtaacctttctccccttcttccctttgccggccggcccttcagcggcgacaagtgcccaccaggcggtggtttacgttgagctgaggagtgaggaagatgtctggaaatccagtcggcgtcgacaacacttctaggaggaaatttgacaaggaagagtacttggagagagctcgacagagggagcacagggagaaggatgaagctcggaaaagcaaggaaaggggtcctcctgtgcaaagacagcccttgaaacacagggactatgaagttgatcttgattctcgtcttggcaaagactcaggtggtgaccccgattgcaccattga

SEQ ID NO: 54535 - protein, 76 aa, Zea mays
  misc_feature: Ceres CLONE 1479837-F
MSGNPVGVDNTSRRKFDKEEYLERARQREHREKDEARKSKERGPPVQRQPLKHRDYEVDLDSRLGKDSGGDPDCTI

SEQ ID NO: 54536 - DNA, 742 bp, Zea mays
  misc_feature: Ceres CLONE 1479838-F
  misc_feature: Encodes the peptide sequence at SEQ ID NO. 54537
  misc_feature (609)..(609): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (651)..(651): n is a, c, t, g, unknown, or other
  misc_feature (661)..(661): n is a, c, t, g, unknown, or other
  misc_feature (669)..(669): n is a, c, t, g, unknown, or other
aaagctggagctccccgcggtggcggccgctctagaactagtggatcccccgggctgcaggaattcgtctcacccctagaaaaacgaccagcggtcagccccctttcggcctttccctcccatatactcgccgtcggccagcggatctaatcggggcgggcgcgatggctgggcagaaccagcggctcaacgtcgtgccgacggtgacgatgctcggcgtcatgaaggctcggctcgtcggcgcgacccgcggccacgcgctgctgaagaagaagtccgacgcgctgacggtccagttccgcgccatcctcaagaagatcgtcgcccccaaggagtcgatgggcgagacgatgcgcgcctcctcctttttccctcgcccagggccaagtacgtcccttggggacggggttccgccaccagtgtggccacccccccccccccggggatccgacccgggtccggttcccctccagaagaacgggggccgggggttcaagcccccccaaatttcacccccttttttttcaaaccccctctcgggccccccggggggcccccttagaagcggcgcccccaacccctcctgagggccttgacccctcgggggtncnnnnnnncccgccccgcggcaggnnnnnnnnnntgnnncgnctccctttancccctgcnaaaatgatccctccccggcgggaaataaaagaacgcgacattttccccctttttttcccgcgtccctgtgttg

SEQ ID NO: 54537 - protein, 140 aa, Zea mays
  misc_feature: Ceres CLONE 1479838-F
  misc_feature: SWISSPROT Homolog: EC 3.6.3.14 H(+)-transporting two-sector ATPase
MAGQNQRLNVVPTVTMLGVMKARLVGATRGHALLKKKSDALTVQFRAILKKIVAPKESMGETMRASSFFPRPGPSTSLGDGVPPPVWPPPPPRGSDPGPVPLQKNGGRGFKPPQISPPFFSNPLSGPPGGPLRSGAPNPS

SEQ ID NO: 54538 - DNA, 670 bp, Zea mays
  misc_feature: Ceres CLONE 1479840-F
  misc_feature: Encodes the peptide sequence at SEQ ID NO. 54539
ctggagctccccgcggtggcggccgctctagaactagtggatcccccgggctgcaggaattcgtctcacccctagaaaaaattcgttgcagtagtcgcagctgacggacgactgaaccaccgacagacaacatcgccgcctccgcctccaccgtctccggcctcgccggcgcctccctggccagccgcccggcgttctccaccagcttcacgcggggcagccgggtgtcggcgaggaaccccctgatgagcaggaacctggagaggaatggcaggatcacctgcatgacgtttccccgggactggctgcggagggacctgagcgtcatcggcttcgggctcatcggctggatggggccgtccagcgtcccggccatcaacggcaacagcctcacggggctcttcttctccagcatcggccaggagctggcccacttccccacgcccccgcccgtcacctcccagttctggctgtggctagtgacatggcacctgggcctgttcatcgtgctcaccttcggccagatcggattcaagggcaggaccgaagactatttcgagaagtgaagcggttatgatcggatccatcatcgctggtgctgcgttgcgtgcgtgcctgccgcaatcgaacctttgctgtgtatagggttcccatttcgtgaaatgtacga

SEQ ID NO: 54539 - protein, 106 aa, Zea mays
  misc_feature: Ceres CLONE 1479840-F
MSRNLERNGRITCMTFPRDWLRRDLSVIGFGLIGWMGPSSVPAINGNSLTGLFFSSIGQELAHFPTPPPVTSQFWLWLVTWHLGLFIVLTFGQIGFKGRTEDYFEK

SEQ ID NO: 54540 - DNA, 794 bp, Zea mays
  misc_feature: Ceres CLONE 1479842-F
  misc_feature: Encodes the peptide sequence at SEQ ID NO. 54541
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (50)..(50): n is a, c, t, g, unknown, or other
  misc_feature (248)..(248): n is a, c, t, g, unknown, or other
  misc_feature (603)..(603): n is a, c, t, g, unknown, or other
  misc_feature (719)..(719): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
caccgcccgcccaaccaaacctcacccccccccnnnnnnnnnnccaaatntacagactggagctcccgcggtggcggccgctctagaatagtggatccccgggctgcaggattcgtctcacccctagaaaaacatgatggctgcaaacttgtacatcgatcagattgaagagctgatgtttgagctctctatgtggcgctgcaacgatgagcttcgtgttcgtgccgaagaagctcaaagttcgtctngttccaaaggttacaaggttttctttgaattttgggaggaaattccttccaaacaagccctacggggggaacttggccctggaaaggaaaaattgtccaaacacagcgaaagggggtcccccacttgggggggttttggggggtttttgaaaattttcgggggaaatgctcttttttcaaaggcggaaaaagttgtttttggaccccttttgggggggggtgcaaaaaacccctgtgggaagggggggaaaaacccccccccccccccaaaaagggacccttgagactccctgggggggggggtttttcattatggggggtctccccctctgggagaatggggaaatccctcccncgagggttgtacgggggggacccccaccgtttttttgtgacgatccctcacacgcacttcgcatcggtcgtaccgcgagtgccccgagacagagcagagtgctgctgcggagctgnaggcagcgccgctgctgccccggacttcccagacgacagatcgcgacgtatcgggcgttcgcgacgtcgnnnngg

SEQ ID NO: 54541 - protein, 132 aa, Zea mays
  misc_feature: Ceres CLONE 1479842-F
  misc_feature: SWISSPROT Homolog: EC 4.1.1.31 Phosphoenolpyruvate carboxylase
  misc_feature (39)..(39): Xaa is any aa, unknown, or other
MMAANLYIDQIEELMFELSMWRCNDELRVRAEEAQSSSXSKGYKVFFEFWEEIPSKQALRGELGPGKEKLSKHSERGSPTWGGFGGFLKIFGGNALFSKAEKVVFGPLLGGGAKNPCGKGGKNPPPPPKRDP

SEQ ID NO: 54542 - DNA, 679 bp, Zea mays
  misc_feature: Ceres CLONE 1479843-F
  misc_feature: Encodes the peptide sequence at SEQ ID NO. 54543
aaactggagctccccgcggtggcggccgctctagaactagtggatcccccgggctgcaggaattcgtctcacccctagaaaaacgctaccagcccgacccaccaccaccatcgccaccattaccctctcgcccctgcctctccggccgccagcccatcccgtccccgtcccatgccgcagcgcgcagcggccgcactgacacaccagtgagcgagcagagcgagagcgaggcctgatgcggcagcggcagcaaggcgaggagcaccgggagatattcgtccagtggagaccctgcgacaagaagaggtcttaggccctccgccgccacgcgcaccggcagacaaatccgcgcaggccttcttccgatccgcaaaggcgccgcctttttcgccgattccacaggccggagcccggggagaaaggcagacagacagaccggaagatgagcgcgtccgtgggccggacccgtgtggggcggtacgagctcggccggaccctcggcgaaggcaccttcgccaaggtcaagttcgcccggaacgtcgagaccggagagaatgtcgccatcaagatcctcgacaaggagaaagtcctcaagcacaagatgatcgcccagatcaagcgggagatctcgaccatgaagctcatcaggcaccccaacgtcatccggatgtatgaggtg

SEQ ID NO: 54543 - protein, 79 aa, Zea mays
  misc_feature: Ceres CLONE 1479843-F
  misc_feature: SWISSPROT Homolog: EC 2.7.11.1 Non-specific serine/threonine protein kinase
MSASVGRTRVGRYELGRTLGEGTFAKVKFARNVETGENVAIKILDKEKVLKHKMIAQIKREISTMKLIRHPNVIRMYEV

SEQ ID NO: 54544 - DNA, 706 bp, Zea mays
  misc_feature: Ceres CLONE 1479854-F
  misc_feature: Translation starting site: 187
  misc_feature: SWISSPROT Homolog: EC 1.13.12.14 Chlorophyllide-a oxygenase
  misc_feature (421)..(421): n is a, c, t, g, unknown, or other
aagctggagctccccgcggtggcggccgctctagaactagtggatcccccgggctgcaggaattcgtctcacccctagaaaaagctttccgattttcgtttctctctcttttcctttccccccgtccctctctttctttctctcttggaattggaattggactcaaaagtttcggcggccttctccatgaacacggtggcttcgctgcctttggcgccgcgcctactcattaagccctccctcgcctgcttctccagaaaggacgtcgcccgctatggcgggatcaaggtgtacgccgtgctcagggaagacggggccgagttcgcccggaacacaacctgggggccttgttccaggtggacgaccccgggtcgcgggcccccgtcaagaagttcctgaacgtggacgaagctccccacgnggtccgctttcgacatcagtactgcgactgggaggccccgcaagatctcctcacatcaggtttttccccggaaggttgttgaaggccctcaaccttttggcaagggagttcaagccatccgggcctttgaggaaaaactccccaaattcccgcaggagttgaaaaaagttcaaattcgggccttttcttgaaaccaaatttttttggcgctccaaattttgccaaattggaacccctgtggggctttttttcagggaaaaaccccctttttttccccggggggaa

SEQ ID NO: 54545 - DNA, 712 bp, Zea mays
  misc_feature: Ceres CLONE 1479855-F
  misc_feature: Encodes the peptide sequence at SEQ ID NO. 54546
aaactggagctccccgcggtggcggccgctctagaactagtggatcccccgggctgcaggaattcgtctcacccctagaaaaagccggcgccgtccatccccaccgcacaccaccgcctccaccacgccaccgactccgcctctcgctcccccctcgccgcgccgcccgaacgccacgatgcgtcacctcctcctctcccgcttcctccgccgcggtggcggcagcggcatccccaacggccactaccaccacctccccctcctccgcgccctctcctcctccccctccccggtctcctcggacgcagagctccgcaagtacgcgggctacgcgctgcttcttctcggctgcggcgccgcgacctactactccttcccgttccccgccgacgcgctgcacaagaaggcctccccctccccgtacgcgccgctgccggaggacctccacgccgtctccaactggagcggcacgcacgaggtccacgcccgcgtcctgctccagccggactcgctcccggccctcgagggcgcgctcgccgccgcgcacaaggagcgccgcaagctcaggcccctcggctccggcctgtcccccaatgggatcgcgctctcccgcgctgggatggtcaacctcgcgctcctggacaaggggctcgacgtcaacactaaaaagaagaccgtcccggtgcaggcttgggatacttgtcgcggagct

SEQ ID NO: 54546 - protein, 178 aa, Zea mays
  misc_feature: Ceres CLONE 1479855-F
  misc_feature: SWISSPROT Homolog: EC 1.1.3.8 L-gulonolactone oxidase
MRHLLLSRFLRRGGGSGIPNGHYHHLPLLRALSSSPSPVSSDAELRKYAGYALLLLGCGAATYYSFPFPADALHKKASPSPYAPLPEDLHAVSNWSGTHEVHARVLLQPDSLPALEGALAAAHKERRKLRPLGSGLSPNGIALSRAGMVNLALLDKGLDVNTKKKTVPVQAWDTCRGA

SEQ ID NO: 54547 - DNA, 701 bp, Zea mays
  misc_feature: Ceres CLONE 1479856-F
  misc_feature: Encodes the peptide sequence at SEQ ID NO. 54548
aaagctggagctccccgcggtggcggccgctctagaactagtggatcccccgggctgcaggaattcgtctcacccctagaaaaagagccatcgccgcgtcgcctccacgcgaccgactacttctcatatcaatctatctatccggcttacccgccgccgcacgcaccaaggttgcgttcaccatattacctgtttgcttatcttctcccgagcccagtaaaccctagccgccgccacccatggacatagaggccgacggactattcggcaacaaacgagtgcacaatcgcctaggcccgggctccggcagcgctccaccatctaccaacagaaaggtctgcaactactggcgtgccggtcggtgcaactgctttatgtgccccttcctccacagcgagctccccgaggctgcgccacccaaccaccccactgtacccggggggaacgtatggcgcaaccccaacaccggaggacaaggaggtggccatcacaatatatggtggaagggcccaggagggggcatcgggattgcgagccacaagcccgctgagaagccctgcaagtactttctcgccggtacaaaatgtacctctggcgagaggtgccgctatccccacaggtacttgcaaaagccaaattatcgggaaagcttaaccttgctcaaggggaaaccaacaagggtgtccccgggcatttgcctt

SEQ ID NO: 54548 - protein, 154 aa, Zea mays
  misc_feature: Ceres CLONE 1479856-F
MDIEADGLFGNKRVHNRLGPGSGSAPPSTNRKVCNYWRAGRCNCFMCPFLHSELPEAAPPNHPTVPGGNVWRNPNTGGQGGGHHNIWWKGPGGGIGIASHKPAEKPCKYFLAGTKCTSGERCRYPHRYLQKPNYRESLTLLKGKPTRVSPGICL

SEQ ID NO: 54549 - DNA, 723 bp, Zea mays
  misc_feature: Ceres CLONE 1479857-F
  misc_feature: Encodes the peptide sequence at SEQ ID NO. 54550
  misc_feature (399)..(399): n is a, c, t, g, unknown, or other
agagctggagctccccgcggtggcggccgctctagaactagtggatcccccgggctgcaggaattcgtctcacccctagaaaaagaaacatcctcctctcctcgcagacatcttatccctcccgatcgaggccccgtttcctcctcctccggccaccgcacttagctgtcttaacttgccgttcggttcgcagcctcacgcccatggctaggaagtgctctagctgtgggaacaacggccacaactcgaggacctgcagcgggcacggcgccgggggcgggggcgtgaggctgttcggggtgcagctgcacgtggggtccctcgccgtggccatgaagaagtgcttcagcatggagtgcctgtcgtcgtcggcgtccgccgcgccgggtaatacggggncgttcttggccccaccaaagggcctcgccggcgggctcctccttcctcgtccttgtctccgggggagaaggcccccaaaaaaaatggcccacggtaccttctcccacgggcttttggcaagggcggcccagaaaaaaaaaaagggttttccttggagggggaaaaacccgggaatttcttgggggccttgaaaactcgggaaggggaataggggagggattccccggcttttttgggaaacccgcacccccccccggggggcccaccccccccaaaattttttccccggggaaacaccctccccaaaaaaaaaagggggcctcc

SEQ ID NO: 54550 - protein, 128 aa, Zea mays
  misc_feature: Ceres CLONE 1479857-F
  misc_feature (66)..(66): Xaa is any aa, unknown, or other
MARKCSSCGNNGHNSRTCSGHGAGGGGVRLFGVQLHVGSLAVAMKKCFSMECLSSSASAAPGNTGXFLAPPKGLAGGLLLPRPCLRGRRPPKKMAHGTFSHGLLARAAQKKKKGFPWRGKNPGISWGP

SEQ ID NO: 54551 - DNA, 727 bp, Zea mays
  misc_feature: Ceres CLONE 1479858-F
  misc_feature: Translation starting site: 277
aagctggagctccccgcggtggcggccgctctagaactagtggatcccccgggctgcaggaattcgtctcacccctagaaaaacagcctgccgctccccacattcccgttccgctcacagcggaaaaggaagccggctagggtttcatcttcctttcccctcctctctttcatcgacgaccgctggccaccccctcgatctcttgacccggaggcgaggacgggggccagcagcggccgccagcgcctgcccgtcttgttatagggagcgttcgccatgtctgaaatggagtctgtcgcggctcttatggactcgacaagctccaagatacaacagcttcaggaggcattcgctgagcttgagagccagagcgctttctgcatgaacttcaagtggaagcagcttgaagacgactctcctggttcttgaacaatccctcaggaaaaagtttgacgagctaaaagagcaggagaaggagttccaggagattgtcccaaaatcaaaacagatgctggaccagccggaggcatctgtttgtgcccagggaactgacctctttggaaagtttgctgaaaagaaggaagctgcattacctatgatctttaccaatcccggctttcccttactggttccttcctcaacccaaggaaaaaggccctggaaaaactggggggaaaggggcctaaaccggttttgagggggggggggccttccaatttaaaaggcc

SEQ ID NO: 54552 - DNA, 689 bp, Zea mays
  misc_feature: Ceres CLONE 1479861-F
  misc_feature: Encodes the peptide sequence at SEQ ID NO. 54553
aaagctggagctccccgcggtggcggccgctctagaactagtggatcccccgggctgcaggaattcgtctcacccctagaaaaaaagcctcacggtcacgcctcgtgtccccccaccccctcctcgtcctccaccggccgcctcacgccgtcacctccgctcggcgagtctcggctccgaccccagccgccacgtgcgacctcccctactcctgactcctgagagatctgcggggctcggcatggggtgaccagatcgggccgctgctcggtgctttccagctgaattctgcccgcagctcgtgtcggaggcagcggagatggcggaggccggcgtggcacgcggctcagggagtgctggcgatgctttgtttaggaaactctggcatgcttgtgctgggccgttggtcacaccccctcgccaaggcgagctggtttattacttcccgcagggtcatatggaacagcttgaagcgtctacaggatcaacaacttgatcagcacttgcctttgtttaatctaccgccaaaaaatctctgcaaggtggtcaatgtaaaaactaaaagctgaaactgattctgaggaaagttatgctcaaattatgctgcacccccaaacagagcaaaatggaccccacccgccccagatcctgaacccacctgaaccttgacagattccaacattcctttc

SEQ ID NO: 54553 - protein, 58 aa, Zea mays
  misc_feature: Ceres CLONE 1479861-F
MAEAGVARGSGSAGDALFRKLWHACAGPLVTPPRQGELVYYFPQGHMEQLEASTGSTT

SEQ ID NO: 54554 - DNA, 753 bp, Zea mays
  misc_feature: Ceres CLONE 1479864-F
  misc_feature (381)..(381): n is a, c, t, g, unknown, or other
  misc_feature (410)..(410): n is a, c, t, g, unknown, or other
  misc_feature (413)..(413): n is a, c, t, g, unknown, or other
aaagctggagctccccgcggtggcggccgctctagaactagtggatcccccgggctgcaggaattcgtctcacccctagaaaaatcgttgcctcccctccactctccactgttcactcccaggccccaccagcatgaggtacagatcactcggttcaccactcgctcacgccaaaacgcaccgcgccgaagtccgaatcgagtccagcaagcagggagctagtgcacgcatctaggctgggcgagagcaccaaaggaggcgccgcgggtggctccggaatgggagggcccctcggcgcgatcatcggccgctacctgtcgctgccggcggcgaccatcagttggcaggcggcgccggaggcggcactatatgccacaaccncacgtgccccgacatcgccgttctcgtgntcnccccccgcttctggcgcgacatgattgccaactcccgcttcggacttcaccaaggaaaacgagttaaagctgatttgtgaactggcctccaaagggaacggttgttgacgaaaaacattgccaacccgaatttgcaggaacctcgcacgtcaaatacctggatcgaatcccgaatctaagacctctcaagatttgggcctcgggaaccgaggggggcgtaaacctgggcggaacggtgaaaagcctttcttgccctggatgggacggacccaaaaatccgggccctgtaggaagggggattcgaagactattagtcctgggctgtgtgttcgcggggggg

SEQ ID NO: 54555 - DNA, 750 bp, Zea mays
  misc_feature: Ceres CLONE 1479870-F
  misc_feature: Encodes the peptide sequence at SEQ ID NO. 54556
  misc_feature (258)..(258): n is a, c, t, g, unknown, or other
  misc_feature (362)..(362): n is a, c, t, g, unknown, or other
  misc_feature (392)..(392): n is a, c, t, g, unknown, or other
  misc_feature (534)..(534): n is a, c, t, g, unknown, or other
  misc_feature (750)..(750): n is a, c, t, g, unknown, or other
ccccgcggtggcggccgctctagaactagtggatcccccgggctgcaggaattcgtctcacccctagaaaaatccatctgctctgctccggtccgttccgctccttcctccccctatctagctagccttcccgttcctgcatcgcggcggagatgggcgcctccaccacgccgctcgcgtcggcggcggcgctgcttctgctgctgctcgcgccgctcgccgcggcggcggacagcatgtcgatcgtctcctacggcnagcggaccgaggaggaggcgcggcggatgtacgccgagtggatggcggcgcacggccggacctacaacgccttctgcgaggaggagcgcaggttccaggtgttnagggacaacctccgttacgtcgacgcccanaaggtcgttttccaccccccccgtccacttctttctgccttggggttcaaccggtttccccaaccttcaccaacgaaaagtacccggcgccccttccttcggggttcgggagcagggccccaaaagggaaaaggagggtttngtgaaaggggtccttgcccgggaaacaccaagaaccctgccccgagatccccccaccgggggggggccaagggggccccttccccggaggtcaaaggaccacggggccacccgccgggagtattttggggttttttctcacacaataagcgccgggtggagaggggctctcacccccgattttttcctgtggggcaaccttttccccctcttgtgn

SEQ ID NO: 54556 - protein, 199 aa, Zea mays
  misc_feature: Ceres CLONE 1479870-F
  misc_feature: SWISSPROT Homolog: EC 3.4.22.14 Actinidain
  misc_feature (36)..(36): Xaa is any aa, unknown, or other
  misc_feature (70)..(70): Xaa is any aa, unknown, or other
  misc_feature (80)..(80): Xaa is any aa, unknown, or other
  misc_feature (128)..(128): Xaa is any aa, unknown, or other
MGASTTPLASAAALLLLLLAPLAAAADSMSIVSYGXRTEEEARRMYAEWMAAHGRTYNAFCEEERRFQVXRDNLRYVDAXKVVFHPPRPLLSALGFNRFPQPSPTKSTRRPFLRGSGAGPQKGKGGFXERGPCPGNTKNPAPRSPHRGGAKGAPSPEVKGPRGHPPGVFWGFFSHNKRRVERGSHPRFFPVGQPFPPLV

SEQ ID NO: 54557 - DNA, 676 bp, Zea mays
  misc_feature: Ceres CLONE 1479871-F
  misc_feature: Encodes the peptide sequence at SEQ ID NO. 54558
  misc_feature (415)..(415): n is a, c, t, g, unknown, or other
  misc_feature (478)..(478): n is a, c, t, g, unknown, or other
  misc_feature (611)..(611): n is a, c, t, g, unknown, or other
  misc_feature (612)..(612): n is a, c, t, g, unknown, or other
aagctggagctccccgcggtggcggccgctctagaactagtggatcccccgggctgcaggaattcgtctcacccctagaaaaactgcagccgccggccctcagcaagcaagcaagggacagacgcggcggggatgggcagcggggtccgggcgctgatgcgccggaagcaggtagactccgagcggacgcgcgccgccggcagcgcccaccagctccgcaaggagctctccgtcacccagctcgtcgccatcggtgttgggtcgacgattggagctggcgtctacgtccttgttggcacagttgcgcgggagcattccgggccggcattgacgctttcatttctgatagccggaatagcagctgcgctttcagccttctgctatgcggagctggctagcccgtgcccttcggcangaagcgcctatcattattcgtacatctgcgttggcgaaagagttgcatggttgattggctggnctttgatactttgaatacacgattggtggatcagcccgtgcccgtggcatttctctaatctagccttattttttggaggacaggatagtctgccatggattttacccgacaggaaatccctggcttgatgtcnntgaaaatccttgggctcttttcttcgtttcggcgccccgggctttcctgggtggggataaaaaa

SEQ ID NO: 54558 - protein, 119 aa, Zea mays
  misc_feature: Ceres CLONE 1479871-F
  misc_feature (95)..(95): Xaa is any aa, unknown, or other
  misc_feature (116)..(116): Xaa is any aa, unknown, or other
MGSGVRALMRRKQVDSERTRAAGSAHQLRKELSVTQLVAIGVGSTIGAGVYVLVGTVAREHSGPALTLSFLIAGIAAALSAFCYAELASPCPSAXSAYHYSYICVGERVAWLIGWXLIL

SEQ ID NO: 54559 - DNA, 687 bp, Zea mays
  misc_feature: Ceres CLONE 1480312-F
  misc_feature (311)..(311): n is a, c, t, g, unknown, or other
  misc_feature (314)..(314): n is a, c, t, g, unknown, or other
  misc_feature (322)..(322): n is a, c, t, g, unknown, or other
  misc_feature (323)..(323): n is a, c, t, g, unknown, or other
  misc_feature (328)..(328): n is a, c, t, g, unknown, or other
  misc_feature (329)..(329): n is a, c, t, g, unknown, or other
aaagctggagctccccgcggtggcggccgctctagaactagtggatcccccgggctgcaggaattcgtctcacccctagaaaaaaggctccatctcaccctcggcgtgtttaattactttcgatcgaagcgtgcactagccaaccattcagctgcatccaagtgtgcgatctccaggccgcagctgcttattacgtggcacgcacgcgacgcgacgatagtgaccaaaaaatggctgccagcagtgccacggcgttggcggcggcgttgttcgaggccctggacacggacggcgacggcaaggtgtctgcntcngagctacnncgcanncgctcggcggcggcggcggatgccctggactaggagaaccccgcctccgtgctcgcggcggcggtccccaacggccacggactgctgggccgcaacaagttcctcagggatgcatgcgaggctgctgccccggaaccaagcccacgcggacggcatgcggggcttgcctcagggctgccgtcgggatggtcgcggaacggccaggccaagaggggggcggcggggaacaaaggaaccgggacgcgggaacaacgccatcaccccgggaaagcctgcaagggattcctcggccgggcttccaggggggggcagaaccaacctgccccggggggcccttggacaaagtgcggggcccttt

SEQ ID NO: 54560 - DNA, 679 bp, Zea mays
  misc_feature: Ceres CLONE 1480313-F
  misc_feature: Encodes the peptide sequence at SEQ ID NO. 54561
  misc_feature (266)..(266): n is a, c, t, g, unknown, or other
  misc_feature (280)..(280): n is a, c, t, g, unknown, or other
  misc_feature (577)..(577): n is a, c, t, g, unknown, or other
aaagctggagctccccgcggtggcggccgctctagaactagtggatcccccgggctgcaggaattcgtctcacccctagaaaaaaagagcgacagagagagagagagagagaccgacgcgccggcagatcccaagttcaccggagagggggaagagggcgaccgaaggcggcgatgggtttcatcatggacttcgcggagaatctgatcctccgtctgatggaggacccgggacagcgcgaccaggttcggcgggagcatgtctancagatgaaggagcngtgcgagcgcactaaggcggcgtggagcctccctctgcgcccctacggcttctggaccttcgaccgctttcactcgcagctctcctgggatccccagatcagccaggccgccggccgtcgggacccctacgacgacctcatcgcccgccactctggctcgccgccgtcttcctgaacacccgttccgatcttttgcccagaggtctactttggcatcaataaaaaactcctccccctcaaactgattggggtttccatcttcttctgtctggaaaatgttgccacaaactaccctanttccctgttccagttggcaatgaaagtataaattggtgtactttctatctcaaaggtggtggcctttggaatagggaaagggtttccaaataatcggcagtg

SEQ ID NO: 54561 - protein, 93 aa, Zea mays
  misc_feature: Ceres CLONE 1480313-F
  misc_feature (31)..(31): Xaa is any aa, unknown, or other
  misc_feature (36)..(36): Xaa is any aa, unknown, or other
MGFIMDFAENLILRLMEDPGQRDQVRREHVXQMKEXCERTKAAWSLPLRPYGFWTFDRFHSQLSWDPQISQAAGRRDPYDDLIARHSGSPPSS

SEQ ID NO: 54562 - DNA, 665 bp, Zea mays
  misc_feature: Ceres CLONE 1480320-F
  misc_feature: Encodes the peptide sequence at SEQ ID NO. 54563
  misc_feature (241)..(241): n is a, c, t, g, unknown, or other
  misc_feature (273)..(273): n is a, c, t, g, unknown, or other
  misc_feature (274)..(274): n is a, c, t, g, unknown, or other
  misc_feature (282)..(282): n is a, c, t, g, unknown, or other
  misc_feature (295)..(295): n is a, c, t, g, unknown, or other
  misc_feature (318)..(318): n is a, c, t, g, unknown, or other
ctggagctccccgcggtggcggccgctctagaactagtggatcccccgggctgcaggaattcgtctcacccctagaaaaagcaggccgagagttgtcaaggacgacgtctgccggcagtgctcctgctcctcctcctccttcctggccgccgcgcgagcttgggttagttagtgtctcttcttcgcggagacctgtgagaggagccatcatcatggccgctgttgagactgttgtcctcanggttgctatgtcatgcgagggctgccccgggnncgtcaaangagtgctctccangatggaaggagttgaaaccttcnacatagacctcaaggagcagaaggtgacagtcaaaggctatgtcaagcctgaggacgtcttccagacggtttccaaagtcggggaagagacctcgtactgggagggcgaagcacggccccgggacgctgcggcggcttccgaagccgaagcagcctcccagacccgcggcaaaggcgcctcctgttggtgcttcggggggcccccaaaatcacccccacccaaggtgaccccctgatcgccccctttttattcctcccctgggggggccgggggttgcgaatccctaaacctttaattttaaaaaaggggggggaatgaagtttgcctttccatcccggttcttccc

SEQ ID NO: 54563 - protein, 113 aa, Zea mays
  misc_feature: Ceres CLONE 1480320-F
  misc_feature (8)..(68): Pfam Name: HMA Pfam Description: Heavy-metal-associated domain
  misc_feature: SWISSPROT Homolog: EC 3.6.3.4 Copper-exporting ATPase
  misc_feature (10)..(10): Xaa is any aa, unknown, or other
  misc_feature (21)..(21): Xaa is any aa, unknown, or other
  misc_feature (24)..(24): Xaa is any aa, unknown, or other
  misc_feature (28)..(28): Xaa is any aa, unknown, or other
  misc_feature (36)..(36): Xaa is any aa, unknown, or other
MAAVETVVLXVAMSCEGCPGXVKXVLSXMEGVETFXIDLKEQKVTVKGYVKPEDVFQTVSKVGEETSYWEGEARPRDAAAASEAEAASQTRGKGASCWCFGGPPKSPPPKVTP

SEQ ID NO: 54564 - DNA, 671 bp, Zea mays
  misc_feature: Ceres CLONE 1480321-F
  misc_feature: Encodes the peptide sequence at SEQ ID NO. 54565
  misc_feature (292)..(292): n is a, c, t, g, unknown, or other
  misc_feature (358)..(358): n is a, c, t, g, unknown, or other
  misc_feature (376)..(376): n is a, c, t, g, unknown, or other
aagctggagctccccgcggtggcggccgctctagaactagtggatcccccgggctgcaggaattcgtctcacccctagaaaaaaacaacaccagaatccgcgaatcacagacgcgtctatctcagcttgctgcactgcactaccctgccctgccatcatatcgtacgtgagcccggccgagcgagagcgagggagaagcatggctgctccgaagctcgcgacgctggcgctggccgtgctccctgcggcgacccgtgtggctcccccggccgcggtgcgcgcggcgatgtcntgctccaccgtgtacagcacgctgatgccgtgcctgccgttcgtccagatgggcggggccatgccngcccagccgtgctgcggnggcttccgcagcctgctgcaacagggcaacaacacccccgaccggcgcaccatcttgggttgcctcaagaacgtcgcccaacggcgccaaggggagcggcacctacatcagccggcgcggccccgcttcccaggaagtgcggcgtccccctgccctacaagatcagcaaccaacgttaactgcaacacgataaattaagtgatgaggcgtccctgtgccccttccggacaaagaaatcattctttggcccttggcaaaaaataaaaaaatacggctccgggttattttaagctat

SEQ ID NO: 54565 - protein, 124 aa, Zea mays
  misc_feature: Ceres CLONE 1480321-F
MAAPKLATLALAVLPAATRVAPPAAVRAAMSCSTVYSTLMPCLPFVQMGGAMPAQPCCGGFRSLLQQGNNTPDRRTILGCLKNVAQRRQGERHLHQPARPRFPGSAASPCPTRSATNVNCNTIN

SEQ ID NO: 54566 - DNA, 648 bp, Zea mays
  misc_feature: Ceres CLONE 1480322-F
  misc_feature: Translation starting site: 140
  misc_feature (272)..(272): n is a, c, t, g, unknown, or other
ctccccgcggtggcggccgctctagaactagtggatcccccgggctgcaggaattcgtctcacccctagaaaaaaaaacaccgcaatcttcaatctccccagcaatccctagcagaagccttccatcctcactcgctcgatggcccgcacgaagcagacggcgaggaagtccaccggcggcaaggcgccgaggaagcagctggcgactaaggcggcccgcaagtctgcccctgcgaccgggcgagtgaagaaaccccaccgcttccgccccnggcacgtcgcgctccgggagatccgcaagtaccagaagagcacggagctgctgatccgcaagctgccgttccagcgcctggtgcgggagatcgcgcaggactttcagaccgacctacgcttccagagctctgctgtctccgcgctgcaggaggcggctgaaggcctactttgtcgggttcttcaaggacaccaacctctgcgccatccacgccaagggcgtcaccatcatgcccaaggacatccagctggcccgccgcatccggggggagaggcctaaccctcttattttctgtcatcagtccagatcaaaaaatgagagatttgctgggttctgtagttggggtactgccaaatcatccagggtggctggccact

SEQ ID NO: 54567 - DNA, 636 bp, Zea mays
  misc_feature: Ceres CLONE 1480326-F
  misc_feature: Encodes the peptide sequence at SEQ ID NO. 54568
  misc_feature (541)..(541): n is a, c, t, g, unknown, or other
  misc_feature (542)..(542): n is a, c, t, g, unknown, or other
ctccccgcggtggcggccgctctagaactagtggatcccccgggctgcaggaattcgtctcacccctagaaaactcagtccgacagaacagcacgtgaaagcccaggcctccctccctccctctccccacctgctggaatccgcggccgctgcctgcaagggtgaccttgcttgagcccgtcttccttcttcctcagctaggcacccgtgcccatcttcagtccacctagccatgcctacgacgatggcggcggcggcggcagcgtctgctccaagctcgctccgcgtttcgcgccaggggacgatcgggggaaggcatgtcctctacagcaggtctcagagggctgccactgtctccgccagagcttcccatgaacatacgtgctgcacgaaccagacgcagacggcgcagcgcaagtcgtattcggggacgacctctccggcgtcaagttcagtgaaagagagggtgaaagcgaggctcgacgacgggggcgtcgggttcccgctttccggttcgggggaggcggaagaggaagaggcnngcgcgggcacaactcttccggcggggtcatccctcttcgtggtcgtcctgctcctggattacctcaaggaggtcaagaggaccctgcagaacgg

SEQ ID NO: 54568 - protein, 130 aa, Zea mays
  misc_feature: Ceres CLONE 1480326-F
  misc_feature (100)..(100): Xaa is any aa, unknown, or other
MAAAAAASAPSSLRVSRQGTIGGRHVLYSRSQRAATVSARASHEHTCCTNQTQTAQRKSYSGTTSPASSSVKERVKARLDDGGVGFPLSGSGEAEEEEAXAGTTLPAGSSLFVVVLLLDYLKEVKRTLQN

SEQ ID NO: 54569 - DNA, 678 bp, Zea mays
  misc_feature: Ceres CLONE 1480327-F
  misc_feature: Translation starting site: 136
  misc_feature (267)..(267): n is a, c, t, g, unknown, or other
  misc_feature (280)..(280): n is a, c, t, g, unknown, or other
  misc_feature (289)..(289): n is a, c, t, g, unknown, or other
  misc_feature (355)..(355): n is a, c, t, g, unknown, or other
ctccccgcggtggcggccgctctagactagtggatcccccgggctgcaggaattcgtctcacccctagaaatctctctcccttccttctccccgttctccgtgcaatctcggccgtttccgctcccgccatcgccatggaggaagccaaggttgtggagtccaaggacggaacgatctcagttgcttcagcatttgctggtcatcaggaagctgtgcaagacagggaccacaaatttttatcaaaggcagtggaagaagcataccgnagagttgactgcngcgatggangaccattttgtgcagttgttgtccataatgatgaagaatagttagctgccataacatggtttttgngaacactgatccaactgcgcatgctgaaataactgcgataaagagagggcttgcaaaaaggctgggaaaaatggagctggcggaattgtgaatttattgcatcctgggagcccatgcccaatggtggtttttggtgctgttcaattatcccggattaagaaggctggtgtatggaacccaaggcaagaagctgccaatggccatttgaattttaataaatttcattgccgaaggcctctcagaagaaccttgggtactttcaaaaacgccaaccttgggaaataaagcccggcagaaggaaaattgggacccctttatttgct

SEQ ID NO: 54570 - DNA, 666 bp, Zea mays
  misc_feature: Ceres CLONE 1480359-F
  misc_feature: Encodes the peptide sequence at SEQ ID NO. 54571
  misc_feature (380)..(380): n is a, c, t, g, unknown, or other
  misc_feature (397)..(397): n is a, c, t, g, unknown, or other
  misc_feature (405)..(405): n is a, c, t, g, unknown, or other
agagctggagctccccgcggtggcggccgctctagaactagtggatcccccgggctgcaggaattcgtctcacccctagaaaaagcgtgctggcctttggcaccttccagaagattcctctatctgcctccgttccgctcatggcgtccgcgccgagcaccacggcgcccaccctcgcgccctctctgcgcacgcccttctcttcagccccccgcggggcccgccttgcggccgcgccccgcctgtcccgcgctcagcccgggcaggccggatgccgcgcggcgccaggtcggtccgctcgccctagctcgcgcgttcggtgcggcgcggcggcccggttcattgggcagggcgagttcccccgcgaggtgctggagtcngagctgcccgtgctcgntgacttcntcgccgactggtgcgggccgtgcccgctcatcgcgcccgtcgtcgactgggcctccgaggatatgacgggcgagtaaaaatcgtcaagatcgatcacgacgccaatccgcagctgattgaagagtacaggtctatgggctcccgactttgattttctccagaatggccgaaaggtaccaaatagccgggagaaagggcaatgacaaaagataagttcaagcaataccctggacctctcttgactaccacagtcacttaaag

SEQ ID NO: 54571 - protein, 113 aa, Zea mays
  misc_feature: Ceres CLONE 1480359-F
  misc_feature: SWISSPROT Homolog: EC 1.8.1.8 Protein-disulfide reductase
  misc_feature (86)..(86): Xaa is any aa, unknown, or other
  misc_feature (89)..(89): Xaa is any aa, unknown, or other
MASAPSTTAPTLAPSLRTPFSSAPRGARLAAAPRLSRAQPGQAGCRAAPGRSARPSSRVRCGAAARFIGQGEFPREVLESELPVLXDFXADWCGPCPLIAPVVDWASEDMTGE

SEQ ID NO: 54572 - DNA, 642 bp, Zea mays
  misc_feature: Ceres CLONE 1480363-F
  misc_feature: Encodes the peptide sequence at SEQ ID NO. 54573
aaagctggagctccccgcggtggcggccgctctagaactagtggatcccccgggctgcaggaattcgtctcacccctagaaaaaactccaacctacccagcctcggccagccacctccccgtcgctctcacgctcttcgtgcccgccgcctcccctcttcccctccacctcactcctcccgtctgacgcacatggcctccatcgccggatcttccgctctctccttcgccatgcctgtcaaggcaatcaactcaaattctctagccttctccccggtgaggaagggtaacacattcctccgcctgcaaccagtgcctatgagatctgtttcctgcgctgccaagaaggatacggtggacaaggtttgtgaaattgtgaagaagcagcttgctcttcctgacacactgaagtttgtggtgatcgaaattctctgaactgggtgcgattcgctggacacggtgagatggtgatggggcttgaggagcactcgacattagcgtgaggagtccagcgcgcagacaattgccacggttaagacgccgctgactcgtttacaagcttggtgctgtaaaggcatagccgcatctcttcaatcattgtcttaccactctaaggttctatgggcggaagactgtgattttc

SEQ ID NO: 54573 - protein, 80 aa, Zea mays
  misc_feature: Ceres CLONE 1480363-F
MASIAGSSALSFAMPVKAINSNSLAFSPVRKGNTFLRLQPVPMRSVSCAAKKDTVDKVCEIVKKQLALPDTLKFVVIEIL

SEQ ID NO: 54574 - DNA, 655 bp, Zea mays
  misc_feature: Ceres CLONE 1480370-F
  misc_feature: Encodes the peptide sequence at SEQ ID NO. 54575
  misc_feature (387)..(387): n is a, c, t, g, unknown, or other
  misc_feature (405)..(405): n is a, c, t, g, unknown, or other
  misc_feature (415)..(415): n is a, c, t, g, unknown, or other
  misc_feature (419)..(419): n is a, c, t, g, unknown, or other
  misc_feature (431)..(431): n is a, c, t, g, unknown, or other
ggagctccccgcggtggcggccgctctagaactagtggatcccccgggctgcaggaattcgtctcacccctagaaaaaccttgccatcacctcctcgcctagcctgccactgccagcaggtgccaccgccatctctgctctgctctcgcaacgcaagcacacgcccggccgcctgccacagttgccatggcgaccatagccacgatggcgctgctgaagcccgccgccaaggccgcggcgcggtcggcgccgtccaccagcagcggcagcgtctcgctgcgcgtccggacggggcaggccgccaagaaggctgcgctgtccgtgtccgcgtcgtccacgctggcgggcgccttcctcgcggcgctggcgtcgtcgcccgacgctgcnctggcagacgtggcagcngccgaacccnggcngcaacaagcgcngccagctgctgctcgtcgtggtggcgcccggcatcgggtgggtgctgtacaacatcctgcagcgggcgctaaacagctgaaccgcatgcacagcaacccagtcgtgggccgctgggcttgggcctcgggccccctccgccacccgggatggcggccccgcacgaggcctccgccgccttggggaagacctcgcggaaatgccgcccccccccccgccaacgaaa

SEQ ID NO: 54575 - protein, 156 aa, Zea mays
  misc_feature: Ceres CLONE 1480370-F
  misc_feature (77)..(77): Xaa is any aa, unknown, or other
  misc_feature (78)..(78): Xaa is any aa, unknown, or other
  misc_feature (82)..(82): Xaa is any aa, unknown, or other
MATIATMALLKPAAKAAARSAPSTSSGSVSLRVRTGQAAKKAALSVSASSTLAGAFLAALASSPDAALADVAAAEPXXQQAXPAAARRGGARHRVGAVQHPAAGAKQLNRMHSNPVVGRWAWASGPLRHPGWRPRTRPPPPWGRPRGNAAPPPANE

SEQ ID NO: 54576 - DNA, 622 bp, Zea mays
  misc_feature: Ceres CLONE 1480378-F
  misc_feature: Encodes the peptide sequence at SEQ ID NO. 54577
  misc_feature (345)..(345): n is a, c, t, g, unknown, or other
gctctagtactagtggatcccccgggctgcaggaattcgtctcacccctagaaaaaatctgctctcatcccccgtcttcttcccaagctgccacgttgcctccctccctccgctccagcggcccatggcgttcgccctggcgggggccttcaagggcctctccctggtgcccgccaccacctcctccttcccgcgcggcgaccgcgcctcgctctccgtcggcggcgcagccggcgtgccggtgccggtgccggcgcggcggctcaccatccagatggcgcacaagaagggggccgggagcaccaagaaacgccgcgactccaagggacagcgcctcggggtcangatatacggcgaccagctcgccaagcccggggccatcatcatccgccagcgcgggcacagggtctatcctggaaataccgttggaatgggcaaggatcacacactctttttcttggatagatggactcctcaagtttgagaagtaatgggccggacaagaaaaaggttagttgttacccattatgagaaggagcctgaaaacccaaacgttttccgagcaagggaggagagagttcttccgcatggcggcgtgaacgaaaaaaaggcaagagccgag

SEQ ID NO: 54577 - protein, 119 aa, Zea mays
  misc_feature: Ceres CLONE 1480378-F
  misc_feature (52)..(120): Pfam Name: Ribosomal_L27 Pfam Description: Ribosomal L27 protein
  misc_feature (74)..(74): Xaa is any aa, unknown, or other
MAFALAGAFKGLSLVPATTSSFPRGDRASLSVGGAAGVPVPVPARRLTIQMAHKKGAGSTKKRRDSKGQRLGVXIYGDQLAKPGAIIIRQRGHRVYPGNTVGMGKDHTLFFLDRWTPQV

SEQ ID NO: 54578 - DNA, 637 bp, Zea mays
  misc_feature: Ceres CLONE 1480384-F
  misc_feature: Encodes the peptide sequence at SEQ ID NO. 54579
  misc_feature (452)..(452): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
aaagctggagctccccgcggtggcggccgctctagaactagtggatcccccgggctgcaggaattcgtctcacccctagaaaaaaattgttgacagtagcgtggacgcatcgtcatcaatcgagcagaggggagggagagagatgaaggagggcacggcgaactgcatcgacatcctcatcgccatcatcctcccgcctctcggcgtcttcctcaagttcggctgcaaggtcgagttctggctctgcctcctgctcaccttcctcgcctatctccccgggatcatctacgcgatctacgttatcaccaaggactagccagatagcgccgtaaaccgggacaaggtgagagagctagctgatcagccagcggaggtaatggagatgaacgtactgctgagatcactttaatttgccctgttgctcaatgtttctggatggagactggatctcnagctgtgatgttgctatatactaccgattgatcctgaaatttgtcgcttttcgttcgtgtctgcatagtatgtgatgcatagtctgtaaaatttgtctcagactcttgtgctatagtatgtgatgcatgcnnnnnnnnnnnnnnnnnnnnnnnnnnnnnnnnnnnnnnnnnnnnnnnnnnnnnna

SEQ ID NO: 54579 - protein, 57 aa, Zea mays; identical to SEQ ID NO: 52573
  misc_feature: Ceres CLONE 1480384-F
  misc_feature (6)..(56): Pfam Name: UPF0057 Pfam Description: Uncharacterized protein family UPF0057

SEQ ID NO: 54580 - DNA, 662 bp, Zea mays
  misc_feature: Ceres CLONE 1480385-F
  misc_feature: Encodes the peptide sequence at SEQ ID NO. 54581
  misc_feature (1)..(1): n is a, c, t, g, unknown, or other
natagctggagctccccgcggtggcggccgctctagaactagtggatcccccgggctgcaggaattcgtctcacccctagaaaaaacaccgagaatcacaatacgaaacgaattaatccccaatcaacacagcaagtcagcaacaagcaaagcagcgatccgagagatggacgcgaggatgttcgggctggagaaccccctggtggcggcgctgcatcacctgctggacgtgcccgatggcgacgccggagcgggcggcgacaaggcgggcggcggcgccacgcgcacctacgtccgcgacgcgcgcgccatggcggccaccccggccgacgtcaaggagctcgcgggagcgtacgcgttcgtggtggacatgccggggctgagcacgggcgacatcagggtgcaggtggaggacgagcgggttcttgtgatcagcggcgagcggcgccgggaggagcgcgaggacgccaagtacctgcgcatggagcggcggatgggcaagttcatgcgcaagttcgtgctgccggacaacgccgacgtggacaaggtcgccgccgtgtgcagggacggcgtgctcacggtgaccgtcgagaagctgcccccgccggagcccaagaagcccaagaccatcgagattaaggtcgcctgagtgtagaccgttg

SEQ ID NO: 54581 - protein, 160 aa, Zea mays
  misc_feature: Ceres CLONE 1480385-F
  misc_feature (55)..(158): Pfam Name: HSP20 Pfam Description: Hsp20/alpha crystallin family
MDARMFGLENPLVAALHHLLDVPDGDAGAGGDKAGGGATRTYVRDARAMAATPADVKELAGAYAFVVDMPGLSTGDIRVQVEDERVLVISGERRREEREDAKYLRMERRMGKFMRKFVLPDNADVDKVAAVCRDGVLTVTVEKLPPPEPKKPKTIEIKVA

SEQ ID NO: 54582 - DNA, 680 bp, Zea mays
  misc_feature: Ceres CLONE 1480388-F
  misc_feature: Translation starting site: 217
  misc_feature (107)..(107): n is a, c, t, g, unknown, or other
  misc_feature (111)..(111): n is a, c, t, g, unknown, or other
  misc_feature (322)..(322): n is a, c, t, g, unknown, or other
  misc_feature (378)..(378): n is a, c, t, g, unknown, or other
aaagctggagctccccgcggtggcggccgctctagaactagtggatcccccgggctgcaggaattcgtctcacccctagaaaaacttttttcggaggaggcggacangtangcagcagcaggaaccctagcaccgccgcatccgcagccatgggtatcgacctcgttgccggtgggaggaacaagaagaccaagcgcacagcgccgaagtccgacgatgttttatctcaagctcctttgtcagctctaccgtttcttggtcaggaggaccaagagcaactttcatgctgtcattctcaagaggctcttcatgagcaaaaccnatcgcccaccaatctccatgcgcccgctttgtcagttcatgggaggaaaggagaangacattgctggtgattggtgggcccgtcacagatgacaagaggatccaggaggtccagcaatgagggtactgccctgaggtccaccgagacggcaaggccaggattgtcaatgctgggggggaagtcctcacatttgacagctttgctctccgtggctccattgggcgagaccccatcccttctgaggggcccccaagatgccccgggaggggggaaaccacttcgggaaggtttcctgggagtcccccacaccccccccaacccttttgggccccccaaagggaaaggaatttccaaaagg

SEQ ID NO: 54583 - DNA, 676 bp, Zea mays
  misc_feature: Ceres CLONE 1480393-F
  misc_feature: Encodes the peptide sequence at SEQ ID NO. 54584
  misc_feature (162)..(162): n is a, c, t, g, unknown, or other
  misc_feature (163)..(163): n is a, c, t, g, unknown, or other
  misc_feature (201)..(201): n is a, c, t, g, unknown, or other
  misc_feature (294)..(294): n is a, c, t, g, unknown, or other
  misc_feature (478)..(478): n is a, c, t, g, unknown, or other
  misc_feature (485)..(485): n is a, c, t, g, unknown, or other
  misc_feature (593)..(593): n is a, c, t, g, unknown, or other
aagctggagctccccgcggtggcggccgctctagaactagtggatcccccgggctgcaggaattcgtctcacccctagaaaaagttgcagaagttgcctctccttttcgtcttgtttctcctccaccccggcgacgcgaatggagaaggggcagtggagaannaatcctccgccgccaccgctccacatggaggacttccnactggaggggaagaagcccgtcaagaacccctttgtgcccatcggcgcactggttactgctggagttctgactgctggtctgatcagtttccngatatgggaactctcagctggggtcagaaactgatgagggtacgtgtagttgctcaaggcgctacagtccctctgatgattggcagtgcttactactatggcgatcaaatcaagctgttcagaaagggtcgagccaatgatcttccatgaatatggctgtttttggggtatgggagaatgcccngtatacncataaatttcacctggactctgctgccccttttttacatcatttttggcctgaaccctggtaactaacaaaaatccctggttggtcccatccggcaggattaaaaatnaaatatttttgtttggtaattttgccaggattttgtgggttaataaattaggccatttccctccatttgttatttcctttgaa

SEQ ID NO: 54584 - protein, 62 aa, Zea mays
  misc_feature: Ceres CLONE 1480393-F
  misc_feature (8)..(8): Xaa is any aa, unknown, or other
  misc_feature (21)..(21): Xaa is any aa, unknown, or other
  misc_feature (52)..(52): Xaa is any aa, unknown, or other
MEKGQWRXNPPPPPLHMEDFXLEGKKPVKNPFVPIGALVTAGVLTAGLISFXIWELSAGVRN

SEQ ID NO: 54585 - DNA, 662 bp, Zea mays
  misc_feature: Ceres CLONE 1480401-F
  misc_feature: Encodes the peptide sequence at SEQ ID NO. 54586
aaagctggagctccccgcggtggcggccgctctagaactagtggatcccccgggctgcaggaattcgtctcacccctagaaaaaagtccatggcaggccagtcctcaagcctccacctcgacctacggcctgctgctgtctgttgggccgaacgggaggcacgaggcggagagcggagaggcgttccgttccatccaagctgatggcaacgagttctccagggcggcggcgcacgggcacctcctgcctaccagaaggcctccgcaccgagctcttctcatcgccaccatcaccagaaggcttccgcccctctctccagtgtctctttctctctccatcgcatggctctcgcgtgcgccactcacgcgcgccgcttcctcctcgctggcccggcgagatctttccacgcccagccctaccaggccaaggtcggcgtggtggagttcttgaacggcgtcgggaagggggtggaagcgcacgccgcgaagctggaggaggctgtgggcggcgacatgcagaggctcctcgaggcccgcacgctgcggctcaagaagcttggcatcccctgcaagcataggaagttgattttgagttttgctcacaagtaccgtcttggtctctggaagcctcaagcagaacccaggaaagttgaataaaattgg

SEQ ID NO: 54586 - protein, 104 aa, Zea mays
  misc_feature: Ceres CLONE 1480401-F
MALACATHARRFLLAGPARSFHAQPYQAKVGVVEFLNGVGKGVEAHAAKLEEAVGGDMQRLLEARTLRLKKLGIPCKHRKLILSFAHKYRLGLWKPQAEPRKVE

SEQ ID NO: 54587 - DNA, 676 bp, Zea mays
  misc_feature: Ceres CLONE 1480770
  misc_feature: Encodes the peptide sequence at SEQ ID NO. 54588
  misc_feature (622)..(622): n is a, c, t, g, unknown, or other
cgattgggtacgggccccccctcgagccactgcagtggtaaaggggagtacttcaattggcgttggccgaagaagaggagaagcgaagcaagcaggcttcgagaacaagggggagggggaggaccaagcgaaagggggaactagagcaagatgggcggcgaactgctgcttgcgctcctcctcgtctctgctgctgccgcccctcaggtacttggagttggcaatggagacaatcacatgagaatcatccaggaggacatcattgagacagtcaacaaccatcccagtgctgggtggacagcctcacgtaatccttacttttcaaactataccattgcgcaatttaagcacatacttggagtgaaaccagcaccacagaatgcactaagcaatgttcctgtcaaaacttattcaagatcactggaacttccaaaagagtttgacgctagatctgcatggtcccgttgcagcacaattgggaacatacttgatcaaggtcactgtggctcttgttgggcttttggtgctgtggagtgcctccaggaccgtttttgcattcacctcaacatgagcattttactttcagtcaatgacctactggcatgctgcggttttatgtgcngcgatgggtgtgatggaagctatcctatagaggcatggcgctactttgttcaaa

SEQ ID NO: 54588 - protein, 175 aa, Zea mays
  misc_feature: Ceres CLONE 1480770
  misc_feature (33)..(76): Pfam Name: Propeptide_C1 Pfam Description: Peptidase family C1 propeptide
  misc_feature: SWISSPROT Homolog: EC 3.4.22.1 Cathepsin B
  misc_feature (158)..(158): Xaa is any aa, unknown, or other
MGGELLLALLLVSAAAAPQVLGVGNGDNHMRIIQEDIIETVNNHPSAGWTASRNPYFSNYTIAQFKHILGVKPAPQNALSNVPVKTYSRSLELPKEFDARSAWSRCSTIGNILDQGHCGSCWAFGAVECLQDRFCIHLNMSILLSVNDLLACCGFMCXDGCDGSYPIEAWRYFVQ

SEQ ID NO: 54589 - DNA, 678 bp, Zea mays
  misc_feature: Ceres CLONE 1480772
  misc_feature: Encodes the peptide sequence at SEQ ID NO. 54590
  misc_feature (552)..(552): n is a, c, t, g, unknown, or other
  misc_feature (582)..(582): n is a, c, t, g, unknown, or other
  misc_feature (678)..(678): n is a, c, t, g, unknown, or other
cgattgggtaccgggccccccctcgagccactgcagtggtaaagggaaacggcaacgagcctgcagctccagctacccctaaaccccgtccaacgtccatggcaatccacctccgggcccacgtcttcgcggccaacccgctgcgtggcgtctctgccgccaccaccgccatgtccccctccgcggccgccgaggcactccgctacctcctcgaccccagctccgccgccgccgccgccaatcccagccagtacctctccaagatccttcctttccgccggggccgcccgctcgcgcgctccacggaccctcccgcggcgccggcctggcgcctcgcgtggctcccgccgtcccgcgtccccggggtggctccggacgccttcgtcttcctgggcgcgctcgtcgagggggacggcacggaggccgccgcgtactgggcggtcgacgtcagcgagggcgagggagccagggttggtgggccggcggacggggatgggccgtcggcgtttgtggacttgaggacgctcatggttgccacggactggagcgacnaggacgccatggcggagctcgccatcgcangacatgctcgagcactgctagaatggcacagcacggcaaaattttgtggagcctgtggagcaaaggctgtacctactgaagccgggaggcgtaagn

SEQ ID NO: 54590 - protein, 193 aa, Zea mays
  misc_feature: Ceres CLONE 1480772
  misc_feature (53)..(170): Pfam Name: NUDIX-like Pfam Description: NADH pyrophosphatase-like rudimentary NUDIX domain
  misc_feature (152)..(152): Xaa is any aa, unknown, or other
  misc_feature (162)..(162): Xaa is any aa, unknown, or other
MAIHLRAHVFAANPLRGVSAATTAMSPSAAAEALRYLLDPSSAAAAANPSQYLSKILPFRRGRPLARSTDPPAAPAWRLAWLPPSRVPGVAPDAFVFLGALVEGDGTEAAAYWAVDVSEGEGARVGGPADGDGPSAFVDLRTLMVATDWSDXDAMAELAIAXHARALLEWHSTAKFCGACGAKAVPTEAGRRK

SEQ ID NO: 54591 - DNA, 649 bp, Zea mays
  misc_feature: Ceres CLONE 1480776
  misc_feature: Translation starting site: 132
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
tcgagccctgcagtggtaaaggatagaccacacacacgctgacggacggaccactagcaaacagcagcgccccacgatcagcacccctgccgccggggcaaactgctgctgctgcagatccggtccgggggatggagagggacgccacagccttctgcccgccgccccagcccgccccggctccggcgtcacatgcggcggtgctgggcgccggtgtcgcggtcgcggtcgcgccggcggcaggtaacggccgcggcggcggcggcggagggaagcagtaccgcggcgtccggatgcgcaagtggggcaagtgggtggcggagtatccgcgagcccaacaaagcggtcgcggatctggctcgggtcctactccaccgctgaggccgctgagcgctcctacaacacggctgtctttcaggctgccgggccgccacgcgcggcttcaactttcccccaacattttttacgactcccagggggtggcgggcgaaaactgaaaacccctgaaggggtggcggcaaagaaggggtccttggtttaaagaagccccaacctttccttataaaagctggacaaaatgtcttgggcccatattcacaaaaaaggnnnccctgtgttttagaccagaaggtgacaaacccattatctc

SEQ ID NO: 54592 - DNA, 688 bp, Zea mays
  misc_feature: Ceres CLONE 1480778
  misc_feature: Encodes the peptide sequence at SEQ ID NO. 54593
cgattgggtccgggccccccctcgagccactgcagtggtaaagggcgttctcgtgccggggcctcttctgggtgctacggatcgtgtcggcggtggggctgagcagggagtgccggcacaagctggagcggctcatggggctcatgctggaccaggccacgctcgacgacctcctcgtctccggcgacgacggcggcggcgtgtacgacgtcaacctggtcatgaggctggtcagggtgttcgtggcctcccaagaggaggcagacgcgccgtcggagaggatgcggaaggtggggcgcctggtcaacaagtacctcggcgaaatctcgccggaccaggggctgaaggtgtccaagttcctcgccgtcgccgagagcctgccggactcggccagggactgctacgacggcgtgtaccgggcgctggacatctacctcgagtcgcacccagcactgtccctggaggagcgcacgacgctgtgccggtgcctcaactaccagaagctgacgctggaggcgtgcaaggacctggccaagaaccggcggatcccgccgggcgtggcggtgcaagcgctggcgtcccaccaatgcaagctccacatcagcgagccgggccccggcggggagcgccaccgcggcaccggggaaaggagcgcccggcccaacccgtccttcctgctccccagtcc

SEQ ID NO: 54593 - protein, 184 aa, Zea mays
  misc_feature: Ceres CLONE 1480778
  misc_feature (1)..(129): Pfam Name: NPH3 Pfam Description: NPH3 family
MGLMLDQATLDDLLVSGDDGGGVYDVNLVMRLVRVFVASQEEADAPSERMRKVGRLVNKYLGEISPDQGLKVSKFLAVAESLPDSARDCYDGVYRALDIYLESHPALSLEERTTLCRCLNYQKLTLEACKDLAKNRRIPPGVAVQALASHQCKLHISEPGPGGERHRGTGERSARPNPSFLLPS

SEQ ID NO: 54594 - DNA, 685 bp, Zea mays
  misc_feature: Ceres CLONE 1480784
  misc_feature: Encodes the peptide sequence at SEQ ID NO. 54595
  misc_feature (685)..(685): n is a, c, t, g, unknown, or other
tctattgggtaccgggccccccctcgagccactgcagtggtaaaggagttcaaggggacatccatcaccatgaccatgctgccgttcacatccacagcagcggcaacaagctagtagcagatgttttcttcttccacgacgtcctacgcccagggtccgtaatcacgccgatcatcccaccgaccatcaccctaccacctctgctgcctctccgcgaggccgacgcgctcccgttctccaccgggcgcttcgccgacatcctcgccatgttcgcgccgacgacatccgacgccatgggcgaagagatacggtcgacgctcgacacctgcgagaacacgcgcccgctccctggcgagaaggccgcctgcgccacctccctcgaggggggcgccaggatacccgccgtcctcctcgggacacccaacgtccgcgctttctccggcgacatgcccaccgatcctgccggcacgtcggcgaaccgggggcggtataacgtaacggccgtgcagaagctctccgagtcactgacggcggcggcgtgccatgacctgacgtacccctacgttgtgttctaatgccccacgaccaaccccagcggccaggtacctggagaaagctgggcccccccagaaggcgcgggacccccggaaatggaaggcccttgcccgtggggcccccctccacn

SEQ ID NO: 54595 - protein, 190 aa, Zea mays
  misc_feature: Ceres CLONE 1480784
  misc_feature (40)..(191): Pfam Name: BURP Pfam Description: BURP domain
YWVPGPPSSHCSGKGVQGDIHHHDHAAVHIHSSGNKLVADVFFFHDVLRPGSVITPIIPPTITLPPLLPLREADALPFSTGRFADILAMFAPTTSDAMGEEIRSTLDTCENTRPLPGEKAACATSLEGGARIPAVLLGTPNVRAFSGDMPTDPAGTSANRGRYNVTAVQKLSESLTAAACHDLTYPYVVF

SEQ ID NO: 54596 - DNA, 678 bp, Zea mays
  misc_feature: Ceres CLONE 1480788
  misc_feature: Encodes the peptide sequence at SEQ ID NO. 54597
cgattggggaccgggccccccctcgagccactgcattggtaaaggagaagcaagcaaccagcggagcggaggaggagagactgatccagacgcaaagggcatcgacagagaccgagcccaataataaatcttgctggatacatacaggaaacagcgcgagggaacgagaagttagtttccatggagaagaagcagaagaagcacgcacacgcgaggtcaaggagcttcaccggcggcgggctggcctccttcctcaggtccaccgtctcctccttctcctccgccttcccgcccagcggcaggaggtcctccttcaaccaccgcaacgccttctcgggccccatcgtcgtctccatcgtcccgccggaggctcgcggcggcggcggcaggaggaagcgcccggggtacgtgacgcccgagccgtcgtcgcccaaggtgtcctgcatcggccagatcaagcgcagcaactccaggcgccagaagaaggtcaacccgtcgtgcggcaagggcggcggcgcctgcccgctcccgccgaggccgccagcggagggcaataagattaagccctgcagcaggaccagcagcagcaggggctccctcgtgaagcggatgcccttctttcgccgcagcaggtcgcgtcctcgctcaagggcggcgtcgtccaaagatgccctcatc

SEQ ID NO: 54597 - protein, 166 aa, Zea mays
  misc_feature: Ceres CLONE 1480788
MEKKQKKHAHARSRSFTGGGLASFLRSTVSSFSSAFPPSGRRSSFNHRNAFSGPIVVSIVPPEARGGGGRRKRPGYVTPEPSSPKVSCIGQIKRSNSRRQKKVNPSCGKGGGACPLPPRPPAEGNKIKPCSRTSSSRGSLVKRMPFFRRSRSRPRSRAASSKDALI

SEQ ID NO: 54598 - DNA, 655 bp, Zea mays
  misc_feature: Ceres CLONE 1480792
  misc_feature: Encodes the peptide sequence at SEQ ID NO. 54599
tcgagccctgcagtggtaaaggggcggtgatgctcctctgcttgccttgccctggtgtggtggtgtctagtcaagtacgcttccgaattaaaagcgctctggcctgcaacctgctgtctgctccgtcctcccacggccggccgcctgcccgcgtcttcttcgccacccctcttctccggtcccgcacctgcatttcttgaccccttcctccaccgcagccaaacaatgtctcctgcgccgagttcgcatcactcgcagatcaattcgaggaaggagaagcggatgaggaaggtggacaccttcgcgccgcacaacgatggccaccaatggaggaagtacggcgagaaaaagatcaacaacaccaacttccccaggtattactacagatgcacgtacaaggacaacatgaactgcccggccacgaagcaggtgcagcagaaggaccacagcgacccgccattgtacgcggtcacgtactacaacgaccactcgtgcaacagcgcgttcctcccgctctccccctccgagttccagctgcagacctcgtccgggaaggccgtctccatctgcttcgactcctcgtccgggacggcggcggcggcggccgccaccaccaatgccagcggcggctcgccctcttccagcgcggcggcgg

SEQ ID NO: 54599 - protein, 143 aa, Zea mays
  misc_feature: Ceres CLONE 1480792
  misc_feature (29)..(92): Pfam Name: WRKY Pfam Description: WRKY DNA -binding domain
MSPAPSSHHSQINSRKEKRMRKVDTFAPHNDGHQWRKYGEKKINNTNFPRYYYRCTYKDNMNCPATKQVQQKDHSDPPLYAVTYYNDHSCNSAFLPLSPSEFQLQTSSGKAVSICFDSSSGTAAAAAATTNASGGSPSSSAAA

SEQ ID NO: 54600 - DNA, 685 bp, Zea mays
  misc_feature: Ceres CLONE 1480793
  misc_feature: Encodes the peptide sequence at SEQ ID NO. 54601
cgattgggtaccgggccccccctcgagccactgcagtggtaaagggtcgtacagccccgttcccatacaggacagtctgctgtctgccgcaagcctagcttcgtccaccactgaatcaagaaacaaaacaactatgcatggacgaccgcacctacaagggcggcatcaaggcgtactggaagcgccggagctactaccgcatggacggcgacgtcgcgcggcgccgccagccgctccccaccgtgaagctcggaagtgacgtcatccagatgcaggcccaggcccagccgccggcggcggatggctcgggccggcgccacaggagccgcgggtggcacgagatccgctaccagctgtggcggcagctgctccgcgcgctgtcccctcgccggtggatcatgcgggtccgcagaacctacatctcccaccatgctgaggttgagcgcctaccgcgtcgtcatggtacggtgaccagcgacagccatctgcgccacggtgaacccataacgagagcatcggcgaggggactgcactcggccggagcagctcagagagtacgacgacaacgtgctggtgcagatctacgggttcatactcgcgcgcgaggatcatctacacgacgagcctgacgcctacaagcagggctaccgacggctgtatgcacttgaaaggcaccacaaaacgg

SEQ ID NO: 54601 - protein, 163 aa, Zea mays
  misc_feature: Ceres CLONE 1480793
MDDRTYKGGIKAYWKRRSYYRMDGDVARRRQPLPTVKLGSDVIQMQAQAQPPAADGSGRRHRSRGWHEIRYQLWRQLLRALSPRRWIMRVRRTYISHHAEVERLPRRHGTVTSDSHLRHGEPITRASARGLHSAGAAQRVRRQRAGADLRVHTRARGSSTRRA

SEQ ID NO: 54602 - DNA, 826 bp, Zea mays
  misc_feature: Ceres CLONE 1480796-R
tggcggccgctctagaactagtggatcccccgggctgcaggaattcccagagctctggttttttttttttttttttaaaaaaaatgcagcagcatcaatacatcaatatcgaccatagcaacacagcaaacaggggggtagcacctcttattctacttatcgcacacgggcagctcatttttctgggacacacaaggcaattacatggcactataaaaaaaactggttcaggggtgtgcgtgaatcacatgcttaacacaatcaaaaccacacccttggggttggtgcaggaaaacccctagcagttgagcctgttatcttcgtcgcaaaagggccccatgccttgccttcagtgtcgctgcaatgcccattcttgtttggatacatagcagtgtgcgttgaaaaaacaccagtaccatttgccgcctgattccttaaacggatgccctcagcccttgacccaattgtctggccaacaatggaggctgctatggggaatgccatcgcagtcctgggcatcacaacaaacttcctcagcattgcaatgaacggaacagcggcatggacagctgcaaaccactgaggagagaacttcttggtgtgctcccgcccaccccaagagggatgtttgctgccatccccagtagtgcaatggctaccatctttaagggcaggggttgtggtccggaaggatttcacaaggcccagttcgcgcaagggcagctcggaagaaaccacagcaggggggcacttcagcttcataccagctggggggcttaaaggccttggcgacaagggcaaaacaccattcattggccggaaaaaa

SEQ ID NO: 54603 - DNA, 670 bp, Zea mays
  misc_feature: Ceres CLONE 1480796
  misc_feature: Encodes the peptide sequence at SEQ ID NO. 54604
  misc_feature (525)..(525): n is a, c, t, g, unknown, or other
cgggccccccctcgagcactgcagtggtaaaggcttttagaccatgttgcggctttttcatggtgcacatggtttacttcccctttcaaaaaaatctatgtatctgatgatgaccacactgccacgattgtatgtcacgactgactctgctctgccgtcttctccaatggctgctagaacaccttcgatacgtctatctgcacttggaccatttggatgtgccttcttcacagggccgggcgaacggcataacaggaaacccaactttctacataactcccgccagaagaccacgacaccaaatctgtcttccatgacacccacaggagtctacccaccatctcatgagtcattcaccgatcagtggatggaaaatggccagtgcccacttgcgcggacttacccccccatcagcggtgttttgccgctagtcgcctgcttcttacacccaaacactgctatgacgttgacgtgccccactgttgtggctgctgtcagatctgcccttcggatgactgcccttgntgaatccctccgaccacaatccctgcccttcaagatgggagccattgcactactgggccatggcagccaacatccctcattgggtcgtgcccgcgagcacacccagaaattgcactcatctgtgggtttggagctgtcacatgcc

SEQ ID NO: 54604 - protein, 209 aa, Zea mays
  misc_feature: Ceres CLONE 1480796
  misc_feature (161)..(161): Xaa is any aa, unknown, or other
MLRLFHGAHGLLPLSKKSMYLMMTTLPRLYVTTDSALPSSPMAARTPSIRLSALGPFGCAFFTGPGERHNRKPNFLHNSRQKTTTPNLSSMTPTGVYPPSHESFTDQWMENGQCPLARTYPPISGVLPLVACFLHPNTAMTLTCPTVVAAVRSALRMTALXESLRPQSLPFKMGAIALLGHGSQHPSLGRAREHTQKLHSSVGLELSHA

SEQ ID NO: 54605 - DNA, 764 bp, Zea mays
  misc_feature: Ceres CLONE 1480804
  misc_feature: Encodes the peptide sequence at SEQ ID NO. 54606
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
ctctgtctctgaagttttccaccaatatataannnnaccannnnnnnccgattgggtacgggccccccctcgagccctgctgtggtaaaggatgcggctgtggccatggacttcgtgctccaggtcctgctgccagtggtgatgaaaagaaacatccgcctgctgcaagaggtcgttgacatcgacgtggacatcggcacggatgtcttgcaggccgtgcgcgactccggtatcttctgccgccgcttgctgaccacgccgacaacatacatcgtcgtcgtcgacgacgtattactactcaccggggacgtcctcctcgatgggcatgaacgtgcaatacgattaattattggaaagcactaaacgagctagctagctagctaggggcagaacatgtatacttctcgcggcggggcatgtacgaaccaaggccgtatatctgtgcgttcttttttgaggaacaaccccgagcctctagataccctacatatatgggttgtgcttttgctctaactatatccctccatgtgtaattttgcggataaagtgcactataaccagagcttctgggaattcctgcagcccgggggaatccactatgttctacaggagggcagctacctgtagcgcaagaccactatctctttgtttcccttttgagtgaagaattaaattatctgaaccattgccagagagtcccgtggaccgttaccacggtttttaccttgcgcataaacaattggcctatccccccccttccccca

SEQ ID NO: 54606 - protein, 85 aa, Zea mays
  misc_feature: Ceres CLONE 1480804
MDFVLQVLLPVVMKRNIRLLQEVVDIDVDIGTDVLQAVRDSGIFCRRLLTTPTTYIVVVDDVLLLTGDVLLDGHERAIRLIIGKH

SEQ ID NO: 54607 - DNA, 662 bp, Zea mays
  misc_feature: Ceres CLONE 1480811
  misc_feature: Encodes the peptide sequence at SEQ ID NO. 54608
cgattgggtccgggccccccctcgagccactgcagtggtaaagggcagagcaaagcatagtcacctgcctatctatctagcgagagagagagaggaaagctagctagctagcatggagtgcggcagcaagaaggcagcaggcggtgtgttggcgctgctgcttctccagctggtgttagctccgacgacggcgacggcccgcctcctgcaggcggatacctccaccgtggttggcctggacatcatcgcgagggagtttggccatccagtgagaggcatcctctgtggtgaaacctgtgtcttcctaccatgctatacggcagccatgggttgccaatgcattggccaaatctgcatgatgtgatatctggactagcgctatttgtaatttgtgttgggagaaacacaaggacggtacggtggtgttcaacttattgcatgtgtatggtgatctaataagtaaagtataataaaaagggatatgttggatgtgtacccaaaagaagcacacactatccgattccctgaccccgctatcaaagaacccgacaaaaaaaaaaaaacccggagctctgggaattcctgcagcccgggggatccactatttctagagcggccgccaccgcggtggagctccagcttttgttccctttagggagggt

SEQ ID NO: 54608 - protein, 83 aa, Zea mays
  misc_feature: Ceres CLONE 1480811
  misc_feature (55)..(84): Pfam Name: Cyclotide Pfam Description: Cyclotide family
MECGSKKAAGGVLALLLLQLVLAPTTATARLLQADTSTVVGLDIIAREFGHPVRGILCGETCVFLPCYTAAMGCQCIGQICMM

SEQ ID NO: 54609 - DNA, 672 bp, Zea mays
  misc_feature: Ceres CLONE 1480816
  misc_feature: Encodes the peptide sequence at SEQ ID NO. 54610
  misc_feature (528)..(528): n is a, c, t, g, unknown, or other
  misc_feature (547)..(547): n is a, c, t, g, unknown, or other
  misc_feature (597)..(597): n is a, c, t, g, unknown, or other
  misc_feature (613)..(613): n is a, c, t, g, unknown, or other
  misc_feature (659)..(659): n is a, c, t, g, unknown, or other
  misc_feature (672)..(672): n is a, c, t, g, unknown, or other
tgggaccgggccccccctcgagccactgcagtggtaaaggagtaattagtttgtgcccgtgtccgtgtttggttgaataataaattgacgaaagagggccaagtatagcttagagagagaagctagctagctgaaatggaggctagcagccgccgccgcgtctctcttgtgccactgctggtggtgatcatcgggtgctgtgcctgccgcgcccagatcccgatcccggcgaggacggacgggttcgtgtacggcgggaagccgccggcgtggggcgagacggtggtggtagaggcgttcttggacccagtgtgccccgacagccgcgacgcgtggccggcgctcaagatggtcgtcgagcactatagctcacgcgtgtccgtcgtcgttcacctcttcccgctgccttaccacagctatgccttcattgcgtgccggtcaattcatgcggtgaacaaactaaatccgtcgttcgtgtaccctctgctggagaagttcttcagataccagaaacgttactataatcangccacatacgaaaaatcangagctacagtggttgatgaaataaccagaaaccttgttgtgcccatcatncgtgaaactaattttngcgcattcagagcaggtttcacgattcacattctgatcaggctacnaggatatctttcn

SEQ ID NO: 54610 - protein, 179 aa, Zea mays
  misc_feature: Ceres CLONE 1480816
  misc_feature (131)..(131): Xaa is any aa, unknown, or other
  misc_feature (138)..(138): Xaa is any aa, unknown, or other
  misc_feature (154)..(154): Xaa is any aa, unknown, or other
  misc_feature (160)..(160): Xaa is any aa, unknown, or other
  misc_feature (175)..(175): Xaa is any aa, unknown, or other
MEASSRRRVSLVPLLVVIIGCCACRAQIPIPARTDGFVYGGKPPAWGETVVVEAFLDPVCPDSRDAWPALKMVVEHYSSRVSVVVHLFPLPYHSYAFIACRSIHAVNKLNPSFVYPLLEKFFRYQKRYYNXATYEKSXATVVDEITRNLVVPIXRETNFXAFRAGFTIHILIRLXGYLS

SEQ ID NO: 54611 - DNA, 671 bp, Zea mays
  misc_feature: Ceres CLONE 1480819
  misc_feature: Encodes the peptide sequence at SEQ ID NO. 54612
  misc_feature (339)..(339): n is a, c, t, g, unknown, or other
  misc_feature (359)..(359): n is a, c, t, g, unknown, or other
  misc_feature (360)..(360): n is a, c, t, g, unknown, or other
  misc_feature (379)..(379): n is a, c, t, g, unknown, or other
tcgagccctgcagtggtaaaggaacgaagccacaagcagcgccgcgagccacagctagcaccaccaccttgcaccgcacccgcaccgagacgaacagatctatcgatcgatagctagatccatggctgccggcggcgacgacaccaccatcgcgcaggtccacagcggcatcgacagcagcaacaagacgctgctcaagagcgaggccctctacaagtacgtgctggacacgtcggtgctgccgcacgagccggagagcatgcgtgagctgcggctggtgaccgacaagcacgagtgggggttcatgcagtcgtccccggacgaagcgtcgctgctgcngatgctgatcaagctgagcnngcgcgcggcgacgctggangtgggcgtgttcacgggctactcgctgctggcgacggcgctggcgctgcccgccgaacgcaaggtcatcgcattcgacgtgagccgcgagtactacgacatcggccgccccttcatcgagcgcgccgggttgccggccaaggtggactttccgggagggcccggccccggaaccacctgaaaaactctcttcccaaacccggcaaaacagggggcctttgaattttcgggttgggcgaaccccaaaaaaccttattacgtcccggaaccccaaaaaaatggctccgccctgg

SEQ ID NO: 54612 - protein, 145 aa, Zea mays
  misc_feature: Ceres CLONE 1480819
  misc_feature (35)..(146): Pfam Name: Methyltransf_3 Pfam Description: O-methyltransferase
  misc_feature: SWISSPROT Homolog: EC 2.1.1.104 Caffeoyl-CoA O-methyltransferase
  misc_feature (73)..(73): Xaa is any aa, unknown, or other
  misc_feature (80)..(80): Xaa is any aa, unknown, or other
  misc_feature (86)..(86): Xaa is any aa, unknown, or other
MAAGGDDTTIAQVHSGIDSSNKTLLKSEALYKYVLDTSVLPHEPESMRELRLVTDKHEWGFMQSSPDEASLLXMLIKLSXRAATLXVGVFTGYSLLATALALPAERKVIAFDVSREYYDIGRPFIERAGLPAKVDFPGGPGPGTT

SEQ ID NO: 54613 - DNA, 692 bp, Zea mays
  misc_feature: Ceres CLONE 1480830
  misc_feature: Encodes the peptide sequence at SEQ ID NO. 54614
  misc_feature (274)..(274): n is a, c, t, g, unknown, or other
  misc_feature (342)..(342): n is a, c, t, g, unknown, or other
  misc_feature (351)..(351): n is a, c, t, g, unknown, or other
  misc_feature (366)..(366): n is a, c, t, g, unknown, or other
  misc_feature (466)..(466): n is a, c, t, g, unknown, or other
cgattgggtccgggccccccctcgagccactgcagtggtaaaggggtccgtttcactcgctgttccccacgcgctcgcccctgatccaccaccgcggccgcgatgagcaccgcctctggcgacggcgcggacgcaggcggcgacggggccgccgcatcggcgcccgccgggaggcggatcccgcccgcctcgtccatgccgtgggtccgcaatctccgccgcttcgtcggcacgggcgccggcctcggatcggaggccctcatggaactggagnactaaaggatattgcttgagatttttcagggagcgcagcgaaagagtgccgaggctggttccatcccnagtttttancagaagaaacctgangaacgatccattagctctagagttcaaaggttggcaagtaccggtttcctaagaaaacatcaaagcttctgctgaatgctgatgatcttgatgccatgtnggtttgtccccaaagaaatggggttttggggaggcacctggggcgaaaaaagaattatgaaaatttttggcctttccccccctttcggcggggaaaaattgggcaaaaaatgcaaaaaattttcccccccttccatttttcaaaattttgaaaagggagttctgggggagttgccttccccccttttttttttttggggggggaaagtttttcttttccgagagag

SEQ ID NO: 54614 - protein, 57 aa, Zea mays
  misc_feature: Ceres CLONE 1480830
MSTASGDGADAGGDGAAASAPAGRRIPPASSMPWVRNLRRFVGTGAGLGSEALMELE

SEQ ID NO: 54615 - DNA, 753 bp, Zea mays
  misc_feature: Ceres CLONE 1480833
  misc_feature: Encodes the peptide sequence at SEQ ID NO. 54616
  misc_feature (271)..(271): n is a, c, t, g, unknown, or other
  misc_feature (358)..(358): n is a, c, t, g, unknown, or other
cgattgggtccgggccccccctcgagccctgcagtggtaaagggctgtgtactcgcgctccagctcaccatttctcctctcccttcccttccctaagcatctcagcgaatccaatcgatccgaaggcgatggaccagcagggtgcgggcggggacgtggaggtgccggcggggctggggctgacggcggcggaatacaagcagctgcgtccgacggtggacgcgcaccaccgctacgccgtgggggagggccaatgctcctcgctgctggngcaacgcatccacactccgccggccgccgtctgggccatcgtcccgcgcttcgactgcccgcaggtgtacaagcacttcatccccanttgtcccgtccccccccgcacccggggggcggggaaagcccctcggcccccgggcgccctccggggagggggggtggtggttctcgggggctcccccgggccaggggcgggggggggaggggggcgtggggccaggcttttaggaaaaacgcgaggggggggggggtgcgggggtttccgccagccgggggggggggggggaagccccgtgctgcccggagaggaccgcggtgcgttcccgccgccctgtttttccagaggaggcggggggggccgcgggggaatgtgggggctcgtgcagggtgtggagtaggtcgcaacctgcgcgtctaacatgttcccgcccaccgggctgaaccgcgtagcaggcctaagaacccccgcccttttttccc

SEQ ID NO: 54616 - protein, 180 aa, Zea mays
  misc_feature: Ceres CLONE 1480833
  misc_feature (48)..(48): Xaa is any aa, unknown, or other
  misc_feature (77)..(77): Xaa is any aa, unknown, or other
MDQQGAGGDVEVPAGLGLTAAEYKQLRPTVDAHHRYAVGEGQCSSLLXQRIHTPPAAVWAIVPRFDCPQVYKHFIPXCPVPPRTRGAGKAPRPPGALRGGGVVVLGGSPGPGAGGGGGRGARLLGKTRGGGGCGGFRQPGGGGGSPVLPGEDRGAFPPPCFSRGGGGGRGGMWGLVQGVE

SEQ ID NO: 54617 - DNA, 676 bp, Zea mays
  misc_feature: Ceres CLONE 1480836
  misc_feature: Encodes the peptide sequence at SEQ ID NO. 54618
cgattgggtaccgggccccccctcgagccctgcagtggtaaaggagcgaagccgaagcagcagccaattcgctcgagttcagatcgagcgcgcgccaagcaagtcttccggccggccgcgaagagcgcaatcaagcaagacaagatggtgaagctcgccttcggaagcgtcggcgactccttcagcgccacctccatcaaggcctacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttctactgggtggcccagctgctgggcgccaccgtggcgtgcctgctcctcgggttcgtcacccacggcaaggtcatccccacgcacgccgtcgccgcgggcatcagcgagctgcagggcgtcgtgttcgaagtcgtcatcaccttcgcgctcgtctacaccgtgtacgccaacgccgccaaccccaagagggctcgctcggaacctcgcgcccatcgcatgggtt

SEQ ID NO: 54618 - protein, 177 aa, Zea mays
  misc_feature: Ceres CLONE 1480836
  misc_feature (11)..(177): Pfam Name: MIP Pfam Description: Major intrinsic protein
MVKLAFGSVGDSFSATSIKAYVAEFIATLLFVFAGVGSAIAYGQLTNGGALDPAGLVAIAIAHALALFVGVSVAANISGGHLNPAVTFGLAVGGHITILTGVFYWVAQLLGATVACLLLGFVTHGKVIPTHAVAAGISELQGVVFEVVITFALVYTVYANAANPKRARSEPRAHRMG

SEQ ID NO: 54619 - DNA, 670 bp, Zea mays
  misc_feature: Ceres CLONE 1480839
  misc_feature: Encodes the peptide sequence at SEQ ID NO. 54620
  misc_feature (670)..(670): n is a, c, t, g, unknown, or other
cgattgggtaccgggccccccctcgagccctgcagtggtaaaggggaatttgagtctatatatggttcataatgttttagttcccttgcgacaaaagttttagttccacagacaaaactgaagaaagaactgggagagctagcatggcaagttcgcgctgctttgagaacccgccggtgctggagccggccagcggaggaggcgaggtcgttgacgacttcggcgggcagaaggcctacgtcagcggctccgctgggtccaaggccgccgtcgtcctcatctccgacgccttcgggttcgaagcgccaaacctgaggaagatagccgacaaagttgcttcgctcggttacttcgttgtgttgcccccccttcctgcgtgggggggggggatgaccccagcaataatgcccatagcaatcctggaacgtggatacagtcgcacaaatccgcaaacggcattcgaagaggcaaaaccggtatttgcggctataaaggaaaatggtgtgtcaaagcctcgaactgccgggttacggttggggtcccaaaggtggttgggggaacttggcaaaagttcctcgagatccaaggcctgccggggttggccccccccttttttttaccccaccggcccgccggatattaaatagatggtctacggggctcccttttn

SEQ ID NO: 54620 - protein, 167 aa, Zea mays
  misc_feature: Ceres CLONE 1480839
  misc_feature: SWISSPROT Homolog: EC 1.2.1.38 N-acetyl-gamma-glutamyl-phosphate reductase
MASSRCFENPPVLEPASGGGEVVDDFGGQKAYVSGSAGSKAAVVLISDAFGFEAPNLRKIADKVASLGYFVVLPPLPAWGGGMTPAIMPIAILERGYSRTNPQTAFEEAKPVFAAIKENGVSKPRTAGLRLGSQRWLGELGKSSSRSKACRGWPPPFFYPTGPPDIK

SEQ ID NO: 54621 - DNA, 666 bp, Zea mays
  misc_feature: Ceres CLONE 1480842
  misc_feature: Encodes the peptide sequence at SEQ ID NO. 54622
cgattgggtaccgggcccccccctcgagccactgcagtggtaaaggaagcgaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacgcctgcggctgcggtagcagctgcaagtgcgacccctgcaactgctgatcacatcgatcgacgaccatggatatgattattatctatctagcttgtggtggtggttgaacaataataagcgaggccgagctggctgccatacataggtattgtgtggtgtgtgagagagagagagaaacagagttcttcagtttgctatctctctctctgcatgtttggcgtcagtctttgtgctcatgtacgtgtgtctacatgcatgttggttgatccgattgcgtctgctgtaacatatattaattggtccacgatgatatgatttgatactatatatatatatatatactaaaaccggacttcttattataaa

SEQ ID NO: 54622 - protein, 76 aa, Zea mays; identical to SEQ ID NO: 42649
  misc_feature: Ceres CLONE 1480842
  misc_feature (1)..(76): Pfam Name: Metallothio_2 Pfam Description: Metallothionein

SEQ ID NO: 54623 - DNA, 682 bp, Zea mays
  misc_feature: Ceres CLONE 1480843
  misc_feature (180)..(180): n is a, c, t, g, unknown, or other
  misc_feature (392)..(392): n is a, c, t, g, unknown, or other
  misc_feature (394)..(394): n is a, c, t, g, unknown, or other
  misc_feature (395)..(395): n is a, c, t, g, unknown, or other
  misc_feature (400)..(400): n is a, c, t, g, unknown, or other
  misc_feature (403)..(403): n is a, c, t, g, unknown, or other
ctattgggtacgggcccccctcgagccctgcagtggtaaagggaggactacttcccgaagctggcggacgtggacctgttcctccggatcatctgcgccaaggccaagggcgtcagcaagcggtgggacagcctcttcaacgagctgctgtcctagtacgcgctctccggcggcaagcanggcgaccacaactctgaagacttcgtgcacctcttgctgtcgctgcaaaaagactacggtctcaccacggataacatcaagggcatacttgtgaacatgttctaccccagcctccgagacatcttttcctggtgttggaatacccccctgagcgaactgatgaataaaccgccatttttttccctacctccccaaggaaaaagaaagggggnanntcccnacncccccttccccacctaataaaaacctaaacctccaatcctttacctggggcgcgggccgcaaaccccccccccctatttttaccttccgccccctattcccccccttcccccccttttcccccccccccttcctatccccgccccctctcccccctcccatatcttccccccccccccccttccatatccctcatatctcactactccgcgcccccggatccgggatctaaaaagcccccaaaaaccctacctctctataacccccccccttcccacac

SEQ ID NO: 54624 - DNA, 675 bp, Zea mays
  misc_feature: Ceres CLONE 1480844
  misc_feature: Encodes the peptide sequence at SEQ ID NO. 54625
  misc_feature (424)..(424): n is a, c, t, g, unknown, or other
  misc_feature (425)..(425): n is a, c, t, g, unknown, or other
  misc_feature (509)..(509): n is a, c, t, g, unknown, or other
  misc_feature (635)..(635): n is a, c, t, g, unknown, or other
acgattgggtaccgggccccccctcgagccactgcagtggtaaagggttgtaagactagcttatctgtattactgcacttgctctccggctccgggcagccacgagtatcagccccggcgagcggcggcgatgcagaacctgctgtccggcgcgtcccacgagacgctcccggacagcttcatcttcccggccgagcagcgcccgccggcgtcggcagccgccgtcgcgctccccgtcatcgacctgtccgggccccgcgacgaggtccggcgagccgttcttgaagctggcaaggagctaggcttcttccaggtggtgaaccacggcgtgccggagcaggtggtgcgggacatggaggcgtgctgcgaggagttcttccgcctccccgcggaggacaaggcggccttctactcggaggacacnnagcagcccaaccgcctcttcaccagcaccacctacggcaccggcggcgagcgctactggcgggactgcctccgcctggcctgcngcttccccgtcggcgccgacgccagggacgcctggcccgaccagccccacggcctcagggaggcggcggaaagggtcttcgcgtcaacaaggcgcctgaacctggacctgctgcggctgctgtgcnaaggcgtgggccctcccccggactacttcgagggggactt

SEQ ID NO: 54625 - protein, 181 aa, Zea mays
  misc_feature: Ceres CLONE 1480844
  misc_feature: SWISSPROT Homolog: EC 1.14.11.11 Hyoscyamine (6S)-dioxygenase
  misc_feature (99)..(99): Xaa is any aa, unknown, or other
  misc_feature (127)..(127): Xaa is any aa, unknown, or other
  misc_feature (169)..(169): Xaa is any aa, unknown, or other
MQNLLSGASHETLPDSFIFPAEQRPPASAAAVALPVIDLSGPRDEVRRAVLEAGKELGFFQVVNHGVPEQVVRDMEACCEEFFRLPAEDKAAFYSEDTXQPNRLFTSTTYGTGGERYWRDCLRLACXFPVGADARDAWPDQPHGLREAAERVFASTRRLNLDLLRLLCXGVGPPPDYFEGD

SEQ ID NO: 54626 - DNA, 670 bp, Zea mays
  misc_feature: Ceres CLONE 1480849
  misc_feature: Encodes the peptide sequence at SEQ ID NO. 54627
  misc_feature (387)..(387): n is a, c, t, g, unknown, or other
  misc_feature (500)..(500): n is a, c, t, g, unknown, or other
  misc_feature (507)..(507): n is a, c, t, g, unknown, or other
  misc_feature (670)..(670): n is a, c, t, g, unknown, or other
caattgggtacgggccccccctcgagccctgcagtggtaaagggagcacctgcagcgccgccagacactccgtagtctgtaccccaagcaccggcgcggcggcggcggctaccatggcagtcgggaagaacaagaggatctccaagggaaagaagggtggtaagaaaaagaccgtcgatcccttctctaagaaggactggtatgacatcaaggccccatcggtcttcagtgtgcgcaacattgggaagactctcgtgtccaggacacagggtaccaggattgcctctgatggtctgaagcacagagtctttgaggtttgtctagctgatcttcagggtgacgaggatcaggcttacaggaaaatcaggctccgtgctgaagatgtgncaggcaggaatgtgctcacaaacttctggggcatgaattttaccacccgatagctcagatctctagtaaagaagtggcagacattgattgaagccccatgtgatgtcaagacnaccgacnactacatgctgcgtttgttctgcattggttttaccaagaggcgccaaaccaggtcaagagaacctgctatgctcaggcatcccagattcggcagattcgccgcaagatgggttgaaattatgaatcaaccacccccccccatgggaaccttaaagaacttggn

SEQ ID NO: 54627 - protein, 108 aa, Zea mays
  misc_feature: Ceres CLONE 1480849
  misc_feature (11)..(109): Pfam Name: Ribosomal_S3Ae Pfam Description: Ribosomal S3Ae family
  misc_feature (92)..(92): Xaa is any aa, unknown, or other
MAVGKNKRISKGKKGGKKKTVDPFSKKDWYDIKAPSVFSVRNIGKTLVSRTQGTRIASDGLKHRVFEVCLADLQGDEDQAYRKIRLRAEDVXGRNVLTNFWGMNFTTR

SEQ ID NO: 54628 - DNA, 655 bp, Zea mays
  misc_feature: Ceres CLONE 1480854
  misc_feature: Encodes the peptide sequence at SEQ ID NO. 54629
cgattgggtaccgggccccccctcgagccctgcagtggtaaaggaagcattccattccatccagtaccttccttgtcaccttgaccttccccctcccttcctagtcccctactcgccagtccacaggacctcgaccccgctaagcaagctccaagagcgatcgccgcagaagatcccgcgatgcaggccccgccggcgccctcctccgtcgacctgccgctggcggtggcgccgccgccggtgaaggcgccgaccccgcggcccccgccgccggcctcgctgcagcccgagtccccgggggtcttcttctccgccgccgccgccgccgcgcccctgggcaccgcccaccgccgcatcggcatcgccggcgacctctccgacgagtccgcctacgccgtgcgctgggccatcgcaaactacctccgccccggggacgccgtcatcctgctccacgtgcgccccacctccgtgctctacggcaccaactggagcgccgtcgacgtctccctccccaaccctagcgccacagccgcctccgaggacggcgacggcgactgctacaccgccgctgccgcgcgcaggatgtaggacgactactacgccttcacggtcaccaaagcctgaggacttcgccagcccgctcaaggacgccggt

SEQ ID NO: 54629 - protein, 135 aa, Zea mays
  misc_feature: Ceres CLONE 1480854
MQAPPAPSSVDLPLAVAPPPVKAPTPRPPPPASLQPESPGVFFSAAAAAAPLGTAHRRIGIAGDLSDESAYAVRWAIANYLRPGDAVILLHVRPTSVLYGTNWSAVDVSLPNPSATAASEDGDGDCYTAAAARRM

SEQ ID NO: 54630 - DNA, 673 bp, Zea mays
  misc_feature: Ceres CLONE 1480857
  misc_feature: Encodes the peptide sequence at SEQ ID NO. 54631
cgattgggtaccgggccccccctcgagccctgcagtgctaaaggccatctggggagacatcgctgtctacagaaatccgtctaagtttagcttaatctgaacaggcatttttgctatactgtaccggttgaccagtgaatgaatgatgttctagacattaactttggttccaagctttctgtcgtgtccatggataactatccgtccgaatcctagaaacgtggtccgtgcttgtaacctgtttgttctggtgcttccatacgccggagcagattttgaagagaaatgaaacaaatcgttaattcgtctaccttctgttaaaacaaaagtgacaattttacaagaaaacaaaaaaaaagaagatatgacaacttaaaaaaaaaaacagaagaacaaaaggaaaaaaaaaaaaaaaggcccaaacctctggaaatccctgcaccccggggaatcccctatttttaaagcgcccccccccgcgggggacccccagtttttgtccccttaaggaagggtaaatttcaacttgggcgaaatcagggccatagctgtttccggggggaaattgttatccgctcacaattccacaaaaaatccaagccggaagcataaagggtaaaccctggggcgcccaaaggagggaccaaactccccttattggcgtggcgctccc

SEQ ID NO: 54631 - protein, 32 aa, Zea mays
  misc_feature: Ceres CLONE 1480857
DWVPGPPSSPAVLKAIWGDIAVYRNPSKFSLI

SEQ ID NO: 54632 - DNA, 847 bp, Zea mays
  misc_feature: Ceres CLONE 1480866
  misc_feature: Translation starting site: 277
  misc_feature (35)..(35): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (41)..(41): n is a, c, t, g, unknown, or other
  misc_feature (42)..(42): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
ttttgtatgttcacccccaaacccaactcccctcncnnncnncccccnnnnnnnnccgcattgggtaccgggccccccctcgaggtcgagggtagcgataagacggctcattcaccaaccctctcatcactcctcactcactcactcaaaacgaaagccagctcagctcagctctgctcagctcatctgctcacacctcacacccacaggccggccgccacagcaccgcggatagcagagcggcagctaggtcggtcgtcgtcgtcgtcgtcagccatgagcaaggacaagcaccacaagcacgagcaccacctgcggcgttgctgcgggtgcatggcgtcgtgcctcctggcgctggtcctcatcgtggccttcgtctcgctggtggtgtacctggcgctgcacccctcgaagccgtcctttctacctgcaaggacctgcaagttgcgaaagacccattctcgttgggcggacccgtttgcttgacggcgcccggccccaagtggaaattgggccttccccgcaacccccaaaagacccagcgcgggcccatctttccaaaaaagccctccttggcccgcgtgattcttttacaccttaaccgccccaacaaaagaccccgtgaacccgccgcccccgttggccctccggccccgccgccaaattacccaaggggcccaccccggccgaactttcaaccaacccggaggcccccccacccgcctttaccggtattaacatcccattgtccccgtgcgcccccccccaagccttcccccaaaacccatataaaaccacgggaatttccccacccacggagtctttcccttccccccttgcaccggtt

SEQ ID NO: 54633 - DNA, 691 bp, Zea mays
  misc_feature: Ceres CLONE 1480876
  misc_feature: SWISSPROT Homolog: EC 4.4.1.5 Lactoylglutathione lyase
  misc_feature (691)..(691): n is a, c, t, g, unknown, or other
cgattgggtaccgggccccccctcgagccactgcagtggtaaaggaaccaacatagtccgaggcccccgtgcctgtgatcggcctatggccgaccccgttcgtgatccccctccgtgatcgccctgatggtgagcgcgtccacttccagttcgtggatgatgtggtgggcaggaacacccacctgctgctgacgtcaaacccggtgcacacgaggatccgcgtcctgctccaccacggcaagcccatctccgagtctctgatcgacgtccgctacctccaccaggtctggcactccggcgcgccggctttcctccccgtcgacgctcacgcccgcgccgtccagcggctctggcggcagtgcgtcgaccacaacctgccttgggcgatccgcatactgaaggccaccacgaccggggcatggagtaagcctcggggcacctgtccccgggccctggcctccctgaggaggctttagcgccccttcgccaggggaaccgcttacttccgcggggacagcctcggggtaccttggacaccgatttggtgctcgcccgtccccctgggagaaaggaggaggaaaaccatccccgtggtcccaccctgcttgaacaaaggaccaaggtgcccaaacccttgcggccccggggttgaaactcattcgtcctgcccccccccggcccgggtctaaan

SEQ ID NO: 54634 - DNA, 674 bp, Zea mays
  misc_feature: Ceres CLONE 1480880
  misc_feature: Encodes the peptide sequence at SEQ ID NO. 54635
  misc_feature (466)..(466): n is a, c, t, g, unknown, or other
  misc_feature (473)..(473): n is a, c, t, g, unknown, or other
  misc_feature (548)..(548): n is a, c, t, g, unknown, or other
  misc_feature (555)..(555): n is a, c, t, g, unknown, or other
  misc_feature (596)..(596): n is a, c, t, g, unknown, or other
cgattgggtaccgggccccccctcgagccactgcagtggtaaaggtgtcaggtctcatccggagtcgtcgccaagaaccacagccaccgcgatggcgcagatcatcgatggcaaggccatcgccgccgacgtccgccgcgaggtcgccgccgatgtggccgcgctctcgtcagcccacggactcgtgccggggctggccgtggtcatcgtggggagcaggaaggactcgcagacgtacgtgaacatgaagcgcaaggcgtgcgccgaggtcggcatctgctccatcgacgtcgacctcccggaggacatctccgagaccgcgctcgtcgccgaggttcatcgcctcaacgctgaccccgcagtgcacgggatccttgtccagcttccacttcctaagcatatcaacgaagagaagatactgagcgagatttccatcgagaaagatgtggatggcttccatcctctncacattnggcagcttgcaatgaaaagcagagagccactgttcgtaccatgtacgccaaaggggtgcatggagctcttgtcanggagcgnagtcactgttaagggtagcgggcagttgtggttggtcgcancacatcgtcgggctacctgtatccctgctcctttctgaggcagatgcgaccgtatctgttgtgcactcgcggacccct

SEQ ID NO: 54635 - protein, 180 aa, Zea mays
  misc_feature: Ceres CLONE 1480880
  misc_feature (3)..(120): Pfam Name: THF_DHG_CYH Pfam Description: Tetrahydrofolate dehydrogenase/cyclohydrolase, catalytic domain
  misc_feature (128)..(128): Xaa is any aa, unknown, or other
  misc_feature (153)..(153): Xaa is any aa, unknown, or other
  misc_feature (155)..(155): Xaa is any aa, unknown, or other
  misc_feature (169)..(169): Xaa is any aa, unknown, or other
MAQIIDGKAIAADVRREVAADVAALSSAHGLVPGLAVVIVGSRKDSQTYVNMKRKACAEVGICSIDVDLPEDISETALVAEVHRLNADPAVHGILVQLPLPKHINEEKILSEISIEKDVDGFHPLHIXQLAMKSREPLFVPCTPKGCMELLSXSXVTVKGSGQLWLVAXHRRATCIPAPF

SEQ ID NO: 54636 - DNA, 673 bp, Zea mays
  misc_feature: Ceres CLONE 1480881
ccaattgggtaccgggccccccctcgagccactgcagtggtaaaggtttaagaatttggggagatcggtcgggttcgcgctgcaagattcggtctctgtgcctgttttattcacgagatcgcaacaacgatattgctaagcaagataagatttcaacttttttcctggatcgatctcagattaggaggagcaaataaagcaagaatagaaagatttttggggggagaaaggcatgatgctggaagggaagtcctaccttgtgtcgcgctccgtgccgagctcctgcgagccggagacggagtgggagtacctcgcccacggcgtccctcagcgcaagcgcccggcgccggaagatgacgtcgaagtcgaagaccccgacgaaactggcagcggcgcaagcgcaacaaaccggcgtctccgcagccgcacacgccggacatctgcgaggggcagggctccaacgccacgcccacgggttcggagagcaacggaatcaccgggagcaccccatgacttcaatcgggcgggacctgaccctcaattgcctccctcgggttatctcggcccgactagggttcgggggcctcccctaagcggggaattccccctccagggccccgcaagggggaaaatctacggccttgcggcgcccagaacggggggggcccaatct

SEQ ID NO: 54637 - DNA, 679 bp, Zea mays
  misc_feature: Ceres CLONE 1480882
  misc_feature (295)..(295): n is a, c, t, g, unknown, or other
  misc_feature (368)..(368): n is a, c, t, g, unknown, or other
  misc_feature (400)..(400): n is a, c, t, g, unknown, or other
  misc_feature (480)..(480): n is a, c, t, g, unknown, or other
  misc_feature (526)..(526): n is a, c, t, g, unknown, or other
cgattgggtaccgggccccccctcgagccactgcagtggtaaaggtgtgtgtgttgctggcacctggcagtggcagccgagacgacgatggcgtcgtgtatcatgtgggtgttgtgttgtgtatatcatcatcatccgaaagatggaaactttactggcctaaaaaaaaaaaaaaaaccagagctctgggaattcctgcagcccgggggatccactagttctagagcggccgccaccgcggtggagctccagcttttgttccctttagtgagggttaatttcgagcttggcgtantcatggtcatagctgtttcctgtgtgaaattgtatccgctcacatttccacacacatacgagcccgaagcatnaagtgtaaagcctggggtgcctaatgagtganctaactcacattaattgcgttgccctcactgccggctttccagtcggaaaacctgtcgtgccagctgcattaatgaatcngccaacgcgcgaggaagaggcggtttgcgtattgggcgctcttccngcttcctcgctcactgactcgctgcgctcggtcgttcggctgcggggagcggtatcacctcactacaagggcggtatacggttatcccacagaatcgggggataacgcaggaaagaacttgttagcaaaaagccagcaaaaggccaagaaccc

SEQ ID NO: 54638 - DNA, 691 bp, Zea mays
  misc_feature: Ceres CLONE 1480883
  misc_feature: Encodes the peptide sequence at SEQ ID NO. 54639
  misc_feature (390)..(390): n is a, c, t, g, unknown, or other
  misc_feature (402)..(402): n is a, c, t, g, unknown, or other
  misc_feature (408)..(408): n is a, c, t, g, unknown, or other
  misc_feature (436)..(436): n is a, c, t, g, unknown, or other
  misc_feature (454)..(454): n is a, c, t, g, unknown, or other
cgattgggtaccgggccccccctcgagccactgcagtggtgcatggttcgcagcgccaccgccagggtcgcaagcttatagcagtcaacaaatactagtgcccattaccggatcggtcggaagccggccggcggcaaggaaggagtatcccagcgcagcaccgactccacgacttggccatcatccatcgcagtatcgcaccgcagcaacagacaccgaccgaggatggttgttgccgtcgccgcgcggtcgtcgtccgcgaccagcagcagcagcgagctggggtcgctgttcgcggcgttcgacgcggacgcggacgggcggatctcggcggccgaactgcgggagtgcgtgcgggcgacgctggggcccgacgccgtcggcgtgtcngcggaagaggcngaggcnctggtggcgggcgcggactcggacggcnacgggctgctggaccccnccgaagtcgcgcggctcgtggccggcctgcacgcgggcgccgccgaggaaggacggccaccgcggcctgcgccaggcctttccggatgtactccctcgggctccgaagaacgcgggggagggcccggggcctccttcttgcatcaccccccgacagcctgtgcccgcaatgctcccccgggctccggcgcgccacccgggacgtggaaccaactgcccccccccatggattttgcag

SEQ ID NO: 54639 - protein, 155 aa, Zea mays
  misc_feature: Ceres CLONE 1480883
  misc_feature (18)..(46): Pfam Name: efhand Pfam Description: EF hand
  misc_feature (71)..(71): Xaa is any aa, unknown, or other
  misc_feature (77)..(77): Xaa is any aa, unknown, or other
MVVAVAARSSSATSSSSELGSLFAAFDADADGRISAAELRECVRATLGPDAVGVSAEEAEALVAGADSDGXGLLDPXEVARLVAGLHAGAAEEGRPPRPAPGLSGCTPSGSEERGGGPGASFLHHPPTACARNAPPGSGAPPGTWNQLPPPMDFA

SEQ ID NO: 54640 - DNA, 681 bp, Zea mays
  misc_feature: Ceres CLONE 1480885
  misc_feature: Encodes the peptide sequence at SEQ ID NO. 54641
  misc_feature (1)..(1): n is a, c, t, g, unknown, or other
ncgattgggtaccgggccccccctcgagccctgcagtggtaaaggagttcctcagggccggcgcccactgggtccccgtcggccccaccaaggggggcaggctcttcgtcaacatcggggaccagatcgaggtcctcagcgccggcgcctaccggagcgtcctgcaccgcgtcgcggccggggaccagggccgccgcctgtccgtgggcacgttctacaaccctggcaccgacgccgtggtcgcgccagcgcccggcagggacgatcagggcgccggcgccgccgcgtaccccggtccctacaggttcgggggactacctcgactactaccagggcactaagttcggcgacaaggacgccaggttccaggccgtcaagaagctgctcggctaagcgaacagctgcaagtaggcagaggcagcttagctcgtggactatgcatagtttcaagcttgctgcttgcttcttgttcgatccattgtctgcatgcgtactgtggcgtgttaaatttagcaaatcttatacgtagccgttactgggactaacttatctgggggttgacaatcctttgtttgcgttttagggcccaaaaaaaaaaaaaaaaaccccggatctctgggaaatttcccggcaccccgggggaatcccatttttttttaggagggggcccccccccggggg

SEQ ID NO: 54641 - protein, 112 aa, Zea mays
  misc_feature: Ceres CLONE 1480885
  misc_feature: SWISSPROT Homolog: EC 1.14.17.4 Aminocyclopropanecarboxylate oxidase
DWVPGPPSSPAVVKEFLRAGAHWVPVGPTKGGRLFVNIGDQIEVLSAGAYRSVLHRVAAGDQGRRLSVGTFYNPGTDAVVAPAPGRDDQGAGAAAYPGPYRFGGLPRLLPGH

SEQ ID NO: 54642 - DNA, 667 bp, Zea mays
  misc_feature: Ceres CLONE 1480894
  misc_feature: Encodes the peptide sequence at SEQ ID NO. 54643
  misc_feature (624)..(624): n is a, c, t, g, unknown, or other
  misc_feature (667)..(667): n is a, c, t, g, unknown, or other
cgattgggtccgggccccccctcgagccctgcagtggtaaaggcctggacgcggccacggcctacctcctcgacgagctcacggacgactgccccgccgactaccgcaacgtcatggccgctgccgtgcgcggcgactacgacacgtgcggcctgtacgccgaccagctgaagcggcggtccgcggagctgttcaaggagggtgtccttggcctggagcacctcgccgcggtggacgccttctgcgagctcgtcgcccgcggcatgggcgcgcccgagccgccgcgcacctaccacatcaacctgtccgtgttcacctccctgccggacatgtgggccatcgggcagcagttccccatcatcccgatccagcggctgcaggagcggcccgccgtcgacggcgtgctctcggacctcacctgcgacagcgacggcaaggtgagcgagttcatcggcgggaggcacagcctggcgctgcacgagctgcccacccacgccacccgcggctactacctgggcatgtttctcgggggcgcctacccagaagcccttcgcgggctgcacaaactcttcggcgggccgagcgtggtgcgcgtgtcccagtgcgacgggtcccactgcttcnccgtgacgcgcgccgccgcgggcccctcttgccccgacttgtn

SEQ ID NO: 54643 - protein, 221 aa, Zea mays
  misc_feature: Ceres CLONE 1480894
  misc_feature (37)..(198): Pfam Name: Orn_DAP_Arg_deC Pfam Description: Pyridoxal-dependent decarboxylase, C-terminal sheet domain
  misc_feature: SWISSPROT Homolog: EC 4.1.1.19 Arginine decarboxylase
  misc_feature (208)..(208): Xaa is any aa, unknown, or other
IGSGPPLEPCSGKGLDAATAYLLDELTDDCPADYRNVMAAAVRGDYDTCGLYADQLKRRSAELFKEGVLGLEHLAAVDAFCELVARGMGAPEPPRTYHINLSVFTSLPDMWAIGQQFPIIPIQRLQERPAVDGVLSDLTCDSDGKVSEFIGGRHSLALHELPTHATRGYYLGMFLGGAYPEALRGLHKLFGGPSVVRVSQCDGSHCFXVTRAAAGPSCPDL

SEQ ID NO: 54644 - DNA, 690 bp, Zea mays
  misc_feature: Ceres CLONE 1480898
  misc_feature: Encodes the peptide sequence at SEQ ID NO. 54645
  misc_feature (656)..(656): n is a, c, t, g, unknown, or other
cgaattgggtaccgggccccccctcgagccctgcagtggtaaaggcgtctgacagcttctccatgtgcttcggcgacgacggcgtcggccgcgtcaacttcggcgacgccggcagccgcggccaggccgagacgccgttcaccgtccggagcttgaacccgacgtacaacgttagcttcacgtccatcggcatcggcagcgagtcggtggcagcggagttcgccgccgtcatggactccggcacgtccttcacgtacctcagcgacccggagtacacgcagctcgccaccaaattcaactcccaggtcagcgagaggagagtgaatttcagcagtggctctgcagatcctttttccttcgagtactgctacagactcagccctaaccagacagaggtggcgatgccggacgtgagcctgacggccaaggggggagccctgttcccggtcacccagccgttcatccccgtcggcgacacgaccggccgtgccatcggctactgcctggggatcatgagggacgacatggccattcggcttcgacatcatcggccagaaatttcttgaccggaactaaaggtcggtcttcaaacagggaaaggtcccgtccctgggcttggggaaaagtttcaactgcttacaggaaacagcgggggngggccgaaagcccccgggacgggaaaccccgggt

SEQ ID NO: 54645 - protein, 187 aa, Zea mays
  misc_feature: Ceres CLONE 1480898
  misc_feature: SWISSPROT Homolog: EC 3.4.23.12 Nepenthesin
NWVPGPPSSPAVVKASDSFSMCFGDDGVGRVNFGDAGSRGQAETPFTVRSLNPTYNVSFTSIGIGSESVAAEFAAVMDSGTSFTYLSDPEYTQLATKFNSQVSERRVNFSSGSADPFSFEYCYRLSPNQTEVAMPDVSLTAKGGALFPVTQPFIPVGDTTGRAIGYCLGIMRDDMAIRLRHHRPEIS

SEQ ID NO: 54646 - DNA, 682 bp, Zea mays
  misc_feature: Ceres CLONE 1480906
  misc_feature: Encodes the peptide sequence at SEQ ID NO. 54647
  misc_feature (279)..(279): n is a, c, t, g, unknown, or other
  misc_feature (460)..(460): n is a, c, t, g, unknown, or other
  misc_feature (500)..(500): n is a, c, t, g, unknown, or other
  misc_feature (626)..(626): n is a, c, t, g, unknown, or other
cgattgggtaccgggccccccctcgagccactgcagtggtaaagggattgctttccccacctccaccgccaccagaccagatagcaagcaaccgacccctcctcgctgtattcgcagggaaggagaagatggagcctggccagagcgggactgagcaggcctctccacgcgggaacgattgggaggtcgtgcagctcaccgcgtccgcatacgccgccgcgcccgctccgaggaagcccgagccctccgacgaagcggaagctaagagatacggcgcanagggggacgatctagccgccggcctactcatgtccggccacttctccgtgtctcagagcgaggtcgagagcctcctcgtaggcgccgacacccaagaaccaccgccaagggacagggagagccttgcgagcatactaagctgctggaggacgacgtccccacccatccgttcgatgacggncaggcgctgaaaggcatgggtctgggtcgggaagagccgncggggttctcgtcgcctgtctacggctccatcacggagagcaggagtgacaagaggagcgaggagcctactactctgcatagtttgaaccccgtgactgggctcacaaaggtcgtcttcactgacnagcaaagcgagcctgctgctgggtctgggtcccggtctgggtcaggcccgcgtgaa

SEQ ID NO: 54647 - protein, 113 aa, Zea mays
  misc_feature: Ceres CLONE 1480906
  misc_feature (51)..(51): Xaa is any aa, unknown, or other
  misc_feature (111)..(111): Xaa is any aa, unknown, or other
MEPGQSGTEQASPRGNDWEVVQLTASAYAAAPAPRKPEPSDEAEAKRYGAXGDDLAAGLLMSGHFSVSQSEVESLLVGADTQEPPPRDRESLASILSCWRTTSPPIRSMTXRR

SEQ ID NO: 54648 - DNA, 650 bp, Zea mays
  misc_feature: Ceres CLONE 1480912
  misc_feature: Encodes the peptide sequence at SEQ ID NO. 54649
  misc_feature (413)..(413): n is a, c, t, g, unknown, or other
  misc_feature (432)..(432): n is a, c, t, g, unknown, or other
  misc_feature (443)..(443): n is a, c, t, g, unknown, or other
cgattgggtaccgggcccccctcgagccactgcagtggtaaagggcagggcctcttgatcatcagtcgccagaggagctgttgatcgaggtgagtgaggttgaaaagcaggcggcgaacaaaggcaccatcgtcatggacagcggatactacggcggccgcgatcagcgctacagcggcgggtactacggcggcggtggcatcgcgacgccggggtacgctccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcgacgggaaggtggtgctggcgccggcgaaccccaagacgagtaccagcactggatcaaggacatgncgtggagcacgagcatcanggacgaagaanggtacccggcgttcgcgctggtgaacaaggcgaccggggaggccatcaagcactcgctggggcagtcccacccggtgcgcctggtgccctacaacccggactttcctggacaatcggtgctgtggacggaaagccccgaactccgcaacgggtttccgctgcgtccgcatggttcaaaacatctacctcaatttcgatgccctccag

SEQ ID NO: 54649 - protein, 110 aa, Zea mays
  misc_feature: Ceres CLONE 1480912
  misc_feature (93)..(93): Xaa is any aa, unknown, or other
  misc_feature (100)..(100): Xaa is any aa, unknown, or other
  misc_feature (103)..(103): Xaa is any aa, unknown, or other
MDSGYYGGRDQRYSGGYYGGGGIATPGYAPAVPYGMSQVNIEGNGCGRALPPQPTVKVYCRANPNYAMSVRDGKVVLAPANPKTSTSTGSRTXRGARASXTKXGTRRSRW

SEQ ID NO: 54650 - DNA, 660 bp, Zea mays
  misc_feature: Ceres CLONE 1480914
  misc_feature: Encodes the peptide sequence at SEQ ID NO. 54651
  misc_feature (289)..(289): n is a, c, t, g, unknown, or other
cgattgggtaccgggcccccctcgagccactgcagtggtaaaggagaagctgccgggccacaaggacggccaccacacggccgcaccgtccccggcgcccgcgcccgtggagacgcatgcccaccaccaggaggaagcgcacaggccgcacgtcgtcccgaccccggccccgccgcctccaccgcacgtccaccagcacgaccacggcgtcgtcgtccaggacgacgtgaagaccgggaccccgccgcatgcacccggaggagagaagaaagcctgctggacagatcanggagaagctctcgggtggccacaacagaagctgaagccgctgccgctgccgcacggctcacccgtcacgcgccgcgcggcgccgcaggcggagacgtgagcacccggatgccaagagaagaaggcttgctgggcaaatcatggacaaatacccggctacccaaggctcagttgagaagcaaccacaggggggagccgccgggagacaccggacatctccttctataaggtccaattccagcgtgtcctggccgggccggccttgggcaaaaaaaaactagcgttggctgtggggtccgttcctgagttcttttcccaaaatttttgtttcaagggggatcccctgggccaaggtccttttgtcttttttag

SEQ ID NO: 54651 - protein, 128 aa, Zea mays
  misc_feature: Ceres CLONE 1480914
  misc_feature (96)..(96): Xaa is any aa, unknown, or other
DWVPGPPRATAVVKEKLPGHKDGHHTAAPSPAPAPVETHAHHQEEAHRPHVVPTPAPPPPPHVHQHDHGVVVQDDVKTGTPPHAPGGEKKACWTDXGEALGWPQQKLKPLPLPHGSPVTRRAAPQAET

SEQ ID NO: 54652 - DNA, 709 bp, Zea mays
  misc_feature: Ceres CLONE 1480916
  misc_feature (297)..(297): n is a, c, t, g, unknown, or other
  misc_feature (302)..(302): n is a, c, t, g, unknown, or other
cgattgggtaccgggccccccctcgagccctgcagtggtaaagggatgcatctactcccatttctctgcacgcagctcagtctcgtccatccagtgctgtagaattttctttggtctgttggcaaggcagccatgaaaccccctcagctgccggcaggggagggggcctcctgagctcacgaggtcaagcaggccctccgtgagaaactccggcgctcctacggcgccggagctgcctccgccacaccggaggctaggccggccggcgaaccaagccgtggcgcccagtgcccccgncttgncggccgaggaccccataaggagagtcttggtctttggctccctggggtcccccttaagaccacaaacccacccacccaaatcttggtgtggtaaacaaacaaattggtttttccccccccccggggcatttttaatttggcaaacaacccgaacttataaaaaaaaaactgggacgcctgtcttttgtaaatccatggaaaacttggttgctggctttgccccccttgaaaaaaccatggaaacccttgggaaaaagcttggttaaacctagccttaggaaaaataaaatattttccccattatttgggggttatttaaaagggggggtgggaaataaaaaaaaaaaaaaaaaaaacaaaggggcccgttaatcccccctgttctcttctgggggtgcctttgggga

SEQ ID NO: 54653 - DNA, 654 bp, Zea mays
  misc_feature: Ceres CLONE 1480918
  misc_feature: Encodes the peptide sequence at SEQ ID NO. 54654
  misc_feature (433)..(433): n is a, c, t, g, unknown, or other
  misc_feature (451)..(451): n is a, c, t, g, unknown, or other
  misc_feature (467)..(467): n is a, c, t, g, unknown, or other
  misc_feature (541)..(541): n is a, c, t, g, unknown, or other
cgattgggtaccgggccccccctcgagccctgcagtggtaaaggctagacgacgcgaccggcacggcggcggcgcacagccccgacgacgaccctccccgctgccttctccccgatctctacgacaccaattatagatggggaaggtgaacctcctccctcttgggatccggcaccaactccaaaagttctacactcagatgagacaggcgaggttaaggttcgacgactcctcgagggacatgccaagaactatcaagttacattgttgtttattttccctgtcttattgggaagcaaagtattggaaaaaactgcatttagttgatgatccactagaaagttaggctatgtcccactcgagtctttatactgtggtgttgtctcttgttatgcaatgttccctgcatgattttttgttttggcatgtctancactgggtcagctgttcngctgctcattatggtngcagtcaaacataagattgggtgtctagcacctttgatatgtcgtagcaaaaactgctagttcactctttgatnaaaaaaaaaaaaaaaaccagagctctgggaattcctgcagcccgggggatccactagttctagagcggccgccacgcggtggaactccagcttttgttcctttagggaaggta

SEQ ID NO: 54654 - protein, 69 aa, Zea mays
  misc_feature: Ceres CLONE 1480918
MGKVNLLPLGIRHQLQKFYTQMRQARLRFDDSSRDMPRTIKLHCCLFSLSYWEAKYWKKLHLVDDPLES

SEQ ID NO: 54655 - DNA, 573 bp, Zea mays
  misc_feature: Ceres CLONE 1482258
  misc_feature: Encodes the peptide sequence at SEQ ID NO. 54656
  misc_feature (49)..(49): n is a, c, t, g, unknown, or other
cgattgggtacgggcccccctcgagccctgcagtggtaaagggatctantttcccactcgatcgccaataatggagtttccgcaccaccaccaccaccacggccatcgccgcgacgacgacgaagacgaccgcagaggcccgcctcccccggtctacggcggctacggccagccaccgccacccgacccgtacggccgcgcgcccgtcgaccccgatccgtacggtcgacctccgccccagtccgcgtacggtggggccggggacgcctacggccacagcggccaaggctacgcgcccccgccggcctacggcgcccgggggccggtacggcaacgttcgtccacgtcgcgcacgagggtcgggaacaagagggctttactaacgggggcggccggcggcggtcttttgggggcccctacgggaaggggggggctcccaaatacgggcccccagggggccaacccccccccggggggggggggggattcccattaagggccccaaaaaaacccccccccccccagggggggggggggggggggcccccccccccctggtaggggaacaaaaaa

SEQ ID NO: 54656 - protein, 141 aa, Zea mays
  misc_feature: Ceres CLONE 1482258
MEFPHHHHHHGHRRDDDEDDRRGPPPPVYGGYGQPPPPDPYGRAPVDPDPYGRPPPQSAYGGAGDAYGHSGQGYAPPPAYGARGPVRQRSSTSRTRVGNKRALLTGAAGGGLLGAPTGRGGLPNTGPQGANPPPGGGGDSH

SEQ ID NO: 54657 - DNA, 660 bp, Zea mays
  misc_feature: Ceres CLONE 1482260
  misc_feature (1)..(1): n is a, c, t, g, unknown, or other
ncgattgggtccgggccccccctcgagccactgcagtggtaaagggtcatagctccttctcctacacagaaaagccgtcgcctactcgcctccggccaaaaaactgactccacacacgacccaaatcttttcctctccacaggcgactcccaacgcaacagcagctcgtcgagcgagtcgtcgccggccggccggtatatacgcaagaaagccaagaaaaacacttctgcctcttccctcatatccaaagaacaaaggtagctagctagccgcgactcgttggctagacgattcaagcagcagcgcaggatggtggcgcccgtggtgattgcgtcggcccgggcttggcatgcttggccggcgtggcaattgcccaaccgggccctcggggaaagggtctccggggggctctccaggggggacacgcggcccccgcttgggccaccgggtgggggggtcccgggccccctgggaagggatcttggaaaccccgggggcccaaaggggactcccgggtggccgaaacttttccttggggggggggaggaagacccttgtgcgcaaatggggggggggttccgggggggggggcaccgccctccttgggagggggttacccttccacgaaaccaaaaaaccccccccccccccccccccccc

SEQ ID NO: 54658 - DNA, 653 bp, Zea mays
  misc_feature: Ceres CLONE 1482265
  misc_feature: Translation starting site: 428
  misc_feature: SWISSPROT Homolog: EC 5.2.1.8 Peptidylprolyl isomerase
  misc_feature (635)..(635): n is a, c, t, g, unknown, or other
cgattgggtaccgggccccccctcgagccactgcagtggtaaagggtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaaggtccgttcccgtcccagatccgtccatggcttcgtccagatctgacctgtcctgacacaccctcacccggatctgtccctccttcccctctcccctgcagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacngtggtggtggcggcggct

SEQ ID NO: 54659 - DNA, 667 bp, Zea mays
  misc_feature: Ceres CLONE 1482267
  misc_feature: Encodes the peptide sequence at SEQ ID NO. 54660
ccgattgggtaccgggccccccctcgagccactgcagtggtaaaggaatccagcaatacccgagtacccgacgcgctagctagttctattgccgcaccccagatctccaggagggactcgttcgttcagctaactacactgcacgcaatggccaccacggcgaccgaggcggcgccggcgcaggagcagcaggccaacggcaacggcgagcagaagacgcggcactccgaggtcggccacaagagcctgctcaagagcgacgacctctaccagtacatcctggacacgagcgtgtacccgcgggagccggagagcatgaaggagctccgcgagatcaccgccaagcacccatggaacctgatgacgacctccgccgacgaggggcagttcctgaacatgctcatcaagctcatcggcgccaagaagaccatggagatcggcgtctacaccggctactccctcctcggcacggcgctcgccctcccggaggacggcacgatcttggccatggacatcaaccgcgagaactacgagctgggcctgccctgcatcgagaaggccggggtcccccacaagaccgctttccgcgagggggccgcgctcccccgccttcgacgacctcagcgcgggaggaggaaaaccccggggccggtcgacttccgccttc

SEQ ID NO: 54660 - protein, 173 aa, Zea mays
  misc_feature: Ceres CLONE 1482267
  misc_feature (45)..(173): Pfam Name: Methyltransf_3 Pfam Description: O-methyltransferase
  misc_feature: SWISSPROT Homolog: EC 2.1.1.104 Caffeoyl-CoA O-methyltransferase
MATTATEAAPAQEQQANGNGEQKTRHSEVGHKSLLKSDDLYQYILDTSVYPREPESMKELREITAKHPWNLMTTSADEGQFLNMLIKLIGAKKTMEIGVYTGYSLLGTALALPEDGTILAMDINRENYELGLPCIEKAGVPHKTAFREGAALPRLRRPQRGRRKTPGPVDFRL

SEQ ID NO: 54661 - DNA, 663 bp, Zea mays
  misc_feature: Ceres CLONE 1482274
  misc_feature: Encodes the peptide sequence at SEQ ID NO. 54662
cgattgggtaccgggcccccctcgagccactgcattggtaaaggagtctacgcgacgctcgacggcacggcaacagacaaagccaacagcgtggctccaccaccgtggccggtcgtagcgctgctgctctgcgccgcgctagcgttcgcggcgcggtcgagctcggccgtggacccggtgggcacgtactgcgccaagaacttcacgggagcgcagactcatgcgagcatctgcccaggtcctggccgctctggtcccgcgcgcctccgcggactactacgcgacggcaacagacggcggcggcggcggctcggccaccatctggggcctggctcaatgcctcgggcacgttccggcttccgactgccctcgctgcgtgggggcggaggtctcgcaggctgcgactactcgccttcgcccggctgaccacctcctatggaacgactactgccccctcccctgcaacaactcccactcctagggactgccggacaccttgtaccagctcttcctcattcacctgttgaacccccccgagcattgccctcaaccacccaagccgagggcatttttcatggcccctccttcaatggaaaacatgccccaaggaatccacctgccgggggggggaagcgcccaagatcctattatggatctttacgg

SEQ ID NO: 54662 - protein, 86 aa, Zea mays
  misc_feature: Ceres CLONE 1482274
MRASAQVLAALVPRASADYYATATDGGGGGSATIWGLAQCLGHVPASDCPRCVGAEVSQAATTRLRPADHLLWNDYCPLPCNNSHS

SEQ ID NO: 54663 - DNA, 642 bp, Zea mays
  misc_feature: Ceres CLONE 1482276
  misc_feature: Encodes the peptide sequence at SEQ ID NO. 54664
  misc_feature (109)..(109): n is a, c, t, g, unknown, or other
  misc_feature (118)..(118): n is a, c, t, g, unknown, or other
  misc_feature (143)..(143): n is a, c, t, g, unknown, or other
  misc_feature (347)..(347): n is a, c, t, g, unknown, or other
cgattgggaccgggccccccctcgagcactgcagtggtaaagggatctccaggaatccgcggctgaggcgccggcgatggcggctcccatggtcgacgccgaatacctngcgccaggntcgacagggggcgcgccgccacctnccgcgccctcatctccaacaagggatgcgccccgatcatgctccgcctcgcatggcatgatgctggaacttatgacctgaagacaaaaactggtggtgcaaatggttcgattagatatgaagaagagtacactcatggttcaaatgctgggtttaagattgctatcgatctccttgagcctatcaaagcaaagaatccaaagantacatatgcagaacctgtatcagctttggctggaaatgggttgcaagtcgaaagttgactggggggggcccaactggttgaaattttatttccctgggcaaaacgtgaattcctgccgggggtgccccccgggaagggggcggctggcccaaaatccaaaaaaaggggggaccccaatcctgaggggaaattctttttatcggaagggggtttttccgaaaaaaaaattttggaaaccccttttccgggggggacaaaacccctggggaaaggggcccccccccgggaagggggt

SEQ ID NO: 54664 - protein, 74 aa, Zea mays
  misc_feature: Ceres CLONE 1482276
  misc_feature: SWISSPROT Homolog: EC 1.11.1.11 L-ascorbate peroxidase
  misc_feature (56)..(56): Xaa is any aa, unknown, or other
MLRLAWHDAGTYDLKTKTGGANGSIRYEEEYTHGSNAGFKIAIDLLEPIKAKNPKXTYAEPVSALAGNGLQVES

SEQ ID NO: 54665 - DNA, 672 bp, Zea mays
  misc_feature: Ceres CLONE 1482281
cgattgggtccgggccccccctcgagccctgcagtggtaaaggattccgtcgtcgtcgtcagcagcttctgcttgctttgtgggggaaggagagagagacagagcgagagatagatctagtagagaggctagtaggtggtcctccaacgaagatgttggcggtgttcagcgggcattgtggtggaggtgccggcagagctggtggcggcgggcagccggacgccgtcacccaagacgaaggcgtcgcagctcgtggggcgcttcctggccgcctcctagccggccgtgtccgtgcagctcggcgaccacggccacctcgcttactcccacaccaaccaggcgctcctccgccccaggtcgttcacggccaaggacgaggtgttctgcctgttcgaaggggtgctggacaacctgggtcggctgagccagcactacgggctgtcaagcaagggcgccaacgaggtgctcctcgtcatcgaggcctacaagacgctgcgcgaccgcgcgccctacccggccagcttcatgctcgcccagctcaccggctcctacgccttcgtcctcttcgaaagtccaccaactccctgctcgtagcatccgaccactagggcagggtgccgctcttctgggggatcaccggcgactgatgcgtcgccttctccgacgacatcg

SEQ ID NO: 54666 - DNA, 670 bp, Zea mays
  misc_feature: Ceres CLONE 1482288
  misc_feature: Encodes the peptide sequence at SEQ ID NO. 54667
cgattgggtacgggccccccctcgagccctgcagtggtaaagggcgcgctgcactccctccctgcccctgttctctctctcgtggcgacggcgacggcgacgactgggcggccgttgctgccgccctactcgccaggcgcccaggtattcttcggccccttcgccggcgacgagtgtcaccaggttcctcgtctccggaacgcagtgcaaagcagatcgatctcggcccagcaggggcctcacgacttgactcccaagactccagggctggatcgtgtttcttccagtgtgcaagcttggatctcgtaggtctggtttagaaaggaccgtgcttgctctttgctgccgcaatcatgcagagtgggggcgacatgaggcctgtgcacaacagtgtcgatacagttaacgctgctgctgttgccatcgtcaccgcggagagccgcacacagcctcctgctgaacagagaaggaaatgggctgaccggttgagcgtgtacttctgccttggatcacagaagaatggccggcgcatgcgtgtcaaccatgccgcacttggtcccgaaacctgcacctcaaaggacagatgctccctgcagcagaaaattccaaaccaccccaccgcctccctggggttcccctttgggggcaccggccatccctctcctggctt

SEQ ID NO: 54667 - protein, 105 aa, Zea mays
  misc_feature: Ceres CLONE 1482288
MQSGGDMRPVHNSVDTVNAAAVAIVTAESRTQPPAEQRRKWADRLSVYFCLGSQKNGRRMRVNHAALGPETCTSKDRCSLQQKIPNHPTASLGFPFGGTGHPSPG

SEQ ID NO: 54668 - DNA, 651 bp, Zea mays
  misc_feature: Ceres CLONE 1482305
  misc_feature: Encodes the peptide sequence at SEQ ID NO. 54669
aaagctggagctccccgcggtggcggccgctctagaactagtggatcccccgggctgcaggaattcgcacgagaccattacctagaacatcctaatcgaaaaaagtcgttttggataaaacactctctcatctctcctggagcagagcctcagctccgtcgtcaatcctagcaatggcttcctcagtcgtcacttcttttcaacccaggtcagcatttttgggagataggaacgtgttcaaggtctcagccacgccttcagctcaagtgggttactcaaggaagactatccagtgtaaggaatcaaggatagggaagcaacctatcgctgtaccaaccaatgtaaccattgcattggaaggtcaagacttgaaagtcaaaggtccactaggagagcttgctttaacttacccacgcgaagttgagctcatcaaagaagatgctggtttcttgagggtcaaaaagaccgtcgaaactagaagagctaaccaaatgcacggccctcttcaggacgctaacggataacatgggtagtgggagtatcaaaggggtttgaagaaaaagctgatacttagtggggagttggttaccgtggcaacccggggaagggaagagaaactggttctgaaccttccggtgttctctcccccgg

SEQ ID NO: 54669 - protein, 116 aa, Zea mays
  misc_feature: Ceres CLONE 1482305
MASSVVTSFQPRSAFLGDRNVFKVSATPSAQVGYSRKTIQCKESRIGKQPIAVPTNVTIALEGQDLKVKGPLGELALTYPREVELIKEDAGFLRVKKTVETRRANQMHGPLQDANG

SEQ ID NO: 54670 - DNA, 437 bp, Zea mays
  misc_feature: Ceres CLONE 1482315
  misc_feature: Encodes the peptide sequence at SEQ ID NO. 54671
  misc_feature (259)..(259): n is a, c, t, g, unknown, or other
  misc_feature (260)..(260): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
atagctggagctccccgcggtggcggccgctctagaactagtggatcccccgggctgcaggaattcgcacgagaccattacctagaacatcctaatcgaaaagcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtaccccggacatggnnctgagcaaggtggaaacccccccccaccccgggcctccttttgggggtcgccccctcccaggggcacccccaggccggtgttcaaaggggggccccccccgaaaatcttaaaaaaaagcggnnnnnnggggggggaaaaataagaggggggggcgggggaaaacacttctcccccct

SEQ ID NO: 54671 - protein, 78 aa, Zea mays
  misc_feature: Ceres CLONE 1482315
  misc_feature (1)..(55): Pfam Name: Metallothio_2 Pfam Description: Metallothionein
  misc_feature (32)..(32): Xaa is any aa, unknown, or other
  misc_feature (73)..(73): Xaa is any aa, unknown, or other
  misc_feature (74)..(74): Xaa is any aa, unknown, or other
MSCCGGNCGCGSGCKCGNGCGGCSKMYPGHGXEQGGNPPPPRASFWGSPPPRGTPRPVFKGGPPPKILKKSGXXGGEK

SEQ ID NO: 54672 - DNA, 631 bp, Zea mays
  misc_feature: Ceres CLONE 1482317
atagctggagctccccgcggtggcggccgctctagaactagtggatcccccgggctgcaggaattcgcacgagaccattacctagaacatcctaatcgaaaagtcagccgccgtgcacgctcatcatatggcatagccccaagcccccaacggatcgagcgcctccccgagtccccgttcccctgccccagctgaccgccgccgagacgtgccacaccgcctccccctcccgccgccacaaccttcgcctccacgcaattggccgcactcctttccacctcccgctacaggatagcgtgggccggtcggcggcgccgacgggtggagaactggagatccacccgcacgcggactgcttccttcgctagtcgatgggaagtaagcgttgttaggtctcatgatttcttttgggagatccggagctgtggtgcctgtctgactcatcatctctgggacactgccaagtacgattaaggaaggatttgtaaatgccactttttggagtttctggccttttggtttagtcatcaagactctagctagcaattatctaaagaaacaaatgaaatgctaattgccaccaagatggcaaaattgccggaaaacagcagttgagggagaaacttcattg

SEQ ID NO: 54673 - DNA, 595 bp, Zea mays
  misc_feature: Ceres CLONE 1482318
  misc_feature: Encodes the peptide sequence at SEQ ID NO. 54674
  misc_feature (283)..(283): n is a, c, t, g, unknown, or other
  misc_feature (439)..(439): n is a, c, t, g, unknown, or other
  misc_feature (448)..(448): n is a, c, t, g, unknown, or other
  misc_feature (474)..(474): n is a, c, t, g, unknown, or other
catagctggagctccccgcggtggcggccgctctagaactagtggatcccccgggctgcaggaattcgcacgagaccattacctagaacatcctaatcgaaaaaaacaacagcagcctgagcacccgaggagactccgtgcgaccgaagccagagccagcggaaccgaacggaagcgagacccccggcggctagcgagatggacggcggcgccggcgaggaggggaagcaagagcggcacctggtgctggcccacaagctcttccttctatcccacccctccngttgatgaacctctccaaggtcgccctccgcgccgaagtcctcgacaccgtgaaatccgatgatatggcgacgctgtttgagtcgctggtcgccgcgggtgtgctggagggggacgccgcgctgctggccgagatgcgtgggaagattgacgaagnagatccgcnagctagatgagaaaattgctgatgcngaggaaacttggggtgaaagcgaattcctgaaacacatcttgcccaaaccttgtactttataagggtccgggaaaaagaaaaagggcctggaacacctttaaggcccctgaaggaaaaacc

SEQ ID NO: 54674 - protein, 56 aa, Zea mays
  misc_feature: Ceres CLONE 1482318
  misc_feature (51)..(51): Xaa is any aa, unknown, or other
  misc_feature (54)..(54): Xaa is any aa, unknown, or other
MNLSKVALRAEVLDTVKSDDMATLFESLVAAGVLEGDAALLAEMRGKIDEXDPXAR

SEQ ID NO: 54675 - DNA, 666 bp, Zea mays
  misc_feature: Ceres CLONE 1482322
  misc_feature (204)..(204): n is a, c, t, g, unknown, or other
  misc_feature (205)..(205): n is a, c, t, g, unknown, or other
  misc_feature (212)..(212): n is a, c, t, g, unknown, or other
  misc_feature (213)..(213): n is a, c, t, g, unknown, or other
  misc_feature (217)..(217): n is a, c, t, g, unknown, or other
  misc_feature (222)..(222): n is a, c, t, g, unknown, or other
  misc_feature (224)..(224): n is a, c, t, g, unknown, or other
  misc_feature (226)..(226): n is a, c, t, g, unknown, or other
  misc_feature (232)..(232): n is a, c, t, g, unknown, or other
  misc_feature (233)..(233): n is a, c, t, g, unknown, or other
  misc_feature (239)..(239): n is a, c, t, g, unknown, or other
  misc_feature (240)..(240): n is a, c, t, g, unknown, or other
  misc_feature (246)..(246): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (278)..(278): n is a, c, t, g, unknown, or other
  misc_feature (279)..(279): n is a, c, t, g, unknown, or other
  misc_feature (416)..(416): n is a, c, t, g, unknown, or other
  misc_feature (437)..(437): n is a, c, t, g, unknown, or other
  misc_feature (535)..(535): n is a, c, t, g, unknown, or other
  misc_feature (628)..(628): n is a, c, t, g, unknown, or other
catgctggagctcaccgcggtggcggccgctctagaactagtggatcccccgggctgcaggaattcgcacgagaccattacctagaacattctaatcgaaaaactgtcagctgacgccaccgcctgcgccagccctcgccaagccggtgaaaacctcgtgccctccgccgcctccgcccgcctcttccagagtaccgcggtctnncatctcnnctcncccgngngnaaacgnngggggnnccaaanttgggnnncccnnnngggnnnaaaaggggggnncccccaaaaaaccccccggggggggagggggaccaccccggggggggggggcccccccccccaaaaaaaaaaccaccccccaagggggggggaagaaagcgacccccccccacggggccgggggggacggaccgggncccccccccgcgggggggggnggcccccccccccacaaaaaattgtgggtgggccctcgggtgaccccccccccccccctgacgctgatcgggcgggcccgcgcgggggggggggttanttcccccacacaacaaaatctcttttttccttccccccctccccccgccgaaaaaaacatacccgtccctgtttctttgtataagacaccccnccccctccccccccctttttttatgtttgaggcgggac

SEQ ID NO: 54676 - DNA, 652 bp, Zea mays
  misc_feature: Ceres CLONE 1482326
  misc_feature: Encodes the peptide sequence at SEQ ID NO. 54677
caaagctggagctccccgcggtggcggccgctctagaactagtggatcccccgggctgcaggaattcgcacgagaccattacctagaacatcctaatcgaaaactcggccgtatttaacacagcccctcgccgtccatcgacattctccctccggcctcacactctctttctcgcccgtcccacctcttttcgctgataagcacgccgccttctccagcccgtccacccccgccgctgcaggtcccgggcgctgctccccaccaccggcggaaaaatgtcgacggagtgttcggacctcggggacgagttctggctgccggaggagttcctggacgacgacttcttctccgaggaggagaaggcggccgtggcggccaggagcgagagcgacgaggaggacagcctggcggggctctcgcgcaggctcgcgggcctcctcggcgacgacggggagcggaagccgcctaccgccaagcaggcggaggtggcggtgattggatcgccgcagtcgacgctgtgcgggctgcccaagtcgggccaggagagccccaacggcggggcgtccaaggggacgtcgccgccgtcgtcgccgcctctggagcagaagccggccgacccgtggacgtcctgtacgaagcggcggggcaggtc

SEQ ID NO: 54677 - protein, 125 aa, Zea mays
  misc_feature: Ceres CLONE 1482326
MSTECSDLGDEFWLPEEFLDDDFFSEEEKAAVAARSESDEEDSLAGLSRRLAGLLGDDGERKPPTAKQAEVAVIGSPQSTLCGLPKSGQESPNGGASKGTSPPSSPPLEQKPADPWTSCTKRRGR

SEQ ID NO: 54678 - DNA, 668 bp, Zea mays
  misc_feature: Ceres CLONE 1482327
  misc_feature: Encodes the peptide sequence at SEQ ID NO. 54679
  misc_feature (436)..(436): n is a, c, t, g, unknown, or other
gatagctggagctccccgcggtggcggccgctctagaactagtggatcccccgggctgcaggaattcgcacgagaccattacctagaacatcctaatcgaaaagaggtggagagatcgcacgcgccctctgccgcttgttcgttcctcgcgcttgccaccaggcaccaccacacacatcccaatctcgcgaggcggcgagggcaagcagcagggtctgcggcggcggcggcgcttccggctccccttcccattggcctccacgatggcgctccgcctcaacgacgtcgcgctctgcctctccccgccgctcgccgcccgctgccgccgccgcagcagcggcaggttcgtcgctgtcgcctccatgacgtccgccgtctccaccaaggtcgagaataaagagccatttgctcctccaaggggagtacatgtcccagntacacattcaatgccacctcacaagattgaaattttcaagtcccttgatgattgggctaaaaataaaatcttgacgcatctcaagccaatccaaaaaggttggcacccaaagatttcctcccggaccccgcatccgaggagttcctgatgaatttaagggacccaaaaaacgggccaggaaaaacccgaaaaaatttttgtttggttgggggaaaaaatattcccagaaaac

SEQ ID NO: 54679 - protein, 106 aa, Zea mays
  misc_feature: Ceres CLONE 1482327
  misc_feature: SWISSPROT Homolog: EC 1.14.19.2 Acyl-[acyl-carrier-protein] desaturase
  misc_feature (58)..(58): Xaa is any aa, unknown, or other
MALRLNDVALCLSPPLAARCRRRSSGRFVAVASMTSAVSTKVENKEPFAPPRGVHVPXTHSMPPHKIEIFKSLDDWAKNKILTHLKPIQKGWHPKISSRTPHPRSS

SEQ ID NO: 54680 - DNA, 620 bp, Zea mays
  misc_feature: Ceres CLONE 1482336
  misc_feature: Encodes the peptide sequence at SEQ ID NO. 54681
atagctggagctccccgcggtggcggccgctctagaactagtggatcccccgggctgcaggaattcgcacgagaccattacctagaacatcctaatcgaaaagtccgtctggtttggaatttcgattgcccgtttggattggttcggggctctgttctgctggctttgcttccgccctgatctctctgctcgtgccgatcctcgacgggacgacgaaacacaggggctctccggcggcaccggggccatggaggaggacccgctcatcccgctggtgcacgtctggaacaacgccgccttcgaccatgcctccgcctccgcgtggcacgcccattcccctgcgcccgcgagcgcccgcgagggggacaaggagaaccaccgccccgagcccgacgttgaggcggaggtcgacgacgttgaggccgagatttaccacatcgaggcggagatcctgcgcctgtcttcccgcctccaccacctccgcacctccaagcagacggagccgcccaagcgtggacaggtcgcgcggacgcggatgcgggggctcagtctgggccagctcgacgtcgccgctgccgtcgactccgacccgctcaccgacaagcagcagccgcgcgccc

SEQ ID NO: 54681 - protein, 124 aa, Zea mays
  misc_feature: Ceres CLONE 1482336
MEEDPLIPLVHVWNNAAFDHASASAWHAHSPAPASAREGDKENHRPEPDVEAEVDDVEAEIYHIEAEILRLSSRLHHLRTSKQTEPPKRGQVARTRMRGLSLGQLDVAAAVDSDPLTDKQQPRA

SEQ ID NO: 54682 - DNA, 622 bp, Zea mays
  misc_feature: Ceres CLONE 1482337
  misc_feature: Translation starting site: 142
  misc_feature: SWISSPROT Homolog: EC 3.4.22.16 Cathepsin H
  misc_feature: SWISSPROT Homolog: EC 3.4.22.14 Actinidain
atagctggagctccccgcggtggcggccgctctagaactagtggatcccccgggctgcaggaattcgcacgagaccattacctagaacatcctaatcgaaaaattttgtcgcactaaaatattgccagtcccgcagtcgagatggccctacgccgccagctcgccctcgccgtcctcgccctggcggcaaccactgccgcggccaactccggcttcgcggactccaacccgatccgtcccgtcaccgaccgcgcggcctccgcgctcgagtccaccgtcttcgccgcgctcggccgcacccgcgacgcgcttcgcttcgcacgcttcgccatcaggtatggcaagaattacaagagcgcggcggaggtccagaagcggttcaggatcttctccgagagcctccagctcgtccgctctaccaaccggaaaggcctctacggctctactaccgcctcggcatcaaccgcttcgcggacatgagctgggaggagttccgtgcgacccggctcggcgcagcgcagaactgctccgccacgctcgccggcaaccaccagatgcgcgccgccgccgctgccgcgatgccggagacgaaagactggagggaggatgggatcgtgagcct

SEQ ID NO: 54683 - DNA, 675 bp, Zea mays
  misc_feature: Ceres CLONE 1482341
  misc_feature: Encodes the peptide sequence at SEQ ID NO. 54684
  misc_feature (644)..(644): n is a, c, t, g, unknown, or other
  misc_feature (675)..(675): n is a, c, t, g, unknown, or other
aagctggagctccccgcggtggcggccgctctagaactagtggatcccccgggctgcaggaattcgcacgagaccattacctagaacatcctaatcgaaaaagtcgtcgtcgttaaaaccgagaagagaccaggccgaaggaaaacaatcctgaaaccaagccatgggtctgcaggaggaatttgaggagcatgctgagaaggcaaagaccttgcctgagaacacgagcaatgagaacaagctgatcctatacgggctctacaagcaagccacggttggagatgtgaataccgatcgtccgggcatattctaccaaaaggacagggccaagtgggatgcctggaaggctgttgaaggcaaatcgaaggatgaggcgatgaatgactacatcaccaaggtgaagcagctccaggaggaggctgccgcctcttaaaagtctcttaatagtgttgccaaacagctatttgtcagatgagctttgtgccatttcctcattagaagtatatcattcgatccattggggatctgtgaaccatgtacctgtttatgtaactggttaccagtgttatccatctatctatctatctgtgaagacttgagtcttctaaattatgatatctgtctgtgtgatatctgaggctgtngttcgttttacaggctggttagttggcttcn

SEQ ID NO: 54684 - protein, 89 aa, Zea mays
  misc_feature: Ceres CLONE 1482341
  misc_feature (3)..(87): Pfam Name: ACBP Pfam Description: Acyl CoA binding protein
  misc_feature: SWISSPROT Homolog: EC 5.3.3.8 Dodecenoyl-CoA isomerase
MGLQEEFEEHAEKAKTLPENTSNENKLILYGLYKQATVGDVNTDRPGIFYQKDRAKWDAWKAVEGKSKDEAMNDYITKVKQLQEEAAAS

SEQ ID NO: 54685 - DNA, 645 bp, Zea mays
  misc_feature: Ceres CLONE 1482345
cataactggagctccccgcggtggcggccgctctagaactagtggatcccccgggctgcaggaattcgcacgagaccattacctagaacatcctaatcgaaaaagccgcgtctgattcgttcacgcaaccacgcgttcgtgggccgcctctctctcataaaatccaccgccctcgtcgccaaaatccccccaatcccaccgccagtctccccccgcgcctcagaagtcagaaccctagccccggcgacgccttcagatccggtgccctatcaggcggaatcgctcgctcctaccaccggttgccgcgttccggcatctcggctacccggcgtcctctacccgacttctacgccctcgatctcccccagccgtcgtcacgaggaatcgtttgctccacaggctacgtctccaccaagccagcgtcgacgactcgaaggatccgtgccgtcgtcgatcgccgatcgcctcttcgtagatcgaatctgttcagtgttttgctattcgttgtatttcatctgagatctgaaaaaagtattcgggccatctcgagatagagaggccttcataggcggagaaaaagaaacaggactcgccatccatcatgggtgttgtctattaccaatataagagtgaaaaggaaatctg

SEQ ID NO: 54686 - DNA, 663 bp, Zea mays
  misc_feature: Ceres CLONE 1482350
  misc_feature: Encodes the peptide sequence at SEQ ID NO. 54687
  misc_feature (585)..(585): n is a, c, t, g, unknown, or other
aagctggagctccccgcggtggcggccgctctagaactagtggatcccccgggctgcaggaattcgcacgagaccattacctagaacatctagaacatccgctctagaactagtggatcccccgggctgcaggaattcgcacgagaccattacctagaacatcctaatcgaaaaaccttatcacgacccgacctccaaccccgacgccagccagccaggcacgcacgcacgcacctacctgctgcggcggcccagagagatggacggcgggcggccggagatgcggcggaccatgacgctgtccgagcagctgtcgtccacgcccgacccggccatccgcgacttcctcaagatcccccaagacgccgacgtcggcgggatcctccacgacgaagatagcccctcggctgtggacgcgcaggggccccgcgccggcaggacgagcggctggaagccgctgcgggaccggctccggctccggcgcgcggcgggcgcctggcagacgccgcctaataagcccggcgctgccgcggcgcacgccccgaccaacagcggcaatctcagcaacaggtacaactacaaccncggcgaggcggcggcggcgttctcccgcaccttctcccgcgcgccctctctgcgcgcgccgtcactccgcgcgacgcc

SEQ ID NO: 54687 - protein, 134 aa, Zea mays
  misc_feature: Ceres CLONE 1482350
  misc_feature (109)..(109): Xaa is any aa, unknown, or other
MDGGRPEMRRTMTLSEQLSSTPDPAIRDFLKIPQDADVGGILHDEDSPSAVDAQGPRAGRTSGWKPLRDRLRLRRAAGAWQTPPNKPGAAAAHAPTNSGNLSNRYNYNXGEAAAAFSRTFSRAPSLRAPSLRAT

SEQ ID NO: 54688 - DNA, 665 bp, Zea mays
  misc_feature: Ceres CLONE 1482354
  misc_feature: Encodes the peptide sequence at SEQ ID NO. 54689
aaagctggagctccccgcggtggcggccgctctagaactagtggatcccccgggctgcaggaattcgcacgagaccattacctagaacatcctaatcgaaaacttccacggcgcggcggggctgctggggctcggccgcggcccgctctcgttcgcgtcgcagctgcgcggcgtctacggcggccacgccttctcctactgcctcgtggagcatggcagcgcggccgggagcaaggtcatcttcggccacgacgacgcgctgctcgcgcacccgcagctcaactacacggccttcgcgccggccacggacacggacaccttctactacctccagctcaagtccatcctcgtgggcggggaggcggtcaacatctcctccgacacccttgccgccggcggcaccatcatcgactccggcacgacgctgagctacttcccggagccggcgtaccgggcgatccggcaggcgttcatcgaccgcatgagcccgtcctacccgctcatcgccgggttcccggtgctgagcccgtgctacaacgtgtccggagccggaaagatcgaggtgccggagctgtcgctggtgttcgcggactgcgcggcgtgggaattcccggcggagaactacttcatccggctggagccggagggggtgatgtgcctggccg

SEQ ID NO: 54689 - protein, 61 aa, Zea mays
  misc_feature: Ceres CLONE 1482354
MSPSYPLIAGFPVLSPCYNVSGAGKIEVPELSLVFADCAAWEFPAENYFIRLEPEGVMCLA

SEQ ID NO: 54690 - DNA, 647 bp, Zea mays
  misc_feature: Ceres CLONE 1482355
  misc_feature: Encodes the peptide sequence at SEQ ID NO. 54691
  misc_feature (647)..(647): n is a, c, t, g, unknown, or other
aaactggagctccccgcggtggcggccgctctagaactagtggatcccccgggctgcaggaattcgcacgagaccattacctagaacatcctaatcgaaaaataggctcaataacctcgccagcggatcccttccttgcgaggccggaactgagctgccgccggcgctatggcgagcggcggcctggcggctgcgtcggaagtcgccgtcgttttcctcatccgccctgtccttgccatcgccttcgtcttcaccctcatcctcctcagctggtacgtggcgtggaggacggtgctggtgcacgtgccgctggtgcaggagatcgccggcctgcgcccgaaaaagccctctaaacccaagccagccaaccgcggccgcttcgccaagttctaccagaaccaggccgaagccgcactaaggaacagcaaatcagaaggggcatcatcttaagagaaatccgtcaccaccttgtaatgagtacctgccgcagactttattatgcagttctaattagaatgcaagtactaccagtgacggcgtctttttaggagagaatgtataccaacatgtgatgggagcatccctgcctgcctgacgatacatcaggcttatgataagaacgaatcacctgtttattgccggacctn

SEQ ID NO: 54691 - protein, 93 aa, Zea mays
  misc_feature: Ceres CLONE 1482355
MASGGLAAASEVAVVFLIRPVLAIAFVFTLILLSWYVAWRTVLVHVPLVQEIAGLRPKKPSKPKPANRGRFAKFYQNQAEAALRNSKSEGASS

SEQ ID NO: 54692 - DNA, 477 bp, Zea mays
  misc_feature: Ceres CLONE 1482357
  misc_feature: Encodes the peptide sequence at SEQ ID NO. 54693
  misc_feature (288)..(288): n is a, c, t, g, unknown, or other
  misc_feature (293)..(293): n is a, c, t, g, unknown, or other
  misc_feature (333)..(333): n is a, c, t, g, unknown, or other
aaagctggagctccccgcggtggcggccgctctagaactagtggatcccccgggctgcaggaattcgcacgagaccattacctagaacatcctaatcgaaaagtgcctgctggtactgctcctctctttcgacaagttcctcttccactacctgaagcgccgctggttctccggcggcagcggcgccaccgtcccaaggccccccgccaaatcgaggcggaacatggcggccgccaagtggagcgagacggccatgctcgttatcgacatgcagaaagacttcgtggnacccngcgatgcgcaccccgatgctggtggcccgtggcaaggccntcttccctgcccttatccggggccgtccccctttcccaagggaaagccgggatttttcccccccccggggttttcaaaaaaaaaattaacccctttttggaaaaaaaaaaattttaaaaattttttcccggaaggggcccccct

SEQ ID NO: 54693 - protein, 84 aa, Zea mays
  misc_feature: Ceres CLONE 1482357
  misc_feature (22)..(22): Xaa is any aa, unknown, or other
  misc_feature (24)..(24): Xaa is any aa, unknown, or other
  misc_feature (37)..(37): Xaa is any aa, unknown, or other
MAAAKWSETAMLVIDMQKDFVXPXDAHPDAGGPWQGXLPCPYPGPSPFPKGKPGFFPPPGFSKKKLTPFWKKKNFKNFFPEGAP

SEQ ID NO: 54694 - DNA, 666 bp, Zea mays
  misc_feature: Ceres CLONE 1482359
  misc_feature: Encodes the peptide sequence at SEQ ID NO. 54695
  misc_feature (393)..(393): n is a, c, t, g, unknown, or other
  misc_feature (395)..(395): n is a, c, t, g, unknown, or other
acagctggagctccccgcggtggcggccgctctagaactagtggatcccccgggctgcaggaattcgcacgagaccattacctagaacatcctaatcgaaaacggccggaagagcaccgcacatcgcgcggtgtccggtgcgcccccggcggcccttgaaaatccggaggaccgaattccgtccacgcccggtcgtactcataaccgcatcaggtctccaaggtgaacagcctctggccaatggaacaatgtaggcaagggaagtcggcaaaacggatccgtaacttcgggaaaaggattggctctgagggttgggctcgggggtcccggccccgaacccgtcggctgctggcggaatgctcgagctgctcgcgcggcgagagcgggccgccncntgccggccgggggaacgaccgggaacggccccctcgggggccttccccgggcgtcgaacaacccgatccgaactggtacggacaaggggaatcccactgtttaattaaaacaaacattgcgacggtcctcgaggatgctgacgcaatgtgatttctgcccagtgctctgaatgtcaaagtgaagaaattcaaccaaacccgggtaaaccggcgggagtaactatgactctcttaagggtaccaaaatgcctccctcctctaatttagggag

SEQ ID NO: 54695 - protein, 101 aa, Zea mays
  misc_feature: Ceres CLONE 1482359
  misc_feature (52)..(52): Xaa is any aa, unknown, or other
MEQCRQGKSAKRIRNFGKRIGSEGWARGSRPRTRRLLAECSSCSRGESGPPXAGRGNDRERPPRGPSPGVEQPDPNWYGQGESHCLIKTNIATVLEDADAM

SEQ ID NO: 54696 - DNA, 667 bp, Zea mays
  misc_feature: Ceres CLONE 1482372
  misc_feature: Encodes the peptide sequence at SEQ ID NO. 54697
atagctggagctcaccgcggtggcggccgctctagaactagtggatcccccgggctgcaggaattcgcacgagaccattacctagaacatcctaatcaaaaaaggacaggttgcatttgcatctgagttcctgatcgttgtattccagtttcttccgtgagttttgtgggatcgcgaggaagaaggatgtcgtgctgcggaggcaactgcgggtgcggcgccggctgcaagtgcggcagcggctgcggagggtgcaagatgtacccggacatggctgagcaggtgaccaccacccagactctcatcatgggtgttgcaccatccaagggcgggttcgtggcggccgccggagctgacaacggcgggtgcaagtgcggtgtcaactgcacctgcgacccctgcacctgcaagtgagacgaccccccccatgacgctgcagggcgtgatgaggtcctcggaaggactctttatctctagctaattaataacctctagtatataatattgtaacaggtgccgctttttgtgttttgcttcaatccgtcacacagtcacccccgccgtgccatgggcccatggcataccatggcctcgctccatccgcctccttcgccttgggtcctaggggggggtacccgatcggggggaaccaaataattggtacccc

SEQ ID NO: 54697 - protein, 75 aa, Zea mays
  misc_feature: Ceres CLONE 1482372
  misc_feature (1)..(74): Pfam Name: Metallothio_2 Pfam Description: Metallothionein
MSCCGGNCGCGAGCKCGSGCGGCKMYPDMAEQVTTTQTLIMGVAPSKGGFVAAAGADNGGCKCGVNCTCDPCTCK

SEQ ID NO: 54698 - DNA, 649 bp, Zea mays
  misc_feature: Ceres CLONE 1482373
  misc_feature: Encodes the peptide sequence at SEQ ID NO. 54699
gctccccgcggtggcggccgctctagaactagtggatcccccgggctgcaggaattcgcacgagaccattacctagaacatcctaatcgaaaaactcatccgcctcgtgaaaggcagagcacgcgcaaaagccaccaccgcgcgtcgtctccaagcaagcgaagagcgcctcccctccccctcgagatcttctctccctccccgcgccgctatggacgctgttgactcggtggtcgacccgctccgcgagttcgccaaggagagcatccacctcgtcaagcgctgccacaggcgcgaccgcagggaggtcaccaagggcgccacgcggactgcgatcggcttcatcaacatgggattcgacggctccaatggcagctcgtcttcatgggcgtcagaaggtaggaagggggccccccgccgatacctgggccaaaaaaggggacgagggggtctgcaccttgggggggcactactgggaatggggggaacagtggggttaggggggaggacgagtaccggggggggaacctaatagggggggggggggggggtatatgggaatgggcgtaatgaagggggggaggagaggggaaaaagaaagggggatacggagtgccagtctgaccctcggagaaagcagggcgccgcg

SEQ ID NO: 54699 - protein, 106 aa, Zea mays
  misc_feature: Ceres CLONE 1482373
MDAVDSVVDPLREFAKESIHLVKRCHRRDRREVTKGATRTAIGFINMGFDGSNGSSSSWASEGRKGAPRRYLGQKRGRGGLHLGGALLGMGGTVGLGGRTSTGGGT

SEQ ID NO: 54700 - DNA, 619 bp, Zea mays
  misc_feature: Ceres CLONE 1482376
  misc_feature: Encodes the peptide sequence at SEQ ID NO. 54701
  misc_feature (296)..(296): n is a, c, t, g, unknown, or other
  misc_feature (512)..(512): n is a, c, t, g, unknown, or other
cataactggagctccccgcggtggcggccgctctagaactagtggatcccccgggctgcaggaattcgcacgagaccattacctagaacatcctaatcgaaaactcgcctccaaggctccaacgcatcaatcaatagagcgagcgcgctgtggcatggagcacaaggatgggggcacagcttctgctggtggtctgcccgccggaagcagcttgtgctcgggctcgccgttgctcgacgcgccgatcctccgccgcctctacgccgggcaaatccttgccagatggggcgcgaggngtggtggtgatctcgagcggccatcctccgtcggtgcggacggggatcaactcggtggtccggcggatcgacctgggctgctcgttgctggcccccgtgctgtcggctctcgtcatcagcctcgcgtcgactcaagcctctgcggctgtgctggcgctgtccaccgccgcctcggcggggctgcagtactgcctcttcgtctccgtctacaagggngtgcccgccctcgccgcgccaagaaagcccaaagcttcggaacccaaacgccccgccccagttcccaataaccgtcccgcccggccgaggcccaaaccaaaccaggg

SEQ ID NO: 54701 - protein, 150 aa, Zea mays
  misc_feature: Ceres CLONE 1482376
MGAQLLLVVCPPEAACARARRCSTRRSSAASTPGKSLPDGARGVVVISSGHPPSVRTGINSVVRRIDLGCSLLAPVLSALVISLASTQASAAVLALSTAASAGLQYCLFVSVYKGVPALAAPRKPKASEPKRPAPVPNNRPARPRPKPNQ

SEQ ID NO: 54702 - DNA, 680 bp, Zea mays
  misc_feature: Ceres CLONE 1482385
  misc_feature: Encodes the peptide sequence at SEQ ID NO. 54703
  misc_feature (393)..(393): n is a, c, t, g, unknown, or other
  misc_feature (396)..(396): n is a, c, t, g, unknown, or other
  misc_feature (429)..(429): n is a, c, t, g, unknown, or other
  misc_feature (474)..(474): n is a, c, t, g, unknown, or other
ctggagctccccgcggtggcggccgctctagaactagtggatcccccgggctgcaggaattcgcacgagaccattacctagaacatcctaatcgaaaaaaaacccagggcagagtcgcagggtgacggggagagcccatcatggcgccgcagcagccgtgaagcacaagagcttttctgcagcacgacggctttgtcctctctcctttaaagcggactgctctcctcaattgtcagtcagtagcatccaattgattgttctatcctcttctctgttctcacccccttgcaagcaacaatcgttcaccgatcgatccagtgcgtcctgcatggaaactgccgccgtcgccgcccgcggtgccgggcgccgcatcatggtggccgtggacaaggncgnagagagcctgcacgcgctcaactggtgcctcgncaacgtcgtctccccggcagggagcgaacgctgggtgctcgtcangcccggcggccgggcccggttaagccgccatgaaaagcgcaggttacatgatgacttcgaagtgcttgcaaactttaaaaggccccccaaccgggtctcgggggggggggtcaaagggcaaaaggggtttggcgggacccccccctatttaagggggaaaacaaaggtgggaaacggggaacccggggaatcttctttgaaaaccc

SEQ ID NO: 54703 - protein, 102 aa, Zea mays
  misc_feature: Ceres CLONE 1482385
  misc_feature (7)..(7): Xaa is any aa, unknown, or other
  misc_feature (8)..(8): Xaa is any aa, unknown, or other
  misc_feature (19)..(19): Xaa is any aa, unknown, or other
  misc_feature (34)..(34): Xaa is any aa, unknown, or other
MVAVDKXXESLHALNWCLXNVVSPAGSERWVLVXPGGRARLSRHEKRRLHDDFEVLANFKRPPNRVSGGGVKGQKGFGGTPPYLRGKTKVGNGEPGESSLKT

SEQ ID NO: 54704 - DNA, 643 bp, Zea mays
  misc_feature: Ceres CLONE 1482394
  misc_feature: Encodes the peptide sequence at SEQ ID NO. 54705
ctggagctccccgcggtggcggccgctctagaactagtggatcccccgggctgcaggaattcgcacgagaccattacctagaacatcctaatcgaaaaagggtttggactttggattggagccgcaccgccgcaccgccgccgcagtgccgcacagccgccactcccgtcttggtcttgcggccagtcgccctcgggcctcgaccatcagcccctcgcccgctcgccgagacaccgagtcggcatcgaccgtcgtcgcgtctccgaggtccagcgcctagtggcccagctccaagcctccagccatcggcgcccgccctcctccgacgagacgccgagtgccgagcgcccgagcaccccggtccccagcgcccaacaagctagcaggctgcaggtatgcgctctttgttgatgcgtccaaggagttgagctgaatgcccagaaggctagcaggctgcagaaactgaaggaaaaggcggcattcaggaacccggatgagttctattttaaaatgatcaacagtagggctgttggtggaattcatagacctaagcctgaagataataagtatactgaagaggaacttcatctgttgaaaaataaagatatgggatatatcctttagagcgttcaaagtgaaaaag

SEQ ID NO: 54705 - protein, 37 aa, Zea mays
  misc_feature: Ceres CLONE 1482394
MINSRAVGGIHRPKPEDNKYTEEELHLLKNKDMGYIL

SEQ ID NO: 54706 - DNA, 664 bp, Zea mays
  misc_feature: Ceres CLONE 1482401
  misc_feature: Encodes the peptide sequence at SEQ ID NO. 54707
  misc_feature (409)..(409): n is a, c, t, g, unknown, or other
ctggagctccccgcggtggcggccgctctagaactagtggatcccccgggctgcaggaattcgcacgagaccattacctagaacatcctaatcgaaaattttcggcttctgaatttcggcaaacgttccggagctctgctggcgttgggattattttgcctaccaaacttttccgggtggaggtgaactattgtcgcatcctaaagcaagctgagcatgacagcgcgaagactggaatccagttcagcttttcctcgcccatgtaggaacttgccatggcagccgaagtagctgcactttcctctgtagacttgcattcttcccgttcttttcatgctgaagcaattgaagaagtttacgtgctccctttttctgtgacgctttgtcattgacaccgagagctgctccntttttttggtgtcttcaggagatgaatttattatttgctggttttgacctcacgagggatttgtcctcgcaccactcaaataccgatgctgtggctacccaaggttggaagaaataaaattttggccctaaatgttggaatattcaaacccattcagcttttctgggcaaaaaaaaaaaaaaaaaatttttccatccccccaccccccagggggggccccggaacccaaattccccctaaaggggggccttttac

SEQ ID NO: 54707 - protein, 87 aa, Zea mays
  misc_feature: Ceres CLONE 1482401
GAPRGGGRSRTSGSPGLQEFARDHYLEHPNRKFSASEFRQTFRSSAGVGIILPTKLFRVEVNYCRILKQAEHDSAKTGIQFSFSSPM

SEQ ID NO: 54708 - DNA, 631 bp, Zea mays
  misc_feature: Ceres CLONE 1482403
  misc_feature: Encodes the peptide sequence at SEQ ID NO. 54709
aaagctggagctccccgcggtggcggccgctctagaactagtggatcccccgggctgcaggaattcgcacgagaccattacctagaacatcctaatcgaaaaaccaaccaatctcctcgtctcccactcggctacccacatcccccggagctccacaaaaatctccgctcccaggctcccacccgcgcggagggggcaagcagccagcagccgcgcggcgccactgccttgccctcaacccctcacccaaacgcctcgctttggccgccccccacaaggccactcacccaaaaaatctccactcctcgaccgcaccgagcagaggatcacatggcatccgccgtttcgcttctcctctcgcccccgcgcctgctccaccgcgacggcacatcccgcctcctcagcatcccgcaccggcgggtcctcctcgccgcccccaacaacgcgacccctcgtcggctcctggcccccgcgccgcgcgcctccaacaaaaacgacaacagcggggtccgtggaggcgcccgaccgcctcgtggccgcggtcgcctacctatacccgttcctcgacggcgcgcaccacgggcgcttccttctcacgcagttccccttcttcggcgcgctgctccgcccg

SEQ ID NO: 54709 - protein, 100 aa, Zea mays
  misc_feature: Ceres CLONE 1482403
MASAVSLLLSPPRLLHRDGTSRLLSIPHRRVLLAAPNNATPRRLLAPAPRASNKNDNSGVRGGARPPRGRGRLPIPVPRRRAPRALPSHAVPLLRRAAPP

SEQ ID NO: 54710 - DNA, 656 bp, Zea mays
  misc_feature: Ceres CLONE 1482409
  misc_feature: Encodes the peptide sequence at SEQ ID NO. 54711
aaagctggagctcaccgcggtggcggccgctctagaactagtggatcccccgggctgcaggaattcgcacgagaccattacctagaacatcctaatcgaaaaaaaaaaacagcagcagcagccggcggcggccatagcccaggagcccggagctgtttcttcgtcgcaggaatgggcaaggacggcatccagtacgcagtggtggacgccttcacggcggagccgttcaagggcaaccccgccgcggtgtgcctcctcgaggacgccgcctaggccgccgacgagcggtggatgcagtccgtcgccgccaagttcaacatctccgagaccgccttcctcctccgggaaaagtcctccgcggccggcgccgtcccgctgttccagctccgatggttcacccccgtcgctgaggggcacctctgcggccacaccacgctggcttccgcacacttcctcttcacatccgtcctacgcggagaactagaagctcgtcaaggtctcgaccaagtcctgggattcttaacggccaaaaaaggggcccgcgcccgcaaaaccacgcggcgctgcccacgccgaaggggaaacctgaataaatgaagcccgtgatttcccccaccgaatgtaagcgtggctggaattggccaatcccatcccaa

SEQ ID NO: 54711 - protein, 33 aa, Zea mays
  misc_feature: Ceres CLONE 1482409
MGKDGIQYAVVDAFTAEPFKGNPAAVCLLEDAA

SEQ ID NO: 54712 - DNA, 710 bp, Zea mays
  misc_feature: Ceres CLONE 1482411
  misc_feature: Encodes the peptide sequence at SEQ ID NO. 54713
  misc_feature (415)..(415): n is a, c, t, g, unknown, or other
  misc_feature (416)..(416): n is a, c, t, g, unknown, or other
ctggagctccccgcggtggcggccgctctagaactagtggatcccccgggctgcaggaattcgcacgagaccattacctagaacatcctaatcgaaaatgaaacattttaaaggtcggaccaatgaaaagagtaaggatgtcaccacacttgactggaatggtgaaggtacactgctggctacaggctcctatgatggacaggcaagaatatggagtagagatggagacctgaagcagacattgttcaaacacaagggacccatattttcattgaaatggaataagaaaggagattttctcctaagtggaagtgttgataaaactgctattgtttgggatacaaagacatgggaatgcaaacagcagtttgaaattcattcagctccaacactagatgttgattggagaaataanntactctttttgcacatgtcaacccgatacatgatctatgtttgcaagattggggaacagcgtccggtttaaagcattcagtggccatccgagtggagtttatgctatcaagtgggaatcggaccgggctcccttttggcctccatggttcgaatggatggaaccgcaaaaaatttgggtttgtaaccaaacaaaagtgtttttttgttttcgggggccttccccggggaaatttccccttttttcgggggaaccccaaagggccccggaaaaaaaaaaattttaatatcccgtt

SEQ ID NO: 54713 - protein, 129 aa, Zea mays
  misc_feature: Ceres CLONE 1482411
  misc_feature (43)..(81): Pfam Name: WD40 Pfam Description: WD domain, G-beta repeat
  misc_feature (2)..(40): Pfam Name: WD40 Pfam Description: WD domain, G-beta repeat
  misc_feature: SWISSPROT Homolog: EC 2.7.11.7 [Myosin heavy-chain] kinase
  misc_feature (106)..(106): Xaa is any aa, unknown, or other
  misc_feature (107)..(107): Xaa is any aa, unknown, or other
MKHFKGRTNEKSKDVTTLDWNGEGTLLATGSYDGQARIWSRDGDLKQTLFKHKGPIFSLKWNKKGDFLLSGSVDKTAIVWDTKTWECKQQFEIHSAPTLDVDWRNXXLFLHMSTRYMIYVCKIGEQRPV

SEQ ID NO: 54714 - DNA, 714 bp, Zea mays
  misc_feature: Ceres CLONE 1482420
  misc_feature: Pfam Name: Yippee Pfam Description: Yippee putative zinc-binding protein
ggagctccccgcggtggcggccgctctagaactagtggatcccccgggctgcaggaattcgcacgagaccattacctagaacatcctaatcgaaaaagagggactgggttggagtggagttcgggaggtgtgagagaaggcggcgatggggcggctgttcctgatgcacctggacggcaacgtctacagctgcaagcactgcaggacccagctcggcgttgccagcgacatcatctccaaggtcttccactgcaggcacgggaaggcgtacctcttccataaggttgccaatgtgccttctggagtaaaagaacatcgcatgatgatgacaggaatgcatactggttctgatatcttcctggttggctgtggatccatccgtggatggaaatatcaccctcctcctgaaaagagcccgaaatccccgggagggaacgttccttctgggaaaggtacccgggttccgggccccttaccgaaacgccaaccctcgccttcccaaaaatcccccccctccggtggaaacccccccccccaaaccccaccaaccctcccgttcacccccttcaaacgccccctgccctcctcgcctccccccgataataaacccccgcgcccccttttcccccttaaacccccatccccctccgccccccctccaaaaaaccccccccccccccacaatataggcgggtccccccgacaaaaaccacc

SEQ ID NO: 54715 - DNA, 669 bp, Zea mays
  misc_feature: Ceres CLONE 1482435
  misc_feature: Encodes the peptide sequence at SEQ ID NO. 54716
aaagctggagctccccgcggtggcggccgctctagaactagtggatcccccgggctgcaggaattcgcacgagaccattacctagaacatcctaatcgaaaaatccgcatctccatctcccggaagaactctcaacagcgccgtaacaaatcgggcggatttggcgcagggtaccgggtgtgcgggaattattgcgaatcggtctccggccttgatcgggtataaaacctcgacacagagtcccagcttctccatgccatgccatggtccgccatttactttgagagtgggagaacagccattgttgagggttggtcctcttcgccattggcccgagaaaattggtctaggaagatcagcatcgaatgtaggacgtcttcgggggctcatccatgtgagaaatcatgtgggcgactggcaattcattgccggattccgactcttgcggccaaatcgccgcgcgacgagaacaagcctcctcgggatctaatcaccgcgcgaggtttcgaggatctcaagagatcttctgctaactggaatcttgagtgccacgagaagaacatatggctcaagtggagccacacatcgagcatttcgattcaatctaggtggcgtctcatagttaacgtgcgcctaggatgatccatacgtcgtattctaattaccatt

SEQ ID NO: 54716 - protein, 74 aa, Zea mays
  misc_feature: Ceres CLONE 1482435
KAGAPRGGGRSRTSGSPGLQEFARDHYLEHPNRKIRISISRKNSQQRRNKSGGFGAGYRVCGNYCESVSGLDRV

SEQ ID NO: 54717 - DNA, 1011 bp, Zea mays
  misc_feature: Ceres CLONE 1482438
  misc_feature: Encodes the peptide sequence at SEQ ID NO. 54718
atacgctcatcggttcctcggcgctcgcctcgacctccgactcgaagcggccctcctccctcgccggacgacggcgacggccgtggccgtctaacacatccgtggggaaccgctcccttagttgggcctcctccggccatggtgcacagcgcgtacgatgctgtcgagctggtggctgacgtgccgggccacatcgaggccgtcgcctcccacgctgggaagctcctcgtcgcggtttccgacaccgtaggcttcctctggggctccgactgctccttgcgcatctactccgctccttccccctccgacggcggcggcgagatccggtgggacgggccctacgcgctcgagcggcaggagccgcggttctggcggcgcccgcccttagccatggaggtcagcgccagccgcgacctcctgatctcgctctccgagtggatcgcgctccaccgcctccccgggctcgagaccgtcgctgtcgtctctagcaagacaaagggggccaacgtctttgcttgggacgagcggcggggcttccttgccgtcggtcgacagaagcgactcaccgtcttccgcctcgacagtgggcgagaatttgttgaagtgaaggaatttggagtgccagatattctgaaatcaatggcctggtgtggtgataacatatgtcttggaatcaggcgggaatatatgataataaatagcatgaccggggcactaacagaagtgttttcttctgggaggatcgctcctcctttagttgtgcctctccttactggggaactgatccttggcaaggtataatacttcaataattcaatgttcgtgatgctgtgtccaattcctgttccatttcataaatctgttagatgggtgatcctttttggttcaagggttcaagtgacatcattctatgctttatgagaagattggcagatgttctaacaatgtacttattaccattttctaatttaaggacagtggaacattatcttgtgaaaaaaaaaaaaaaaa

SEQ ID NO: 54718 - protein, 220 aa, Zea mays
  misc_feature: Ceres CLONE 1482438
MVHSAYDAVELVADVPGHIEAVASHAGKLLVAVSDTVGFLWGSDCSLRIYSAPSPSDGGGEIRWDGPYALERQEPRFWRRPPLAMEVSASRDLLISLSEWIALHRLPGLETVAVVSSKTKGANVFAWDERRGFLAVGRQKRLTVFRLDSGREFVEVKEFGVPDILKSMAWCGDNICLGIRREYMIINSMTGALTEVFSSGRIAPPLVVPLLTGELILGKV

SEQ ID NO: 54719 - DNA, 715 bp, Zea mays
  misc_feature: Ceres CLONE 1482449
  misc_feature: Encodes the peptide sequence at SEQ ID NO. 54720
  misc_feature (363)..(363): n is a, c, t, g, unknown, or other
  misc_feature (368)..(368): n is a, c, t, g, unknown, or other
  misc_feature (378)..(378): n is a, c, t, g, unknown, or other
  misc_feature (694)..(694): n is a, c, t, g, unknown, or other
caaagctggagctccccgcggtggcggccgctctagaactagtggatcccccgggctgcaggaattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcacccatccaggggcacgccgagggcgggttcgagggcgccgccggagctgagaacngcggntgcaagtgcngcgggcactggcagtgcgacccctgcaactgcggaaagtgagctaggtgctccaccctgcaggccggcggaaggaacctttccttaatttttttttaggcttaaattaaaggttttacgggcccccccccctggggtgggttttcgagcccgcccacccgtttattttcgggcccaggggggggagtcccttaacttaaaaataaatataaaccccaaagggcggcccctttccccgaaaccctccccgccccccccgggggccttttggggggaaaaatttttttgtttttttttttttgggggggtcccacccnggacgggtctacatttttgcc

SEQ ID NO: 54720 - protein, 82 aa, Zea mays
  misc_feature: Ceres CLONE 1482449
  misc_feature (1)..(80): Pfam Name: Metallothio_2 Pfam Description: Metallothionein
  misc_feature (65)..(65): Xaa is any aa, unknown, or other
  misc_feature (70)..(70): Xaa is any aa, unknown, or other
MSCCGGNCGCGSGCKCGNGCGGCSKMYPDMAEQVTTTTQALIMGVAPIQGHAEGGFEGAAGAENXGCKCXGHWQCDPCNCGK

SEQ ID NO: 54721 - DNA, 666 bp, Zea mays
  misc_feature: Ceres CLONE 1482455
  misc_feature: Encodes the peptide sequence at SEQ ID NO. 54722
  misc_feature (614)..(614): n is a, c, t, g, unknown, or other
aagctggagctccccgcggtggcggccgctctagaactagtggatcccccgggctgcaggaattcgcacgagaccattacctagaacatcctaatcgaaaatcctttcccctcctctctttcatcgacgaccgctggccaccccctcgatctcttgacccggaggcgaggacgggggccagcagcggccgccagcgcctgcccgtcttgttatagggtgtcattgaagttctggtggaaagtggaagacctattgatgcaattaatttggcttatgtgtttgagcttactgaacaatttgaaccagtacaccttcttaaagcatatctaagggatgttaagaaaatgtcacacgccaggaatgtcaaaacttctcctggagcacagaatgagatgaatgaacgtgagttatctgcgctgaaatctgtcattaagtgcattgaagagcacaaacttgagcagcagtaccctgtggatccacttcagaaaagggttttgcagctagagaaagcaaaggcagacaagaggatggctgttgaagcagcaaagccgcagtccaagaggcctcgtgccaatggatcggcctttgcaacccgtgctacaggctttgctgancagagcttctactcagcaaccccagagaggcatccattcaatccttgcgaga

SEQ ID NO: 54722 - protein, 107 aa, Zea mays
  misc_feature: Ceres CLONE 1482455
  misc_feature (90)..(90): Xaa is any aa, unknown, or other
MSHARNVKTSPGAQNEMNERELSALKSVIKCIEEHKLEQQYPVDPLQKRVLQLEKAKADKRMAVEAAKPQSKRPRANGSAFATRATGFAXQSFYSATPERHPFNPCE

SEQ ID NO: 54723 - DNA, 665 bp, Zea mays
  misc_feature: Ceres CLONE 1482458
  misc_feature: Translation starting site: 194
  misc_feature (612)..(612): n is a, c, t, g, unknown, or other
  misc_feature (665)..(665): n is a, c, t, g, unknown, or other
aagctggagctccccgcggtggcggccgctctagaactagtggatcccccgggctgcaggaattcgcacgagaccattacctagaacatcctaatcgaaaaaccgggcaccgccgccggtacaccgcgcatcgaatcgccaccagtgccgattctgctgacccctcgccatcgctggcgggcgaatcgacgccatggccgccgcgcgccggggccgcgccgacggtgccaacggcgtcgtccgtccccgcccccgcgaccgtgtcgtcggcgtcagcggaagcatggcgaggcgcgtggcggtcctcgctttctgtgtcgccgggatctggtccgcctacatctaccagggcgtcctccaggagactctatccacgaagcggttcaggccggaggcgcggcggttcgaggcttcgagcaccttgcgttcctcaacttcgcgcagaatgtcgtatgcttcgtctggtccttcctaatgattaagttgtggtcgagcgggagcgggagtagctccgacggccgtgcgccgctatcgaagtactggggcgtcagcgtaaccaataccatcgggccgaccatggggatcgaggcgctcaagtacattaactatccnggctcaggtgttggcaaaatcttctaagatgatccccgtaatgctgatgggan

SEQ ID NO: 54724 - DNA, 618 bp, Zea mays
  misc_feature: Ceres CLONE 1482465
  misc_feature: Encodes the peptide sequence at SEQ ID NO. 54725
  misc_feature (429)..(429): n is a, c, t, g, unknown, or other
  misc_feature (436)..(436): n is a, c, t, g, unknown, or other
  misc_feature (444)..(444): n is a, c, t, g, unknown, or other
  misc_feature (453)..(453): n is a, c, t, g, unknown, or other
  misc_feature (454)..(454): n is a, c, t, g, unknown, or other
  misc_feature (516)..(516): n is a, c, t, g, unknown, or other
aaagctggagctccccgcggtggcggccgctctagaactagtggatcccccgggctgcaggaattcgcacgagaccattacctagaacatcataatcgaaaaatagtgaaaatggtcggttcagttatggagttgcaagttctcccgggaaaagagcatcgatggaggacttctatgaggcaaggatagacgacgttgacggagagaaagttggaatgtttggtgtgtatgatggtcatggaggagtcagagcagctgagtacgttaagcagcatcttttcagcaatttaatcaaacacccaaagttcatcactgataccaaggccgctattgctgaaacttacaaccgcacagattcagaatttctgaaagctgatagcactcaaactcgagatgctggctcaactgcctcaacagctattattgtanggtgatncgtttgcnttgttgcannatgttggagattctagagctgttatttctaaagggagacagggcgattgcggttttcagggnatcacaaaacctgattccgacccgatgaaaagggcaaaaaattttagggatccccggggggggcctttttttttttttggggcgggaaaaaaaaaaaaaggg

SEQ ID NO: 54725 - protein, 89 aa, Zea mays
  misc_feature: Ceres CLONE 1482465
  misc_feature: SWISSPROT Homolog: EC 3.1.3.16 Phosphoprotein phosphatase
MEDFYEARIDDVDGEKVGMFGVYDGHGGVRAAEYVKQHLFSNLIKHPKFITDTKAAIAETYNRTDSEFLKADSTQTRDAGSTASTAIIV

SEQ ID NO: 54726 - DNA, 636 bp, Zea mays
  misc_feature: Ceres CLONE 1482473
  misc_feature: Encodes the peptide sequence at SEQ ID NO. 54727
  misc_feature (218)..(218): n is a, c, t, g, unknown, or other
  misc_feature (510)..(510): n is a, c, t, g, unknown, or other
aagctggagctccccgcggtggcggccgctctagaactagtggatcccccgggctgcaggaattcgcacgagaccattacctagaacatcctaatcgaaaagatcgaagcggagagcaagggagcggtcgagcgggtgacatcatcgtcatccagggtttctcaatcggcagcgatggcgaccagggcggcggcgaggttcctgcagcgcaggtttcntgtcttccggcggcaaggtcctcagcgaggaggagaaggccgccgagaacgtgtacatcaagaaagtggaacaagagaagctggagaagctcgcacgcaagggccccagctcaggagagcaacccctcgtcaaccacaggctctgcagcaagtgatgtgaaggccgatgctgggcaaacggagtcagcatctgcaagtgtgtcgacggacaagaacagaactatgctgttctggcggcgcagttgctgccctgggtgcttgggttgtatctattgttaaagcctaagagtcngaagagtttgtgactgaaaagggaggtgtaaatgccgaaggcggccttaatccccccatggtttactttctggccaaaacctgcactttgaaaaaaattgttaaatttccctcacaaaaaaaaaaa

SEQ ID NO: 54727 - protein, 164 aa, Zea mays
  misc_feature: Ceres CLONE 1482473
AGAPRGGGRSRTSGSPGLQEFARDHYLEHPNRKDRSGEQGSGRAGDIIVIQGFSIGSDGDQGGGEVPAAQVSCLPAARSSARRRRPPRTCTSRKWNKRSWRSSHARAPAQESNPSSTTGSAASDVKADAGQTESASASVSTDKNRTMLFWRRSCCPGCLGCIYC

SEQ ID NO: 54728 - DNA, 677 bp, Zea mays
  misc_feature: Ceres CLONE 1482479
  misc_feature: Encodes the peptide sequence at SEQ ID NO. 54729
aaagctggagctccccgcggtggcggccgctctagaactagtggatcccccgggctgcaggaattcgcacgagaccattacctagaacatcctaatcgaaaaacatcaattcatttcagtttcagcaggtcagttttcgtcctgatactctgtcgctgcagcggtgccggcggtgcagttgggttgcggccgcagagcagcaggaaggatggcgacgaccaaggtggtggtggacctgcggtccgacacggtcaccaagccttccgaggccatgcgcgcgtccatggccgcggctgacgtcgacgacgacgtccggggcgcggacccgaccgcgcgccgcttccaggaggagatggcggcgctcatgggcaaggaggccgcgctcttcgtcccgtcggggaccatgggcaacctcgtgtccgtcctcgcgcactgcgacgtccgcggcagcgaggtcatcctcggcgacgactcgcacatccacctctacgagaacggcggcatctccaccctcggcggcgtgcaccctaagaccgtcagaaacaactcagacggcaccatggacatcgacagcatcgtcgctgcaatcaggcctcccggcgggggcctgtattatccgaccaccaggctcatctgcttggagacacacatgggaattccggagggaagtgtttatc

SEQ ID NO: 54729 - protein, 156 aa, Zea mays
  misc_feature: Ceres CLONE 1482479
  misc_feature (9)..(156): Pfam Name: Beta_elim_lyase Pfam Description: Beta-eliminating lyase
  misc_feature: SWISSPROT Homolog: EC 4.1.2.5 Threonine aldolase
MATTKVVVDLRSDTVTKPSEAMRASMAAADVDDDVRGADPTARRFQEEMAALMGKEAALFVPSGTMGNLVSVLAHCDVRGSEVILGDDSHIHLYENGGISTLGGVHPKTVRNNSDGTMDIDSIVAAIRPPGGGLYYPTTRLICLETHMGIPEGSVY

SEQ ID NO: 54730 - DNA, 664 bp, Zea mays
  misc_feature: Ceres CLONE 1482481
aaagctggagctccccgcggtggcggccgctctagaactagtggatcccccgggctgcaggaattcgcacgagaccattacctagaacatcctaatcgaaaaatctatttcaatcatccggatcgtatacctgtctaacccgatcttctgtttgggtgttggcttgccagtggcggtgtgctttggtgacgctgacgacgagcactctctccgaacggcaactgcaggggcggcctctgtaacgtggtcatcctgttcctcgaagcgcatggctttgtccgaactccgtggggccgtagacctgcttgattgcctgcacgagcacgtccggctcgcagggtaagcaggccaccggccgcttgaccaataacgccacgacctgtggatccccgctctgccgtgacctgcatcctcttcctctggtcgggcgctcgccatttagtcttcctcctgtcctccaactgatcgccctactactgtacactgctcgcttgcctggtgctgcgctgctccaatgctcgtgccctactgtactgcagctcgcgcgccaccgcacctggctgacatctgcttgagctgcggtgctcggcttcctgttcctaatgcggccaatatgtaggcactgattgttaaggcaaagcgtggctccatgtatattacgctg

SEQ ID NO: 54731 - DNA, 719 bp, Zea mays
  misc_feature: Ceres CLONE 1482540
tggcggccgctctagaactagtggatcccccgggctgcaggaattcgcacgagaccattacctagaacatcctaatcgaaaaaccgagcttatctcctcccgtctaggcgacgacgacgacgaagcagcgggaggagcataagcgccgccgatcccgagcatacgagcgagttctccactcatcctccgcctcgtgccacagatcctaacgaacgccgcccgcccgccatggcccgctcccccccccagacgccaccctcccttttgttcctcccccccgcgggccgtgtgtggccctttttcttctgcggcatccgcgggcacgggcaccccctgcccccccttatttttttcccccccccccccggggggaacgaaggggggggttttcctccttaatataattcaccattggcccccccctattttagcctcttattccccttccacattcttttagacggcggcctcccactttaacccctcgctcgtattctctttgaacatccgctcctcccataccttattctcccctcctgtttctcgtcccagaactccgcccaccaacgccccttccttccacgcgtatgtccctcttacttcccgctacatccctttcctcttttaacccactccctttcataacaatttggcgtgagaaccgtccccctcccttcttgaagctcagaagattatcctttcggacgccgcccctccgc

SEQ ID NO: 54732 - DNA, 637 bp, Zea mays
  misc_feature: Ceres CLONE 1482552
  misc_feature: Encodes the peptide sequence at SEQ ID NO. 54733
tggagctccccgcggtggcggccgctctagaactagtggatcccccgggctgcaggaattcgcacgagaccattacctagaacatcctaatcgaaaagtcttggggcatgtgtgctaccacagtcatagactggcggtttgaacggttacatggccgcagagacaaatgttaagagtcacagtgaaccatgggcgatgtgatgcgcctcctattccggctctaatgactgtgcacagatggtcacgtggaccttcagccacccagatcggaaagcctgctgttctcatggctagcgttcacttgaaacgaaaagcatacaatgtattgaggcagacttcttccaggtttttgttgaaagatgtctacagaaacccacgtccgctccagatggaaggaccaagtaccgattcaaaggctatctcactgtgcgtcgagaatcaagactgcttgaacatgataaagaaattgcaagaatacctggagaaggtgaacagaattgtgaagcctgtgtgctctcatgatgtacttaaagcagcgctgagcgccatgtcttctgtgacggagacactgaacatcatgacctcatcggccaccggccagacagcactgaaactcgtttggcgccgtatagaagga

SEQ ID NO: 54733 - protein, 157 aa, Zea mays
  misc_feature: Ceres CLONE 1482552
  misc_feature: SWISSPROT Homolog: EC 2.7.1.90 Diphosphate--fructose-6-phosphate 1-phosphotransferase
MLRVTVNHGRCDAPPIPALMTVHRWSRGPSATQIGKPAVLMASVHLKRKAYNVLRQTSSRFLLKDVYRNPRPLQMEGPSTDSKAISLCVENQDCLNMIKKLQEYLEKVNRIVKPVCSHDVLKAALSAMSSVTETLNIMTSSATGQTALKLVWRRIEG

SEQ ID NO: 54734 - DNA, 740 bp, Zea mays
  misc_feature: Ceres CLONE 1482562
  misc_feature: Encodes the peptide sequence at SEQ ID NO. 54735
  misc_feature (558)..(558): n is a, c, t, g, unknown, or other
  misc_feature (560)..(560): n is a, c, t, g, unknown, or other
  misc_feature (561)..(561): n is a, c, t, g, unknown, or other
  misc_feature (563)..(563): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (569)..(569): n is a, c, t, g, unknown, or other
  misc_feature (570)..(570): n is a, c, t, g, unknown, or other
  misc_feature (572)..(572): n is a, c, t, g, unknown, or other
  misc_feature (573)..(573): n is a, c, t, g, unknown, or other
  misc_feature (575)..(575): n is a, c, t, g, unknown, or other
  misc_feature (576)..(576): n is a, c, t, g, unknown, or other
  misc_feature (578)..(578): n is a, c, t, g, unknown, or other
  misc_feature (579)..(579): n is a, c, t, g, unknown, or other
  misc_feature (602)..(602): n is a, c, t, g, unknown, or other
aaactggagctccccgcggtggcggccgctctagaactagtggatcccccgggctgcaggaattcgcacgagaccattacctagaacatcctaatcgaaaaaaccggccgcctcagcttctgctccttttcctttcccagcgcatcagggaggcggcgattcgcggcggtgagggcgtccgcggagacgatggcgacggagaagctgggcatcaaggtggagcgcaacccggcccgagtcccgtctctccgagctcggcgtccgccagtgggccaagggggggtgccaaaaaaacaagttcccgggggacctctcccccaaggaaccggccccccttccccggggaaagggaaagggttcccctcaccccccccgggggggggggggggggattcccccaaaaaatcttttttcttccccgagggggaaggtcccccggggggccccgcggggggcccaaaaaaaaacctttttggggggccccccccccaaaaaagcgggggggggagagaaaaaaaacgggcgggcgttgtcccacgaaacagatacccggccccncnnanannnanngnngnnannccccccggggggggaggcgcccnccctgtttttccccccgcccccccggcgttggggggagaaaaaaaaccccatcagcgcggggattgtgcccaaaagcgcgggagcggcgtaacacccacgaaatacaattcttttccgtcccccggctgtccggcgta

SEQ ID NO: 54735 - protein, 183 aa, Zea mays
  misc_feature: Ceres CLONE 1482562
  misc_feature (124)..(124): Xaa is any aa, unknown, or other
  misc_feature (125)..(125): Xaa is any aa, unknown, or other
  misc_feature (126)..(126): Xaa is any aa, unknown, or other
  misc_feature (127)..(127): Xaa is any aa, unknown, or other
  misc_feature (128)..(128): Xaa is any aa, unknown, or other
  misc_feature (129)..(129): Xaa is any aa, unknown, or other
  misc_feature (130)..(130): Xaa is any aa, unknown, or other
  misc_feature (138)..(138): Xaa is any aa, unknown, or other
MATEKLGIKVERNPARVPSLRARRPPVGQGGVPKKQVPGGPLPQGTGPPSPGKGKGFPSPPPGGGGGDSPKKSFFFPEGEGPPGGPAGGPKKNLFGGPPPQKSGGGREKKRAGVVPRNRYPAPXXXXXXXPPGGGGAXPVFPPAPPALGGEKKPHQRGDCAQKRGSGVTPTKYNSFPSPGCPA

SEQ ID NO: 54736 - DNA, 714 bp, Zea mays
  misc_feature: Ceres CLONE 1482578
  misc_feature: Encodes the peptide sequence at SEQ ID NO. 54737
gcggtggcggccgctctagaactagtggatcccccgggctgcaggaattcgcacgagaccattacctagaacatcctaatcgaaaactgtgttaacgccgctcgcgcatcctattgctctcgcgcacaccgtcaccgacgctagcgtaaggcaccttgcctgccgtcccctgaggtagacaccaagccaccgccatgtggcgtatgcacagccgcgagaaaggtatctcttcatcggcgctgccgtacaagaggattcctccgatctggctcaagacagctaccaccgaggtggaggagatgattaccaacgctgagaagaagggccacatgcccttctacattggtgttctgctccgtgaccagaacagtatcgcgcttgtcaagagcgtgactggtatcaagattctccgccatcctccaggagcatggggtgctccctgatatccctgacgatctctacttccacataaagaatgagtcggtgattaagaatgcatttgtcatatgaatctggactgacaatgaactccaaatttccgacttctttcttggaatgagcagcagggaatccatcggccctttgccccggctacctttcaagccgatttcttgaggaaagcttctccacccccgcccttggggaagttatccgatatttcaagaccttacttggcccgaagattacctttcttggagaaggggccccttataa

SEQ ID NO: 54737 - protein, 82 aa, Zea mays
  misc_feature: Ceres CLONE 1482578
  misc_feature (1)..(60): Pfam Name: Ribosomal_S13_N Pfam Description: Ribosomal S13/S15 N-terminal domain
MWRMHSREKGISSSALPYKRIPPIWLKTATTEVEEMITNAEKKGHMPFYIGVLLRDQNSIALVKSVTGIKILRHPPGAWGAP

SEQ ID NO: 54738 - DNA, 655 bp, Zea mays
  misc_feature: Ceres CLONE 1482589
  misc_feature: Encodes the peptide sequence at SEQ ID NO. 54739
gaaagctggagctccccgcggtggcggccgctctagaactagtggatcccccgggctgcaggaattcgcacgagaccattacctagaacatcctaatcgaaaaattttttggctcctcactgccgcgccgccaccccctacaggtggatgtaacgaatccgccgccggcgtcatctcctcctcccacctcgactcgccttgctcgccggcggcggccttttcttcgccgcgcggcgagtcgcccatgttgagctcgcggctgatctgatgggcttgttgtgatctcctgcaggtaaggaagaggagggcaggatgtcgcaccgtaagttcgagcacccgaggcacggctccctcggcttccttcccaggaagcgctcctcccgtcaccgcggcaaggtgaagtcattccctagggatgaccccaagaagccttgccatctcactgccttccttggctacaaggctggcatgactcacattgtccgtgaggttgagaagccaggatccaaactccataagaaggaaacttgtgaggctgttaccatcattgaaacccctcctcttgtcattgttgggctcgtggcatatgtgaagactcctcgtggcctccgcacactcaactctgtttgggcccaacatcttagtgaagaagtga

SEQ ID NO: 54739 - protein, 114 aa, Zea mays
  misc_feature: Ceres CLONE 1482589
MSHRKFEHPRHGSLGFLPRKRSSRHRGKVKSFPRDDPKKPCHLTAFLGYKAGMTHIVREVEKPGSKLHKKETCEAVTIIETPPLVIVGLVAYVKTPRGLRTLNSVWAQHLSEEV

SEQ ID NO: 54740 - DNA, 658 bp, Zea mays
  misc_feature: Ceres CLONE 1482609
  misc_feature: Encodes the peptide sequence at SEQ ID NO. 54741
ctccccgcggtggcggccgctctagaactagtggatcccccgggctgcaggaattcgcacgagaccattacctagaacatcctaatcgaaaaaagaaaaaaaaaacacgcacccgcgtccgcgtgctctctgccccctgcccccctcccatctgcgccgccctcctcatccaccgcccgtcccgccgccgccagcccaaggccaggcatccgccagcctctcgcaccacgcgtatcgcgtgcccgcccgaccggctcgtggcgatggcgtaccgggcggacgacgactacgactacctattcaaggtggtgctcatcggggactccggcgtcggcaagtccaacctgctctcgcgcttcacgcgcaacgagttcagcctcgagtccaagtccaccatcggcgtcgagttcgccacccgcagcatccacgtcgacgacaaggtcgtcaaggcccagatctgggacaccgccggtcaggaaaggtaccgtgctatcacgagcgcgtactaccgcggagcagtaggggcgctcgtcgtctacgacgtcacgcggcacgtcaccttcgagaacgtgaagaggtggatgagggagctcagggaccacacggacgccaacatcgtgatcatgctgggtgggaacaagcggacctgcgccacctc

SEQ ID NO: 54741 - protein, 131 aa, Zea mays
  misc_feature: Ceres CLONE 1482609
  misc_feature (14)..(131): Pfam Name: Ras Pfam Description: Ras family
  misc_feature: SWISSPROT Homolog: EC 2.7.11.1 Non-specific serine/threonine protein kinase
MAYRADDDYDYLFKVVLIGDSGVGKSNLLSRFTRNEFSLESKSTIGVEFATRSIHVDDKVVKAQIWDTAGQERYRAITSAYYRGAVGALVVYDVTRHVTFENVKRWMRELRDHTDANIVIMLGGNKRTCAT

SEQ ID NO: 54742 - DNA, 646 bp, Zea mays
  misc_feature: Ceres CLONE 1482612
  misc_feature: Encodes the peptide sequence at SEQ ID NO. 54743
tccccgcggtggcggccgctctagaactagtggatcccccgggctgcaggaattcgcacgagaccattacctagaacatcctaatcgaaaaagcgcagcgaaccaactattcgtttgcttttcgtcttcgtcctctctttgcccagttgtcggtcgcccgcgccgtcgtctccgctccgccggccttcctgcgaaaccctagcgaggcgagcgagagagaaactagcggccatgttcggctacaggaaggctgacccggacctcgaggccggcgggtcctcgctgctgtacccgggaaatgacggagagccccgagctgcggtgggcgttcgtccgcaagatctacgtcatcctagccgtccagctcgccatgacggccgcggtctccgccttcgtcgtcaaggtgcccgccgtctccactttctcgtctcctcaacgccgggctcgcactctacatcttcctcatcatcctgcctttcctcgtgctgtgccctctgcgctactaccaacagaaagcatccggggcaatcttgctggctgtttcggccttttttcccgtccctaattaattttgccctccgggattgaaatggcccttttccctagggaaaaattttttttgggaggcgtcgcctttctttcccac

SEQ ID NO: 54743 - protein, 88 aa, Zea mays
  misc_feature: Ceres CLONE 1482612
MTESPELRWAFVRKIYVILAVQLAMTAAVSAFVVKVPAVSTFSSPQRRARTLHLPHHPAFPRAVPSALLPTESIRGNLAGCFGLFSRP

SEQ ID NO: 54744 - DNA, 695 bp, Zea mays
  misc_feature: Ceres CLONE 1482617
  misc_feature: Encodes the peptide sequence at SEQ ID NO. 54745
aagctggagctccccgcggtggcggccgctctagaactagtggatcccccgggctgcaggaattcgcacgagaccattacctagaacatcctaatcgaaaacttttgcataccctgctccaactccgattcgacattccgacatcgacacggcgcagccgccgccgccggctggcgtgtctccggcatagtctcgggggccggtggtctgctactccttgcctacagaccagcattcgtggtgaaccctccaccaacaagggcagctagagtcacccgattcctcaaaccctaccaattgatgatgcatttcaccaaatactatgtactctgctcaggatgtccacaccccaacagcaactgttgcatgtactgcgagctcaaaggagaagctgatgacacctaatatggaatcgacccgtgactgccaccacctgcgaagattggaaagttgctcggtgagcgcctgctcctcaagggaatacctggactgatcctcgccttgaagaggagaacaaaaaaaccatggttaaagtgaaagccgctaatgcattcatccagaacaaactaggattccaagctgctgaccgatcgccaagtggtgaaaaacattggaactttaacctttttttcccactgcctggaccttggaattccctacaattggtttaaccaaatgtcaaaattggtttcggg

SEQ ID NO: 54745 - protein, 56 aa, Zea mays
  misc_feature: Ceres CLONE 1482617
MYSAQDVHTPTATVACTASSKEKLMTPNMESTRDCHHLRRLESCSVSACSSREYLD

SEQ ID NO: 54746 - DNA, 663 bp, Zea mays
  misc_feature: Ceres CLONE 1482618
  misc_feature: Encodes the peptide sequence at SEQ ID NO. 54747
aagctggagctccccgcggtggcggccgctctagaactagtggatcccccgggctgcaggaattcgcacgagaccattacctagaacatcctaatcgaaaaaattccaccctcgttctcaggcactgtcacacagacacagctgacctgccactgccaggaaagtaggtcgaggatgccccgcagcggcttctcggggtccttcaggtcgcccaagatcgacgtcgtcatcgacatgggaaaccccttcctcaaccgcaccgtcgacggcttcctcaagatcggcgccgtcggcgcctgcaaggtggctgccgaggagaccttcgagtgcctccacaggggggatgtttcgaagcacaaggttgagcatgccctgaggaagatgtgcaaggagggcgcatattggggcactgttgctggagtttatgtgggcatggtgtacggcgtggaaagggtccgtggccgcagtgactggaagaacgcgatgatcgggggcgccttgtccggcgccctgatctccggcgccagcaacagcgacagaagcaaagtcgtcaaggaaccccatcaccgccggcgcgggccgccacagcccgtcgagttcatcaactgcattacctagccagacaagggagcaactgccatttgcagtggccattgtcgtgcc

SEQ ID NO: 54747 - protein, 147 aa, Zea mays
  misc_feature: Ceres CLONE 1482618
  misc_feature (18)..(124): Pfam Name: Tim17 Pfam Description: Tim17/Tim22/Tim23 family
MPRSGFSGSFRSPKIDVVIDMGNPFLNRTVDGFLKIGAVGACKVAAEETFECLHRGDVSKHKVEHALRKMCKEGAYWGTVAGVYVGMVYGVERVRGRSDWKNAMIGGALSGALISGASNSDRSKVVKEPHHRRRGPPQPVEFINCIT

SEQ ID NO: 54748 - DNA, 662 bp, Zea mays
  misc_feature: Ceres CLONE 1482650
  misc_feature: Encodes the peptide sequence at SEQ ID NO. 54749
  misc_feature (389)..(389): n is a, c, t, g, unknown, or other
aaagctggagctccccgcggtggcggccgctctagaactagtggatcccccgggctgcaggaattcgcacgagaccattacctagaacatcctaatcgaaaaatcacaagctgtcacaaactcagcacacaatcacactgacacacacaccaccaccacggcaccgctagtgagaagcggagcgggaggacacgcggcgcggactgcgatggctcgtgcgctcggcgcttgcgtgctgctcgccgtcctgctcggtgccctggcgccggcggcggccgcgcgcgcccacgacgaccagggcagcggggccggcatacggcagccgagcggcgagtaccgcgggaggaaggtgggggccaggacggaggtgcgggacgtggagggcgacngctaggtgcaggagctcggccggttctcccccacccactacaaccggcagctccgagaaggtggcggcggcggcggcaggctcgagttcggcagggtggtggcggcgcagcggcaggtggtgtcggggctcaagtactacctccgcgtcgtgcccatggaggagggcggcgcggggaacggcggctagcgcgtgttcgacgccgtcgtcgtcgtcaagccctggctcgactcgcgcaccctgctcacgttcgcggcggcggcccgcaagtaag

SEQ ID NO: 54749 - protein, 60 aa, Zea mays
  misc_feature: Ceres CLONE 1482650
MARALGACVLLAVLLGALAPAAAARAHDDQGSGAGIRQPSGEYRGRKVGARTEVRDVEGD

SEQ ID NO: 54750 - DNA, 679 bp, Zea mays
  misc_feature: Ceres CLONE 1482651
  misc_feature: Encodes the peptide sequence at SEQ ID NO. 54751
cctaagctggagctcaccgcggtggcggccgctctagtactagtggatcccccgggctgcaggaattcgcacgagaccattacctagaacatcctaatcgaaaactgtgaacccgaagtgccggcaccgccgctgttgcagaagttgcctcttttttacgtcttgtttctcctccaccccggcgacgcgaatggagaagggcagtggaggcagcaatcctccgccgccaccgctccacatggaggacttccaactggaggggaagaagcccgtcaagaacccctttgtgcccatcggcgcactggttactgctggagttctgactgctggtctgatcagtttccgatatgggaactctcagctgggtcagaaactgatgagggcacgtgtagttgctcaaggcgctacagtcgctctgatgattggcagtgcttagtactatggcgatcaaatccagctgttcaagaaagggtcgagcccatgatcttcccatgaatattgctgttttttggtgtatggagggaatgccttggtttccgcataaatttcccctgggactctggtggcccctttttaaacatgctttttgggcctggacaacttggttagactaacaagaaaatccccctgttgggtccgaatcggggcagggattggaaaaaaaaaattaaagtttggg

SEQ ID NO: 54751 - protein, 81 aa, Zea mays
  misc_feature: Ceres CLONE 1482651
  misc_feature (14)..(82): Pfam Name: HIG_1_N Pfam Description: Hypoxia induced protein conserved region
MEKGSGGSNPPPPPLHMEDFQLEGKKPVKNPFVPIGALVTAGVLTAGLISFRYGNSQLGQKLMRARVVAQGATVALMIGSA

SEQ ID NO: 54752 - DNA, 631 bp, Zea mays
  misc_feature: Ceres CLONE 1482657
  misc_feature: Encodes the peptide sequence at SEQ ID NO. 54753
atagctggagctccccgcggtggcggccgctctagaactagtggatcccccgggctgcaggaattcgcacgagaccattacctagaacatcctaatcgaaaatttttttcgaatttagaatccccgtgctgagagctgagtgccgccttggttgctccgtactggactcgattcctcatcgcagcagaagcatcccgtcccctccgcttctccttgctctgctctgctaacacacagacaaaaaaaatagcagcatgtcggaggtgaaggactccaatgtgcctgctgcacttgatggaaatcctcaacctatggaccaaactgaagacaattctatgccctcagcacagcaacaggaagaagcaatcaagaagaagtttggaggactaatgcccaaaaagcccccactcatctcaaaggatcatgagcgggcctactttgattctgctgactgggctctagggaagcaaggtgttgccaaaccaaaaggaccgctggaggcacttaggcccaagcttcagccaacacgccaacaacagcaacaacgtgcaaggcgccctatttacacttcgtcagaaaacgaggacggagacggggctggtgctgaggatatgaacatcaattgaagtgg

SEQ ID NO: 54753 - protein, 123 aa, Zea mays; identical to SEQ ID NO: 36580
  misc_feature: Ceres CLONE 1482657
  misc_feature (39)..(122): Pfam Name: Lg106 Pfam Description: Lg106-like protein

SEQ ID NO: 54754 - DNA, 667 bp, Zea mays
  misc_feature: Ceres CLONE 1482658
  misc_feature: Encodes the peptide sequence at SEQ ID NO. 54755
atagctggagctccccgcggtggcggccgctctagaactagtggatcccccgggctgcaggaattcgcacgagaccattacctagaacatcctaatcgaaaaaagtgcatgcagtcgtccatcacatcgatcgactggacacactgacaggatcgcaggattgacagcaagagccgcccgcaatggcctccgcctcgcgcctcgtgtccttcgccgcgctctgcctgtgcctgggggcggcgctccaggcggtccggggcgccaacgcggccgcccgcgccttcttcgtcttcggcgactccctcgtcgacaacggcaacaacaactacctgctcacggaggcgcgcgccgactcgccgccctacggcatcgacacgcccgaccaccgcgccacgggccggttcagcaacggcaagaacgtgccggacatcatcagttgagtcgtcgcttgcatgccggccggaatgcttcccgagtccttcctgcctttccagttactaactaactagctaactaacttgcatgcatggtgcacgactgcacgccgcaggtgagcacctcggcgcggagcccgtgctgccgtacctgagcccggagctcgacggcgacaagatgctcgtcggcgccaacttcgcgtccgccggcgtcggcatcctcaacgacaccg

SEQ ID NO: 54755 - protein, 85 aa, Zea mays
  misc_feature: Ceres CLONE 1482658
MASASRLVSFAALCLCLGAALQAVRGANAAARAFFVFGDSLVDNGNNNYLLTEARADSPPYGIDTPDHRATGRFSNGKNVPDIIS

SEQ ID NO: 54756 - DNA, 677 bp, Zea mays
  misc_feature: Ceres CLONE 1482664
  misc_feature: Encodes the peptide sequence at SEQ ID NO. 54757
atagctggagctccccgcggtggcggccgctctagaactagtggatcccccgggctgcaggaattcgcacgagaccattacctagaacatcctaatcgaaaaacattcacatcgcactctcctccagcctccaggcttggcaagcgtgcttcaacatgaccacatccatgtcgaacagcgccgctagcgagaagcaagcgcagcaggcaggccacaggcagcggcccccggcggcgtcggccgcggacgcggagatgcagagggtgttctgccgcatcgacgcggacggcgacggccggatctccgcctcggagctggccgcggtgacgcgcgccatctccccgccagcgagctcctcgcacgggcgccgcgaggtggccgccatgatggacgagctggacacggaccgcgacggcttcgtggacctcggcgagttcagggcgttccacgcgcgcggcggctgcggcgtggacgacgacgccgagctccgcgccgccttcgacgtctacgacgtcgacggcgacggccgcgtcacggcggccgagctgggcaaggtgctcgcgcgcatcggcgagggcggatgcagcgccgaggagtgcgagcggatggtcgccggcgtcgatgccgacggctgcgtcgggttcgaagacttcaagatgatgatgtgcccccagccg

SEQ ID NO: 54757 - protein, 170 aa, Zea mays
  misc_feature: Ceres CLONE 1482664
  misc_feature (106)..(134): Pfam Name: efhand Pfam Description: EF hand
  misc_feature (29)..(57): Pfam Name: efhand Pfam Description: EF hand
  misc_feature (69)..(97): Pfam Name: efhand Pfam Description: EF hand
  misc_feature: SWISSPROT Homolog: EC 2.7.11.1 Non-specific serine/threonine protein kinase
MSNSAASEKQAQQAGHRQRPPAASAADAEMQRVFCRIDADGDGRISASELAAVTRAISPPASSSHGRREVAAMMDELDTDRDGFVDLGEFRAFHARGGCGVDDDAELRAAFDVYDVDGDGRVTAAELGKVLARIGEGGCSAEECERMVAGVDADGCVGFEDFKMMMCPQP

SEQ ID NO: 54758 - DNA, 667 bp, Zea mays
  misc_feature: Ceres CLONE 1482672
  misc_feature: Encodes the peptide sequence at SEQ ID NO. 54759
  misc_feature (389)..(389): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (477)..(477): n is a, c, t, g, unknown, or other
cataactggagctccccgcggtggcggccgctctagaactagtggatcccccgggctgcaggaattcgcacgagaccattacctagaacatcctaatcgaaaagatttgacccatctcccaacccctacactcccggcggcggcgcaggagcagcagcaccagcacccgaggatggtgaagttcctcaagcccggcaaggccgtgatcctcctgcagggccggttcgccggcaggaaggcggtgatcgtgcgcgtgttcgaggagggcacccgcgaccgcccctacggccactgcctcgtcgccggcctcgccaagtaccccaagaaggtggtccgcagggactcggccaagaagacggcgaagaagtcgcgcgtcaagtgcttcatcnaagctcgtcaactttcccccaccctcatgccccacccgcttacaccctcgaacgtcgaacttcaaaggaaaaannnttttgggggggntgtgggccccacgcgcgcccggccccggcacggagcaggcggccgcgcgccccctcgggaaaacatggtttcttctaggtttggtgggctacataccaggttgcactataactcgacataacgacaatcttgcgtaggggcgggtttcttattcactagtctacctaccgaactctacgaactgcgtggc

SEQ ID NO: 54759 - protein, 141 aa, Zea mays
  misc_feature: Ceres CLONE 1482672
  misc_feature (7)..(40): Pfam Name: KOW Pfam Description: KOW motif
  misc_feature (73)..(73): Xaa is any aa, unknown, or other
  misc_feature (97)..(97): Xaa is any aa, unknown, or other
  misc_feature (98)..(98): Xaa is any aa, unknown, or other
  misc_feature (102)..(102): Xaa is any aa, unknown, or other
MVKFLKPGKAVILLQGRFAGRKAVIVRVFEEGTRDRPYGHCLVAGLAKYPKKVVRRDSAKKTAKKSRVKCFIXARQLSPTLMPHPLTPSNVELQRKXXFGGXVGPTRARPRHGAGGRAPPRENMVSSRFGGLHTRLHYNST

SEQ ID NO: 54760 - DNA, 663 bp, Zea mays
  misc_feature: Ceres CLONE 1482680
atagctggagctccccgcggtggcggccgctctagaactagtggatcccccgggctgcaggaattcgcacgagaccattacctagaacatcctaatcgaaaattcctagctcatacgtctgggccaccagctcgtcacaagctccgatctcctcccacacctctccacctgcgacgacgaccaccgccatggggggcgcttccctcgagcgcctctgccgccgcgccacctcttcctcctccgtgaggggtgcccgccttcaggagcctcctctccgccagctccaccgcccccgccgcggcatccgccccgccgccgccccccagcacgggcgacaccgcggccgcggcgcgcggatcgagtgctggtgggactaccggggccagcggacagctcgtccctctgggacagcgtgtatgccccaggtgacacggtgacgcgtacgctgctcccgagaccgcggtcgcccgtgagggaaccgcgcacgacggcgcctccacctggagcgcgcgcttcctgtggggggacctccaaggatcacgatcgggttccgcccaacgaggagtatcgaagcgccccccatgccacatgggctgcgcccacaggtcaccctcatgactcgaaatggtcagctgggtgccactcgcctggctcaggactgtt

SEQ ID NO: 54761 - DNA, 790 bp, Zea mays
  misc_feature: Ceres CLONE 1482692
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (594)..(594): n is a, c, t, g, unknown, or other
aatgatgtggggaacaatggtgtcgtttgcgggggcgatttttttggggggggnnnacaaactggagctcacgtggtggcggtcgctccgtcatagtgggagccccgggctgcaggaattctcacgagaccattacctagaacatcctaatcgaaaagcgaaaccctcgctccctgcccgcaacagcctcccgcacccagccagccccttccccagcagcagtctccagccgcagccatggccaagccaccgccgcccacctccacctccgaccccgcgctccccaccactgctacaaccacctcgtcggcccccaagtcgtcgtctcgccctaggccccgaccccggggcctcctcgatgcggtcgcagcctccgagcgctccctcctcgccggggggggtcgctccgccggtcaccacggctagccggcgatcgtgggggtcctcgcgctcatcatgaaccagggagggacgaccgaatggatcgatgaaaagatccatccagcaacacctccgaaacaggacggcggacatcgataaacgagacaacgaccgcggggccgagagaggatggccaacgactcgagctgaggnaccctctatcgggaggtaataggtgattctgccggcgattgtagtaccgggcgccgtgaagagacgcgcgggaaaaaaaacaagggacgaaagcggtcaaggagcggggaggtgggagagaaacagcagcacgaaggtaacgggcacccgatgagagagtgggggggcagatgcacaagtctgaacaggcgggtcg

SEQ ID NO: 54762 - DNA, 756 bp, Zea mays
  misc_feature: Ceres CLONE 1482693
  misc_feature: Encodes the peptide sequence at SEQ ID NO. 54763
ctccccgcggtggcggccgctctagaactagtggatcccccgggctgcaggaattcgcacgagaccattacctagaacatcctaatcgaaaaatgcgacacatgttcgagtcactcggctaccagtcgggcttcttcctctcccagctcttctcgtcctcgcggggcgcctcgccgacgccgacgccgccattcccgctcaagcagccgccagcagctccggccgcgcgcgccccgccgcagctcttcagctggccgggccaccaccagccgcagcagctcccgtcgcccgcgggagcgtcgccgctcttcccgccacggaccagggagcggttcaacccgaacctccgacgcgacccaatgggcggcggattccaaggcgggcctagggacgaaggggccaccatgtttgtctattcttccgcccaagggggccggcacgctagtgtaaatcaacccaggggaggccggcctcgcaagctcgggtggtcacaaaatccacccaccctctttagccttggtggggcggcctcttattggttctgcggagcttgtgtgtttctactaattccccagaacggggggaggtttgtgggtggggccacaacgggcgccggtcctgtttgttgtcgttctccgtctccagtagggcgtggggtagtattacaggtggcgtactatttcggtgggggcacccgcagctatggtgtttgggacttgtgggggtttgaacatataaacttgtggtgtggggtgt

SEQ ID NO: 54763 - protein, 221 aa, Zea mays
  misc_feature: Ceres CLONE 1482693
MRHMFESLGYQSGFFLSQLFSSSRGASPTPTPPFPLKQPPAAPAARAPPQLFSWPGHHQPQQLPSPAGASPLFPPRTRERFNPNLRRDPMGGGFQGGPRDEGATMFVYSSAQGGRHASVNQPRGGRPRKLGWSQNPPTLFSLGGAASYWFCGACVFLLIPQNGGRFVGGATTGAGPVCCRSPSPVGRGVVLQVAYYFGGGTRSYGVWDLWGFEHINLWCGV

SEQ ID NO: 54764 - DNA, 654 bp, Zea mays
  misc_feature: Ceres CLONE 1482694
  misc_feature: Encodes the peptide sequence at SEQ ID NO. 54765
  misc_feature (654)..(654): n is a, c, t, g, unknown, or other
ctggagctccccgcggtggcggccgctctagaactagtggatcccccgggctgcaggaattcgcacgagaccattacctagaacatcctaatcgaaaagataatttggatgtctgcttccaaccctgtctagctccttcggtccagcttcgactggctggcaggtaggcacacgcgaagcgataaggtcggctaagccgcgatgtcgccgcggccgccgtccctcgtggtgctcccgctcctcctccccctcctcctcgccgctgtatcccacgctacggctaatgcggccggtgccagcgcccctcccccagtgccgacgccgtggccggagcagttccacgcggtggtcttcaccaatctcaccgagagcggcggccggctgcagctgatcgacctgtactacgactggcccaggggccgcaacctcaacctcatccgggaccagctctccagcgacccgctctacgacgtcgagtggaccaacggcacctcctacttcttcgactccgggtcctgccgcaccatgcgtttccccgtggggatcctgccgcctgactggctcgccgccggcgccgtctatctcggccgcgagcacgtcgacggcttcgactgccacctgtggaccaagtcgacttcgtctggtactacgagn

SEQ ID NO: 54765 - protein, 150 aa, Zea mays
  misc_feature: Ceres CLONE 1482694
MSPRPPSLVVLPLLLPLLLAAVSHATANAAGASAPPPVPTPWPEQFHAVVFTNLTESGGRLQLIDLYYDWPRGRNLNLIRDQLSSDPLYDVEWTNGTSYFFDSGSCRTMRFPVGILPPDWLAAGAVYLGREHVDGFDCHLWTKSTSSGTT

SEQ ID NO: 54766 - DNA, 561 bp, Zea mays
  misc_feature: Ceres CLONE 1482696
  misc_feature: Encodes the peptide sequence at SEQ ID NO. 54767
  misc_feature (21)..(21): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (32)..(32): n is a, c, t, g, unknown, or other
  misc_feature (33)..(33): n is a, c, t, g, unknown, or other
  misc_feature (41)..(41): n is a, c, t, g, unknown, or other
  misc_feature (42)..(42): n is a, c, t, g, unknown, or other
  misc_feature (62)..(62): n is a, c, t, g, unknown, or other
caaagctgggagctccaccgncnnngtggcgnngccgctcnntagaactagtggatcccccngggctgcaggaattcgcacgagaccattacctagaacatcctaatcgaaaaccttcgcctaccccagccagccaggaatcgccaccggcggaagccaagcatcgtcccagcaccggatcgattccgcccgcccgcccgcccgtccatggatccggcggccgagccggcggcgtggccgccgtggacgtcgctcctgctgcgggcgctgagccggcggcggacctgggtggcgctcttcctcgccgtctacgccgggctgctctcgtcctcctggtccctgctcgcctccgtcgcgcctggtactactcggctcctcggcgtccgcggggcccggctggcccgccgggctctaagcctccgtcatgtacggggccctggttcggccggctttccttgggcgcccggcttgcgggtccccccgccccgccatgtttcttacctgggaaaaccggttccccgggggggtttcccccttccgggggccccccccccgaagggt

SEQ ID NO: 54767 - protein, 118 aa, Zea mays
  misc_feature: Ceres CLONE 1482696
MDPAAEPAAWPPWTSLLLRALSRRRTWVALFLAVYAGLLSSSWSLLASVAPGTTRLLGVRGARLARRALSLRHVRGPGSAGFPWAPGLRVPPPRHVSYLGKPVPRGGFPLPGAPPPKG

SEQ ID NO: 54768 - DNA, 678 bp, Zea mays
  misc_feature: Ceres CLONE 1482699
  misc_feature: Encodes the peptide sequence at SEQ ID NO. 54769
aaaaagctggagctccccgcggtggcggccgctctagaactagtggatcccccgggctgcaggaattcgcacgagaccattacctagaacatcctaatcgaaaactggtaattacctatcagaacggcaaaagctgcctgaaagccaagcgaacatttcctgcctaggccgcgggggaagcgaggaaaaagatcccatccaattccaatggctatcctcccccaaatcctccactctcctcacccccgcctcaccgccgccgccgcctccccctctcgcgcattctgccgagcaccacgccacctccatgcctccgcctcccgtacccgggggcagggacggggccgcctcgccacggcggcgggcgcgtccgggcccgggccgtcgtcgccggagccgtacccctctgagtccgacgacaggctggtggagctcccgctgttcccgctcccgctcgtgctcttcccggacgctacgcacgcgctgcacatcttcgagttgcgctaccgcatcatgatgcacacggtgctgcagactgacctccgcttcgggatcgtcttcgccggcaactccgggtccgccgccaaagtgggctgcgtgggggaggtcgttcaacacgagcgcctcgccgatgaccgggctctgcctcatctggaagggccagcagaagttccgcgg

SEQ ID NO: 54769 - protein, 55 aa, Zea mays
  misc_feature: Ceres CLONE 1482699
MMHTVLQTDLRFGIVFAGNSGSAAKVGCVGEVVQHERLADDRALPHLEGPAEVPR

SEQ ID NO: 54770 - DNA, 670 bp, Zea mays
  misc_feature: Ceres CLONE 1482701
  misc_feature: Encodes the peptide sequence at SEQ ID NO. 54771
aaagctggagctccccgcggtggcggccgctctagaactagtggatcccccgggctgcaggaattcgcacgagaccattacctagaacatcctaatcgaaaaatcggaggaggacgagagatccgtcctgcggtgtgcgatggactcccccagctgccggctgttcggtgcccagagatcgccgcacgatctcctcggcggcggggccgttgcggatgtggtgctgcggaggaagaaggaggtggccaccgggacactggcggccgtggtggcctcatgggagctcttctactgcgtgcccgggtacactctgctctccttcctggcccaggtgctcatgatcctgctcaccgtcctcttcgtctgggcctatgctgcgcagctgctcaacagggcacctccgcctatcccattgacgaaaatttctgacgagtcaatgagtgaagcagcagaaatggttggtagcttcatcaacaaggcgctcaaggatttcgaaaacattgcacttgggaaggataacagcctcttctacaaggtggcttttgtgctgttgctggcctccatagctggacgactgaccgatcttatcactttagtatatacaagtgctattattgctctcacggtccctgccttgctggagaaatccgaagaacaccttgccagattc

SEQ ID NO: 54771 - protein, 177 aa, Zea mays
  misc_feature: Ceres CLONE 1482701
  misc_feature (24)..(177): Pfam Name: Reticulon Pfam Description: Reticulon
MDSPSCRLFGAQRSPHDLLGGGAVADVVLRRKKEVATGTLAAVVASWELFYCVPGYTLLSFLAQVLMILLTVLFVWAYAAQLLNRAPPPIPLTKISDESMSEAAEMVGSFINKALKDFENIALGKDNSLFYKVAFVLLLASIAGRLTDLITLVYTSAIIALTVPALLEKSEEHLARF

SEQ ID NO: 54772 - DNA, 879 bp, Zea mays
  misc_feature: Ceres CLONE 1482702-R
  misc_feature (872)..(872): n is a, c, t, g, unknown, or other
cgaattgggtaccgggccccccctcgaggtcgacggtatcgataagcttttttttttttttttttgattcaaaagttacactggcctttcctaaaacatttttagaggacccatgttcccctcccaaaagggggcaaggtaacatgacaaactttcgcccccatcaaaagaactcaaaccagacagcctataccgtggtgaggtcagcccaaatacaccctttgatttcacggatggcaaaccggactcttcacccacaccatgaaaggccacccacgccgttgtgaaatactcacaactggggctcttgagagagactatagggagatgctacactgtcgctttcccggaaggtctgaggcgagacttagagggaagccttttgcaggagcctttagggctttgggaggcatgttgggggtactggggctggtttgaacccaaaattcttcaattatcataccccccccacaaactggaaacccgttccccccgacaccaatttttccataggaaacgccggccctgggaacccatttttctttcccccagggcccccaggggtagggccgggggtttacccgaccccggaaaggcccattcccccaaaaaagggtttttggggacataatttcaggcccccaaggccggggggggcccaaattccccccccttatttttccggcaaaagggggatttttaccccccgaaaatggtgaaagggggaccttccgtttctctttgaaggagaagatttctcaaaaaaaaagggcccccgggggaaaattcctctccggccaaaataggtccccccccccggggggaaaaaaggggatctctccagggggggggccccccccccgggggttctnttttttt

SEQ ID NO: 54773 - DNA, 664 bp, Zea mays
  misc_feature: Ceres CLONE 1482702
  misc_feature (664)..(664): n is a, c, t, g, unknown, or other
atagctggagctccccgcggtggcggccgctctagaactagtggatcccccgggctgcaggaattcgcacgagaccattacctagaacatcctaatcgaaaaaagtctaggaccccctccgattcttatggtcccagctaccgactagtcaacttggcgtcggacagaagcccaattccgtccgctctagtataggccctgaaagcccttacatgaaatagcctcctaggcttacattcccatatcgataattgcagccttgctgtgcatcaaagatggtcctagctggggatcctaggcaacttactcttccatgaaggatctccagtcgaagctagcatgtgtgttactgcggattgcttgactgaataagatgagtaaaagaagctgacctcggaatacgagtagctcctgttccgcaccacccatctgatccgtgctataaatgaggccgcatctctttctgaacagcccggtgaggaccattcctatcctgttgtcagggtgtcaccctgccgccttgttgatcgttcacgttgttcctgcatctaccgcaagctatccttgtgatcccgagatagagattgatcactcgtcatgactgtacttccacactgtcgagctaagcgtggatgagtgcacttgttgctgtcgtcacctgacn

SEQ ID NO: 54774 - DNA, 670 bp, Zea mays
  misc_feature: Ceres CLONE 1482706
  misc_feature: Encodes the peptide sequence at SEQ ID NO. 54775
catagctggagctccccgcggtggcggccgctctagaactagtggatcccccgggctgcaggaattcgcacgagaccattacctagaacatcctaatcgaaaaacacagcgacaccgcgtggttcgttaggaaaggaaatcgatccccatctgatctcttcggtgctaaagaaatataggccgccgccgcctcctcattcggtgaaaggtgggcggttagggttgggagatctcttgactcacgacacgagcagcagaatttgtcgagggccgctggttgctgcgagaggtccgtaccttcgtgggatcttgaaaattgaatgttctaatggagtccaagggtggcaagaagaagtctagcagtagtcgttcctccctgatgtacgaagctccccttggctacagcatcgaggatatccgccctgcaggcggcatcaagaagttctccgctgcttactcgaactgcgcgaggaagccatcctgatatctctgtcgtcatccccatcctagtagcgtagaaaccacctgcattttcattttgatctccctaatccctccggctagctgctttccagtgaccaaaagatatcagagaccacttcccgtcttcctcccgtggcctgtctgtcatctggctctgaaacgatggcagtcctgcaagttgctgctg

SEQ ID NO: 54775 - protein, 51 aa, Zea mays; identical to SEQ ID NO: 13325
  misc_feature: Ceres CLONE 1482706
  misc_feature (1)..(51): Pfam Name: AdoMetDC_leader Pfam Description: S-adenosyl-l-methionine decarboxylase leader peptide

SEQ ID NO: 54776 - DNA, 755 bp, Zea mays
  misc_feature: Ceres CLONE 1482708
  misc_feature (22)..(22): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
aatattatgggggtggcagggnaaaaaaccaaatattccatttnnnnnnnnccaacaaaatcaaaactggcactccccgcggtggcggccgctctagaactagtggatcccccgggctgcaggaattcgcacgagaccattacctagaacatcctaatcgaaaactcaacgccggccttgccgagagcccgagacggatcgccggggtctcccggaatggcggggtaacgaaaccgcggcggaccagacaaggcagaggagccgccgccgcgacccacaggccaccgggtcgccgaggagaggatgcagcaaggggtggggggggggcgtgcccatgagccccgagctccagcagggggacggcgagtgccaggaggtgtgccgcgcgctccggaagggggtactgaagatggggagggataaggatggcgggaggcaatccaagcagctggaggatggtgagggggaaggtgagagaccccccccccccccgccgggggggcttaaccagagtcgcaggggtggcggagaaaagggagaccccttgatagcgacagggcggcgcgtccgacaacaggggagggcgtggggcaaaaaaacccagcggcctacggaggaaggttaatgggagagggcgcccatgagccgggcggtgggggaatgcagaagggagcgggagcatcatccggagcgggcgtaggcgaaccaaaggtaggcggacggtgaattgcagcggagccaaaatgggacacgcg

SEQ ID NO: 54777 - DNA, 685 bp, Zea mays
  misc_feature: Ceres CLONE 1482711
  misc_feature: Encodes the peptide sequence at SEQ ID NO. 54778
atagctggagctccccgcggtggcggccgctctagaactagtggatcccccgggctgcaggaattcgcacgagaccattacctagaacatcctaatcgaaaattagggaacgtcggagaaagccaagtctcgaacctgtcagcaatccgctgcccaagcctttcaccaacgcctggtcgccgccgatcccaaaaggccgccatctttttcctgaaaaccacgagcagttcactacccatccgccatagtccgaaagttaccaaatcctcctgcgaggccccagcaccgaatgccccagcacaacaaggcggcatcgtttgagaggaagcggctagaggacctgctgccgggctagatgacggaagtggcgggacgccccgggacgtcgggcggcctggcgctgcgggcgggccagttcgtcttcgccgccgcgtccatctgcgccatggcctccgcgcccgggttcaccaactacacagccttctgctacttggttgcatctatgggactacaagcactatggagcttagggcttggatgtcttgattgctatgccttgacattgagaagagatcttcagcaagctcttctcatgagcttatttgtttttggcgattgtgtaacagcaattctttcgtttgctgctgcatgctcagctgcaggcgtagttgtgcttttcgaaagg

SEQ ID NO: 54778 - protein, 110 aa, Zea mays
  misc_feature: Ceres CLONE 1482711
  misc_feature (6)..(110): Pfam Name: DUF588 Pfam Description: Domain of unknown function (DUF588)
MTEVAGRPGTSGGLALRAGQFVFAAASICAMASAPGFTNYTAFCYLVASMGLQALWSLGLGCLDCYALTLRRDLQQALLMSLFVFGDCVTAILSFAAACSAAGVVVLFER

SEQ ID NO: 54779 - DNA, 669 bp, Zea mays
  misc_feature: Ceres CLONE 1482712
  misc_feature: Encodes the peptide sequence at SEQ ID NO. 54780
atagctggagctccccgcggtggcggccgctctagaactagtggatcccccgggctgcaggaattcgcacgagaccattacctagaacatcctaatcgaaaaataccagtgatggcctccgtgagctccatcgccaccgccagtgcaagtcgtgccggtgccttccaagcgtcgtgtgcgctcgcaccgcgccaccggcatgccttgatcgcgagggtccagagcgagtacgttgatctaacagcggaagagacgacgacgacgaccgcgcccaccacctccaccttcgttctcctcgccacatactcctgcagcggcggccgccccgacggccagggcaaaggcggcgggccccaggatgtgggacgcgctggcgttcggcagcccggctcccgagcgcactaatggccggctcgccatggtgggctttgtgtccgcgctcgccgtcgagaccgacgccggctccggactagcctggttggcggccacgaccgtcgtgctctccatcgcgtcactcgtgtcgttgctcaatgcatggggacagcgacagcgcccaggtcatgagcggcgccttcatgagcgccgatgccgagctctggaactgccgcttcgccatgcttggcctcgtcgcgctcgccttcactgctcaccggcgcccagctcatcaac

SEQ ID NO: 54780 - protein, 103 aa, Zea mays
  misc_feature: Ceres CLONE 1482712
MWDALAFGSPAPERTNGRLAMVGFVSALAVETDAGSGLAWLAATTVVLSIASLVSLLNAWGQRQRPGHERRLHERRCRALELPLRHAWPRRARLHCSPAPSSS

SEQ ID NO: 54781 - DNA, 654 bp, Zea mays
  misc_feature: Ceres CLONE 1482717
  misc_feature: Encodes the peptide sequence at SEQ ID NO. 54782
  misc_feature (639)..(639): n is a, c, t, g, unknown, or other
catagctggagctccccgcggtggcggccgctctagaactagtggatcccccgggctgcaggaattcgcacgagaccattacctagaacatcctaatcgaaaaaggaaaaggtcgggaaaaaaatccgaaatggccgctagtggcctcggtctctccacctccttcctccccggccacgacaccctcctccggcgccggtgccggcggccggcgggccacgccgccgcgtcgttcctgccggtgacggcggagctcggcggcgtcgcgacagagctgggccgccagctggtggaggcggtgggcgtggggctcccctgcaccgtcatgcagtgcggcgacgtcatctaccgcagcacgctcccccggaacgacgggctcaccatcacggccgccggcctcacgctcgcgctcgctaccgtgtcgtacctctggtccacgccaggcgtcgcgccggggctcttcaacatgttcgtcctcgccttcgccgaacgcctcttccgccctaccttccgcgaggatgacttggtatttgggaatgagctcgtggagggcgcattcagagtcgtgtgtaaggcttcactggcgaaccccgaagcggcgaagaatcaaggggatttggtcgcgaagaagccacccantatggtgcaacgcag

SEQ ID NO: 54782 - protein, 174 aa, Zea mays
  misc_feature: Ceres CLONE 1482717
  misc_feature: SWISSPROT Homolog: EC 2.7.11.1 Non-specific serine/threonine protein kinase
  misc_feature (170)..(170): Xaa is any aa, unknown, or other
MAASGLGLSTSFLPGHDTLLRRRCRRPAGHAAASFLPVTAELGGVATELGRQLVEAVGVGLPCTVMQCGDVIYRSTLPRNDGLTITAAGLTLALATVSYLWSTPGVAPGLFNMFVLAFAERLFRPTFREDDLVFGNELVEGAFRVVCKASLANPEAAKNQGDLVAKKPPXMVQR

SEQ ID NO: 54783 - DNA, 673 bp, Zea mays
  misc_feature: Ceres CLONE 1482719
  misc_feature: Encodes the peptide sequence at SEQ ID NO. 54784
atagctggagctccccgcggtggcggccgctctagaactagtggatcccccgggctgcaggaattcgcacgagaccattacctagaacatcctaatcgaaaagcacagctacttgtggtccccctatgtctactaccgccgctagatagctcaagtgttgcgtgtgcgaccccgaaccgggggaggaaattaagacgcctcaatcaggcatggggtgcgacaacaagtgcaggtgcgccatgacgtgccccggcggcaaatactgcttgtgcacgtcggggagcggcgggcagagggagcacacgacttgcggctgcggggagcactgctagtgcagcccgtgcacgtgtggccgggccacgatgccgtccggccgcgagaacaggacggctaactgctcctgcggggcgtcctgcaactgcgcatcctgcgcctcggcctgatccatgcgcctcgccctcgtgctaccgcgctgcctagtggagggagttgtctagtgaggctctggagacgaagcaactagcactacttctaataaaggggcttgtgtcatgctcgccagacgcatcacgcgctgcatctgcatcatggtatcgtgtagtaagtttgtgtatgaataaacactaccactttatgtctaaaaaaaaaaaaaaaaaagcttatcgataccgtg

SEQ ID NO: 54784 - protein, 40 aa, Zea mays
  misc_feature: Ceres CLONE 1482719
  misc_feature (2)..(41): Pfam Name: Metallothio_PEC Pfam Description: Plant PEC family metallothionein
MGCDNKCRCAMTCPGGKYCLCTSGSGGQREHTTCGCGEHC

SEQ ID NO: 54785 - DNA, 674 bp, Zea mays
  misc_feature: Ceres CLONE 1482722
  misc_feature: Encodes the peptide sequence at SEQ ID NO. 54786
  misc_feature (674)..(674): n is a, c, t, g, unknown, or other
ctcaccgcggtggcggccgctctagaactagtggatcccccgggctgcaggaattcgcacgagaccattacctagaacatcctaatcgaaaactcgcattcgtctccaccagccggtcggacttcttgcgctccaagaactcggcgaggatggaaatgttttttggcagctttctcagtgaatcagtatcaccgcagaaccttttcggacacccggatgttgagagatgcccattcctgaggaatatcaatggagctacaaccttttccctcgcttctgctttgccagtagctgctcaaggaggcaagggtccaatttttgaggaagggtcaggctttgagtcagcattcaagcttttccatggccgaaaaggaataggtcccctttcagaagggtcatatgtgtctcatgaaaaccgcaatgagagcattgatgtcaggacggaacccggcgctcccgtttaagcccatgggctgctagagcacccccgatggggcgtttcaagcattgtggacccatgtgggggttagaattcgtgggccgcccagggggcagaaggcagaggctataaaccccgaaaaaggccgtgatcaaagggcccagcccgtaatgccccaagcacaccccgataagcaattccttgggcgggggaaaacaaaaagggggcgtctcan

SEQ ID NO: 54786 - protein, 104 aa, Zea mays
  misc_feature: Ceres CLONE 1482722
MEMFFGSFLSESVSPQNLFGHPDVERCPFLRNINGATTFSLASALPVAAQGGKGPIFEEGSGFESAFKLFHGRKGIGPLSEGSYVSHENRNESIDVRTEPGAPV

SEQ ID NO: 54787 - DNA, 676 bp, Zea mays
  misc_feature: Ceres CLONE 1482723
  misc_feature: Encodes the peptide sequence at SEQ ID NO. 54788
  misc_feature (398)..(398): n is a, c, t, g, unknown, or other
atagctggagctccccgcggtggcggccgctctagaactagtggatcccccgggctgcaggaattcgcacgagaccattacccagaacatcctaatcgaaaaatttttcgcacgaatcgtccccgtccagagcgcgagcaaccaacgccgccccgctgtctccgccggtccgcccccgtccctcccctcccccgaatcgcgtcgtcccgtctcctgctgccgcggaaccctcgccatggcggaggcgcccgagaccgccgcccccacccagccgcctcccgcgccggcggcttcgtccccgcctcccaagtcggggatcccgccgcggtacgacctggacgccaagtgggacgcgtgcctcgacctctccatccgccgcgtcgcctactcctccctcngcggcgccttcgcgggcctcctcctcttccgtagccctactactcgctgggcatcagttgcccttggagctggtgtgggggataggggctgcatacactgaatggtcatactttcaatggtgctccaaagtgttcacccaaaggatcaactattcccttctgcaccctctgatggggggagaaaaggaaaccccttgctgtttggattgggcccatctccggtggaggtttttggtatggggtgaaagtaccgggggtggttccaggctgggatattt

SEQ ID NO: 54788 - protein, 87 aa, Zea mays
  misc_feature: Ceres CLONE 1482723
  misc_feature (19)..(88): Pfam Name: DUF543 Pfam Description: Domain of unknown function (DUF543)
  misc_feature (55)..(55): Xaa is any aa, unknown, or other
MAEAPETAAPTQPPPAPAASSPPPKSGIPPRYDLDAKWDACLDLSIRRVAYSSLXGAFAGLLLFRSPTTRWASVALGAGVGDRGCIH

SEQ ID NO: 54789 - DNA, 715 bp, Zea mays
  misc_feature: Ceres CLONE 1482727
  misc_feature: Encodes the peptide sequence at SEQ ID NO. 54790
  misc_feature (1)..(1): n is a, c, t, g, unknown, or other
  misc_feature (13)..(13): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
nggtagggtcccnccagcgagggataaaacacccttcggggggggggggnnnncccaaactggagctcccgcggtggcggccgctctgaatagtggatcccccgggctgcaggattcgcacgagaccattacctagaacatcctaatcgaaaagtgccagtttcgttctcatctccgttctctggattgccccgctcccctcttccggtcttccactcttccccatgtcggacgcgttaggaaagccaagcccggccgctcgtcttcagggcggcgaaccgcctccatccacagcgaagaagcacaagaagataagaagcccgcgcagacccctcgccacgcgactcgaggcccaccgcggccgcgaggggctgaagcggcggagtgcagcagaacactggccaaacctcccggggagcgggaagaggatgaagtggagttgtgccccctttttctcgaaaaagtttggggtgacgggggaggcggccggccctgcgcctggaatcgcaccgggtaggagcccccccacagaccgcgtccgctggagaggcgcgaccgcttcctgcaaaaggaggggcacgctttggggctttggccgtcagcttggggcagcgatagtgcgctagggggagtcgtgggtcgggccggcttgtggcctgattgtggcgaaggcggtaatacgggccgtgccgagggtgatgttggttcccaggcg

SEQ ID NO: 54790 - protein, 133 aa, Zea mays
  misc_feature: Ceres CLONE 1482727
MSDALGKPSPAARLQGGEPPPSTAKKHKKIRSPRRPLATRLEAHRGREGLKRRSAAEHWPNLPGSGKRMKWSCAPFFSKKFGVTGEAAGPAPGIAPGRSPPTDRVRWRGATASCKRRGTLWGFGRQLGAAIVR

SEQ ID NO: 54791 - DNA, 654 bp, Zea mays
  misc_feature: Ceres CLONE 1482738
  misc_feature: Encodes the peptide sequence at SEQ ID NO. 54792
tagctggagctccccgcggtggcggccgctctagaactagtggatcccccgggctgcaggaattcgcacgagaccattgcctagaacatcctaatcgaaaagtgcattttctcgagcgacggagcgatccgttcgggccgtccaccacagcgagagagagcggcagaggcgcagagcacaaccgagcgagagagagaggacggcgacggcggagatgatggggtggggagaggaggtggtggctctgtccctgcgagggtacggctatggcaaccaggaggaccaccggccggagaatccgcggcggtacggggtgacagagatgcgaagccccttctactccttccgccccgcaaaccaggcgctccaggaaatatcggattctcttagtacattcgccgatggtttgaagcctccccccccacgccataatttgatgggaaaggagttggttagacagatcactgatctagcactcgggcctgacatttatgggagcgcaggtgattggccagagcagttgctgcgccaaggaccaccttctttcatccatatgtagaggaacgcaggccttggggttgacacaattgaacgaatgctgggtcccgtaactacctgaagaggtctggtgagactagtccgcctcctcaagag

SEQ ID NO: 54792 - protein, 114 aa, Zea mays
  misc_feature: Ceres CLONE 1482738
MMGWGEEVVALSLRGYGYGNQEDHRPENPRRYGVTEMRSPFYSFRPANQALQEISDSLSTFADGLKPPPPRHNLMGKELVRQITDLALGPDIYGSAGDWPEQLLRQGPPSFIHM

SEQ ID NO: 54793 - DNA, 632 bp, Zea mays
  misc_feature: Ceres CLONE 1482739
  misc_feature: Encodes the peptide sequence at SEQ ID NO. 54794
cggccgctctagaactagtggatcccccgggctgcaggaattcgcacgagaccattgcctagaacatcctaatcgaaaagtgcattttctcgagcgacggagcgatccgttcgggccgtcctccacatcgagagagagcggcagaggcgcacagcactaccgagcgagagagagaggacggcgaccgcggagatgatggggtggggagaggaggtggtggctcttccactgcttccgcgccgatatcccccccatgaggtccagcccgacgaaaatccactccgagtcccggtgccacacatccgaactggcgcatatggcttacgacccgccctcacgctgtgccgtacaccccgagtcctcttagtacatcttccggacggattgaagccgtccccaagctcgccgtcatgcttggggggtggggaggcttacacagatccctcgctgacggctggggcctgtgccttctgggaggggatgtcatgggcgaccaaagtcaagggggccaaggaccactccttcgatgcctctcccagggttccgccaggcctttaggcttgctacactgggtaggaaatatttgggccgtttaagtacctgcttcccctgcgtgaaccactacgacctcg

SEQ ID NO: 54794 - protein, 121 aa, Zea mays
  misc_feature: Ceres CLONE 1482739
MMGWGEEVVALPLLPRRYPPHEVQPDENPLRVPVPHIRTGAYGLRPALTLCRTPRVLLVHLPDGLKPSPSSPSCLGGGEAYTDPSLTAGACAFWEGMSWATKVKGAKDHSFDASPRVPPGL

SEQ ID NO: 54795 - DNA, 621 bp, Zea mays
  misc_feature: Ceres CLONE 1482741
atagctggagctccccgcggtggcggccgctctagaactagtggatcccccgggctgcaggaattcgcacgagaccattacctagaacatcctaatcgaaaactctgccctccgaaaagccgcccccttcccaaagaaagaaccacacgcgcaggctcaacccacaccccctccgccgccgccgatctccctccgatcccccaaggagccgtcgcgtcggagcatatccgtccatggcggccctggggtccaagctggcgcagctgcaggccaaggactgctaggcgacgcggttcgtggccaggaaagggtgcgcccgaccagcaagaacccctcatggaagaaagaaaccaagcaaggttcgatcctggcaaggcccccccccccgggccaaaaaaaggggcccgggggaggctccccccaaaggaaaagttttttttctaggggcggggggaaaacaaaagccccccccccggggggccacctctttgagaagggggtctttttcggggaaaaaaaagggggcgccccaacacactgtggggataaaaaccacccccctggggggggggggggaaaacacaccccgcgaaaaacaatttttctgttctttatcacggg

SEQ ID NO: 54796 - DNA, 662 bp, Zea mays
  misc_feature: Ceres CLONE 1482742
  misc_feature: Encodes the peptide sequence at SEQ ID NO. 54797
aaagctggagctccccgcggtggcggccgctctagaactagtggatcccccgggctgcaggaattcgcacgagaccattacctagaacatcctaatcacccactcgagccagccagccagccagccagccgcttgggcgccatctctctagagcttcgtaccctcgaagagagatccggcgcggcccaataaacacccggctcactacagactcgcagatggccggcctcaggatgaagttcgtcgccgtcgccgccatggccgccgcgctcgtggcgtccgccgcagccgccgaggcccccgccccggctcccgcgtccgacgccgcggccgccgtacccctcgccgcggcctccctcgccgccgccgccttcggctacctcttctgctagatccgcgctggatacgtggttcctgctccaaatatgattcgtctggtctggcgcgcgtgagtccagctcgtgtgtcgtgtgtgtctctgtgtgaggtgtcggcgggcctgtgtgtatgtatggagtcggccccggcggcggccggcggaggaagtgtgccccttggtggggtggaacctgcttccaccgcgccactggtttgtcgcgggcaatcatgtacctaccccggctgcggttttcgggggtatcaaggaaaaggaatttattttg

SEQ ID NO: 54797 - protein, 57 aa, Zea mays; identical to SEQ ID NO: 43282
  misc_feature: Ceres CLONE 1482742

SEQ ID NO: 54798 - DNA, 647 bp, Zea mays
  misc_feature: Ceres CLONE 1482751
  misc_feature: Encodes the peptide sequence at SEQ ID NO. 54799
aaagctggagctccccgcggtggcggccgctctagaactagtggatcccccgggctgcaggaattcgcacgagaccattacctagaacatcctaatcgaaaactgttcgccagagccaagcccctagtagccacctcgctccagaagctttcctcccctagatctccctcccgtgcccggtcgcgctgccgacccggccatggcgaccaaggggaagctcggggagctagtgtgggagcaccgggtgcaggcggccgcagcggtggctttcgtggccgcggccgccgtctcgatctccgccgtcgggcccaggctcggcgccgtggtgtcattcttctggccgctgctcgtctccacgggcctcttcctggtggcggtcgccgtgctgctccggatctcgccgccgcccgcgggcgacgacgacgagtccggcaaggagctcatcgacttcgtcgccgggtgccgcccggagcacctcgtcccggatgcggcgccgccggcggccgtagcccccgtggaggctccgcccgagctgcagatctaacgggctgccggaggaggaggctgacagcagcctagctgtgctgtgtgctgctgcgtggcatggcgtgctccgtccccgggtgaacttcctccagtggcacggg

SEQ ID NO: 54799 - protein, 114 aa, Zea mays; identical to SEQ ID NO: 42026
  misc_feature: Ceres CLONE 1482751

SEQ ID NO: 54800 - DNA, 779 bp, Zea mays
  misc_feature: Ceres CLONE 1482762
  misc_feature: Encodes the peptide sequence at SEQ ID NO. 54801
  misc_feature (19)..(19): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (32)..(32): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
gtgtgtgggggtgcggttntttttttnnnccncnnnnnnnnnnggggnnnnnccaatactggagctccccgcggtggcggccgctctagaactagtggatcccccgggctgcaggaattcgcacgagaccattacctagaacatcctaatcgaaaagatcgattcgtctccgatctcctccttcgaccggcgccaccttcgtctccgagactccgacgatgtcctccgccgccgatggaggatgcgttgtcgtctgacaaggggaagaagagggaggaggacggcactgacgggaggagcctacgtctggagggtgtccaggtggccgacgggaaagtggatctaggagacctgtacggcgcggcggcggggtgggtagaggctcggaccagatgaccgcaaatcggggggatgtttccaggtggtgctaaaaaaggggggcgggaggcatctcccgaatctccttgctcccacacccccgcggggtgggtgagtatggggtaggcctccctttgcgaaagatgtggggttcgcagcccggttgtatcacaaaaaccccccgggggggggcttctcgccagtaaaatcggggccacttgccggtgcttttggaggcctcaagcgggtgcggccgtggccaggggggtcccccaacggggagtccgtgaccggggatggtccatacccgatgctgtcagaagtccccccctcgctgagattgaggcctggcgtaatttcgtcagatttctgttgaacatggctcctccttgggcggcggg

SEQ ID NO: 54801 - protein, 53 aa, Zea mays
  misc_feature: Ceres CLONE 1482762
MEDALSSDKGKKREEDGTDGRSLRLEGVQVADGKVDLGDLYGAAAGWVEARTR

SEQ ID NO: 54802 - DNA, 829 bp, Zea mays
  misc_feature: Ceres CLONE 1482763
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
caggggggggtgggggggccgctacaaggagtgtnnnnnnnnnnnnttnnnnnnnccaaactgggactccccgcggtggcggccgctctagaactagtggatcccccgggctgcaggaattcgcacgagaccattacctagaacatcctaatcgaaaaaaccattttcgctaatctccctccaccgagccgggcgaatcaaatcaaaccgcggggagcgcgcacccgcagcgactgccggcgatgggagaacctcatcccgttcggcggggccccccctccccacgccgggacgccctccacctccccaaaggggctccaaggggtgttgggggggcactcggccgcacggcccgcactctccaccgcccggggcgccccgggcggggcgctcgcggggccgtgtatgaaactaatgacaggggggtgaggtggttatactgagttgcgcgcccccccgcccgtggggggagggggggggggggtttacgcacgcgtcggggccggggggggccgccccccccccacagagataatgtcggggaggcggcaggcccgcgcgggcgggggagcgccgcggcctagaagcgcggcctattttgcgggtgcatcgggggggcatcgtgctgcctgcccacgggacgcacccgtagcgtgcattcgggcggatggcataatggccgcccgcgggtttaggctgacagctcgtctcagggagtgcacgtggccttctcggctgcggccgtgggctgggctgaggtaggatggctgggcggtatgtgtttgcaccgctagggagcccgccacgccaacgcacggggcgaatttca

SEQ ID NO: 54803 - DNA, 635 bp, Zea mays
  misc_feature: Ceres CLONE 1482764
  misc_feature (297)..(297): n is a, c, t, g, unknown, or other
aaagctggagctccccgcggtggcggccgctctagaactagtggatcccccgggctgcaggaattcgcacgagaccattacctagaacatcctaatcgaaaccatcaaaataggacgaagaaaatctaagaaactgaaatccaacaggggaatttccctttcggctgctgcgaaactgcagccaaccaaggagtggaggagtaggagtagcggcagtcaaagcgtggcgggcggacgggcgggcaagctggaacccattggatcggtggtatcaaggaatcggaagaggggaccggntctcccctcctcaccccgcgtccaacgtcggttcccctaatctgcgtccgcggcgtgatatgagaacggtctgtaattgctgatcggcgtgatgaattttaagccaatagttcttatcttcctcctgctcgtggccaatggtcacaatcccagtttaagtggaaaccacctttttggtggaggtgaagggaatccccacaccccccccaaaggaagccacccggccccttgaaaaggaaaaatccctttaaaaagaaaaaaaaaaattttggccaaaaaaaaaaaaaacatttccccccccctttataaagagctttttttttaaaaaaaccctctcc

SEQ ID NO: 54804 - DNA, 521 bp, Zea mays
  misc_feature: Ceres CLONE 1482787
  misc_feature (179)..(179): n is a, c, t, g, unknown, or other
  misc_feature (202)..(202): n is a, c, t, g, unknown, or other
  misc_feature (206)..(206): n is a, c, t, g, unknown, or other
  misc_feature (213)..(213): n is a, c, t, g, unknown, or other
  misc_feature (252)..(252): n is a, c, t, g, unknown, or other
  misc_feature (491)..(491): n is a, c, t, g, unknown, or other
aaagctggagctccccgcggtggcggccgctctagaactagtggatcccccgggctgcaggaattcgcacgagaccattacctagaacatcctaatcgaaaaatcgactttttatctccagatccagattagctaccacggcaccgccagcccgggcggctataaagacgaggcccatnctcgaaaatcgacggcgatgaangaangaccagntccccctcctcctgaatcgtcctgggtccctaaaaggancaagcccatggggggcccaaccccgaaaaaaaagggggggcccccccgggaaaaaggaaaaaagggccgggaaacacatttgggggaccttttttaccccccccccccgggaaaccccccccccccccccgggggagagggttttttttttttggggggggtttttccccccccccccccttttttttcggggggggggaaaaaaaaaaaaaaagaggggggggggggggggagccccntttttttttttttcttcccccaaaaaaaaa

SEQ ID NO: 54805 - DNA, 697 bp, Zea mays
  misc_feature: Ceres CLONE 1482789
  misc_feature: Encodes the peptide sequence at SEQ ID NO. 54806
aaagctggagctccccgcggtggcggccgctctagaactagtggatcccccgggctgcaggaattcgcacgagaccattacctagaacatcctaatcgaaaaacacagcctcctcttcctccagtcctcctcccacgcaccacgggcgaacaaaagcacaaaagccaacccacaccgcaccacccctactacccctgagcacccctaggaaacgacgaccgcaactacataccagccagccgacccgacccccagcagtcttgcaggctacagcccctgcggcaccagagggagcggccgcggcagggcgtcctcgtcgccgcggcagggcgctagggcaggcaggcatgcgctgatggaattcacggcccaggagggggaggagcccgtctcggaggagatgggcgcgagctccgcgcccgccgccctgctcggccccggccgcggccctggggaaccagaacacgccgccgaggcgacgtaccacgagtgtctgcacaacaaccctgcggccttgggcggaccactcctcaattgcttcggcgaagtcttgcccgaggaccccaaagggcttaagtgccccacctgggggttgccaccccattttcaccccaagggggaaccggggcgccccccccaattcctgggggcgcccccccccccgggggggtccccgggggtcccctttttctcggcc

SEQ ID NO: 54806 - protein, 114 aa, Zea mays
  misc_feature: Ceres CLONE 1482789
MEFTAQEGEEPVSEEMGASSAPAALLGPGRGPGEPEHAAEATYHECLHNNPAALGGPLLNCFGEVLPEDPKGLKCPTWGLPPHFHPKGEPGRPPQFLGAPPPPGGSPGVPFFSA

SEQ ID NO: 54807 - DNA, 681 bp, Zea mays
  misc_feature: Ceres CLONE 1482803
  misc_feature: Encodes the peptide sequence at SEQ ID NO. 54808
aaagctggagctccccgcggtggcggccgctctagaactagtggatcccccgggctgcaggaattcgcacgagaccattacctagaacatcctaatcgaaaaaacatccaaaattcccagtccgcgatacaagaccaatccaatcccagcggaagtggaagcagtttcatttccttccttgcagctagcagcgatgattcttgtggcgatagtggcggagctgctcgaggagtacaccgcgctggtggcgcgggtgctggagcagctgctcaacgacgcgccgttcccgcgccggatgcgcttcctcatgctgcggagcctccccttcgtgccgccgcctctgcccccgccgccgccgccgcacgccctccacgttaccacccgagtctgattattggctccatttttctcaggggtttcagcctactgcccgccatggccgcccacccactagcctgcgcttgaggcagctagtagtagatactgtaggttgaccagtgatccacggtgtgtttctcgctttccttttgtctgttgatttctattggctatactacacggtgctgtaaaggatcaattagttctgcctttgaggccctcatttggtgtaaatatttttgataacatggaccatggaaaaaactttcctttgacatttaaaaaaaaaaaaaaaaaagctta

SEQ ID NO: 54808 - protein, 65 aa, Zea mays; identical to SEQ ID NO: 44442
  misc_feature: Ceres CLONE 1482803

SEQ ID NO: 54809 - DNA, 686 bp, Zea mays
  misc_feature: Ceres CLONE 1482821
  misc_feature: Encodes the peptide sequence at SEQ ID NO. 54810
  misc_feature (686)..(686): n is a, c, t, g, unknown, or other
aaagctggagctccccgcggtggcggccgctctagaactagtggatcccccgggctgcaggaattcgcacgagaccattacctagaacatcctaatcgaaaaatgttactggaataaaaaacgcacgccacgtagtcacccgctcccaacgcatttccgtcttctcctccgacgagttcccccaatccgcgctgcctgagcccaccctgcctgcctcgccgcgatccctccgcgctgctcgaggctcctgtcctgaaccaatcgagaacgccgacttccggggacgggatcatctaaagccgcctccttcccgttgaatccgccgagattcggcgtgaggcgaggttaccgacttcccttgcgcgtagggccggcaggagcgcccgctggccatggcgtgccggggcttctttgagtgcgtcctcaagctcctcaacctcgtcgtcatggcggttgggctggccatggtgggctacggcgccttcctgctcgtgacctggcttcaggtcgcgccactcccgccgccttcgtcgtcgccggacgccgtgccacccagcggggagctcgtgcagctcgggaggccgctgctgctttttgttgatgcatccctgtcggatgggaccgcggagaggctctccagtgcctggtgcgtgcgtgacgactggtctcttatcttctccctgtcn

SEQ ID NO: 54810 - protein, 98 aa, Zea mays
  misc_feature: Ceres CLONE 1482821
MACRGFFECVLKLLNLVVMAVGLAMVGYGAFLLVTWLQVAPLPPPSSSPDAVPPSGELVQLGRPLLLFVDASLSDGTAERLSSAWCVRDDWSLIFSLS

SEQ ID NO: 54811 - DNA, 691 bp, Zea mays
  misc_feature: Ceres CLONE 1482824
  misc_feature: Encodes the peptide sequence at SEQ ID NO. 54812
aaagctggagctccccgcggtggcggccgctctagaactagtggatcccccgggctgcaggaattcgtacgagaccattacctagaacatcctaatcgaaaaacctccatccagctcgagccagcccgccgcctgcgcgcatctctctacacttctactgcttcatactctcgtagagagatcccgcgcggcccaataaaaacccgactcgctagctacactacacactcgcagatggccggcctcaggatgaagttcgtcgccgtcgccgccatggccgccgcgctcgtggcgtccgccgcagccgccgaggcccccgccccggcccccgcctccgacgccgcggccgccgtgcccctcgccgcggcctccctcgccgccgccgccttcggctacctcttctgctagatccgcgctgcacacgcggtttgtgcttgatttgtgattcgtctggcgcgagtggagtccgtgtcgtgcgcgtgtctgtgtgagttgtttcggcgggcgtgtgtctgtatgtatggagtctgcagcggaagaggaggtgtgcgcggggaggtacgtgcgtcgactccccaatgttggatggcgccatcatcttcctgacccctttttctgggtattcatgagacgaattatttgattaaaaaaaaaagaaaaaaaagttatcattcccctccaactcgaaggg

SEQ ID NO: 54812 - protein, 57 aa, Zea mays; identical to SEQ ID NO: 43282
  misc_feature: Ceres CLONE 1482824

SEQ ID NO: 54813 - DNA, 697 bp, Zea mays
  misc_feature: Ceres CLONE 1482825
  misc_feature: Encodes the peptide sequence at SEQ ID NO. 54814
aaagctggagctccccgcggtggcggccgctctagaactagtggatcccccgggctgcaggaattcgcacgagaccattacctagaacatcctaatcgaaaactccgaatccgccgaccgccggcgagcccctcctcctccacgacacgcgcttccccggctatcatggattcagatccatcatcacagaacccaacagatatgactgcatttgtccagaacctccttggacagatgcaaacaaggttcgagtccatgtcgcagaacattgtgtcaaagatagatgaaatgggaaccaagattgatgagctcgagcagagcatcaacgatctcaaagctgagatgggcactgagacgccggtcaagaagcctgacgagccaaagcctgctgactctgcctaacttgggtgtaacccagagattgttgagtgaagatttgatgatggtgtgacaaatttcagcagtacgtgtatcttccgatgatcgtatctgttttcatgagtcctggcagttatgtagacacgaacccatcgtatgaaagatgaatccatagtttgggctctccagacatcaacgcatgttcttagcttttctgtcatctttcggcaactatttgtttgactgttataagatgttatgcaacatctactccatttgaagtaattgtgttgtgtagagcaaaaaaaaaaaaaaaaag

SEQ ID NO: 54814 - protein, 78 aa, Zea mays
  misc_feature: Ceres CLONE 1482825
  misc_feature (10)..(63): Pfam Name: HSBP1 Pfam Description: Heat shock factor binding protein 1
MDSDPSSQNPTDMTAFVQNLLGQMQTRFESMSQNIVSKIDEMGTKIDELEQSINDLKAEMGTETPVKKPDEPKPADSA

SEQ ID NO: 54815 - DNA, 692 bp, Zea mays
  misc_feature: Ceres CLONE 1482832
  misc_feature: Encodes the peptide sequence at SEQ ID NO. 54816
aaagctggagctccccgcggtggcggccgctctagaactagtggatcccccgggctgcaggaattcgcacgagaccattacctagaacatcctaatcgaaaaatacttccggcagccatgcaccctcatgtccagcatatcgacgcagagtcgcagtcgcagcacacactgaattctctttagctagctgagagagggtagccacaccaagacaggatgcagacagcgaaggtgaaggcgaaggacatggtgagctcggcgaaggagaaggtgaaggaggggtcggcaaagatgcagggcaagacgggcgaggcgacggcggccacgcacggcgagaaggagatggccaaggaggcggcccgcgccaagaaggaccaggccaacgccgacaagcaccaggagaaggccgaccaccgagcggacgccgccactggccaccacggcacgcgcgtgcccctcaccggcccgcacggccaccacggcgctggcgcggccgtcgaccccgcgtacccgtcctccggcaacacgtacccggcgtcgggcaagtacatctaggtgactgcgtcggatgagcgaggccagggtcgtggtcgcacttgcgtttttgtgtacgtagcgaccgagaagatcgatcctggctgtacgcctgcagtaccggtaccgactggttagttatagagggtatgcggtgc

SEQ ID NO: 54816 - protein, 112 aa, Zea mays; identical to SEQ ID NO: 51101
  misc_feature: Ceres CLONE 1482832
  misc_feature (1)..(73): Pfam Name: LEA_1 Pfam Description: Late embryogenesis abundant (LEA) group 1

SEQ ID NO: 54817 - DNA, 706 bp, Zea mays
  misc_feature: Ceres CLONE 1482834
  misc_feature: Encodes the peptide sequence at SEQ ID NO. 54818
  misc_feature (416)..(416): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (491)..(491): n is a, c, t, g, unknown, or other
  misc_feature (510)..(510): n is a, c, t, g, unknown, or other
ctggagctccccgcggtggcggccgctctagaactagtggatcccccgggctgcaggaattcgcacgagaccattacctagaacatcctaatcgaaaaaactttaaatacattaatttgaatgcagctttcacgtaccagcccggcaacgactcggtgctcctggtcgacaagaggtcctacgacgcctgcgacacgggctcgccgaccgacaccttcgccgacggcagcaccgtgttcaccttcacccgctccggccccttctacttcatcagcggcaacaaggacaactgcgaccgcggcgagaagctgatcgtcgtcgtcatggccgagcgcgcggccgtcggcaacgccaccgagccgggcgcggggctggcgccgtccccccagcgcccgttctcgtccttctctccgccngcaccctttcgcatcgacatctcgccgacggcgccgtatccccgcgcaaaaagcgcgnnngcgccaaggtggcancaagagttgcccgcccccnccccgtttgccatcggaaccttgttcaccccgctggtttgaaatcccccggttttgtttttccaaaatgtcccgggggccatccccccaaaggggaggggaataacacccccggttgggtttaacaacttgggccaaatttaaccggggttttccccacggggggaaaaaaaggtgttttaaacaaataaaagggc

SEQ ID NO: 54818 - protein, 182 aa, Zea mays
  misc_feature: Ceres CLONE 1482834
  misc_feature (38)..(101): Pfam Name: Cu_bind_like Pfam Description: Plastocyanin-like domain
  misc_feature (158)..(158): Xaa is any aa, unknown, or other
  misc_feature (163)..(163): Xaa is any aa, unknown, or other
  misc_feature (170)..(170): Xaa is any aa, unknown, or other
GAPRGGGRSRTSGSPGLQEFARDHYLEHPNRKNFKYINLNAAFTYQPGNDSVLLVDKRSYDACDTGSPTDTFADGSTVFTFTRSGPFYFISGNKDNCDRGEKLIVVVMAERAAVGNATEPGAGLAPSPQRPFSSFSPPAPFRIDISPTAPYPRAKSAXAPRWXQELPAPXPFAIGTLFTPLV

SEQ ID NO: 54819 - DNA, 684 bp, Zea mays
  misc_feature: Ceres CLONE 1482855
  misc_feature: Encodes the peptide sequence at SEQ ID NO. 54820
aaagctggagctccccgcggtggcggccgctctagaactagtggatcccccgggctgcaggaattcgcacgagaccattacctagaacatcctaatcgaaaaaaagagcttcgagaggattcaccgcagcaatcttgctggcatgggaatcatccctctatgctacaaagcaggggaggatgcagacagcctgggcctaaccggccatgagcgctacacggtccaccttccaaccaatgtgagtgagatcaagcctggccaagatgttaccgtgacaactgataatggaaagtcgttcacttgcacactcagattcgacactgaggtatgattgttcttttcaatgcataaatcgctgatgctgtctattgatgttttcgttactgatcaccttcacctccaggtggagcttgcttactacgatcatggtggcattctaccatatgtcgctagaaagatagcggaacaatagattgtaccgtcgagatggttgcgatgcttgcggtgaatcgtaattggtgtaaacggtttgtttagtagtacaacccatttttgcggactacttataataacctctgagtatctcagagtgagctgtctgaaatttgatgaactgctacaattctggtgcgccatgaggatgggatccttttgccttctatgttaataatatgctaacttctg

SEQ ID NO: 54820 - protein, 62 aa, Zea mays
  misc_feature: Ceres CLONE 1482855
  misc_feature: SWISSPROT Homolog: EC 4.2.1.3 Aconitate hydratase
MGIIPLCYKAGEDADSLGLTGHERYTVHLPTNVSEIKPGQDVTVTTDNGKSFTCTLRFDTEV

SEQ ID NO: 54821 - DNA, 675 bp, Zea mays
  misc_feature: Ceres CLONE 1482859
  misc_feature: Translation starting site: 213
tccccgcggtggcggccgctctattcctagtggatcccccgggctgcaggaattcgcacgagaccattacctagaacatcctaatcgaaaagaaccacttcacagaagtgctttaccctcacccgcacccgccccacgcgcggtaggttcgttcgtcacagtcacagaccagtcgtttctcccttctctcccccgggcccggagaggagaggatggccggccggagcagcctctccatggtcgcgtcgcaccggctgttcacgccggtcaacccagtgggcggcgccgaccacggcgtggagctcgacgaggccgacgtcatctggggcggcggcggcggatacccggcgtcgtcctcaccgtcgtcgtcgccgttcctgtcctccgcggtcgacccgtacgcgcggtcgccgccggtggccgcgccgtccaagcagaagccgcgtggggtggtggccggcgctccggggccggcgtcggtgcccgtcaacatcccggactggtccaagatcctgggcgccgagtacgcctggagcgagtgggcggcgcacgacgaccgcgcggacgacgacgacgcggcctgctgcggcggcggcgccgggggccggcactgggtgccgccccacgaggtgctgcaagagcgggagcgcccggcggcttccttctccgtgcgcg

SEQ ID NO: 54822 - DNA, 645 bp, Zea mays
  misc_feature: Ceres CLONE 1482918
  misc_feature: Encodes the peptide sequence at SEQ ID NO. 54823
  misc_feature (52)..(52): n is a, c, t, g, unknown, or other
  misc_feature (506)..(506): n is a, c, t, g, unknown, or other
aaagctggagctccccgcggtggcggccgctctagaactagtggatcccccngggctgcaggaattcgcacgagaccattacctagaacatcctaatcgaaaaatagtaattcacatgttcagatgcggatatggatgcactgggagaacaccattcagcaagagggcagctctgctcccaagatgatcgcccgtgtgcagaaaatcaggttcatccaggaccggtgtaaggggtacgagaaggccgcctgggttataatatggctgcgttctttcttcaaacagttctacggatcagtgtccaacgacgactacattgcgatgagactcggtttcgtcatggagcactttagggggcaccccaagttcaacttttacgactacatgatcaaagctctcgagaaagatttcaagcgagtagttagtataaaatggtattactggatttttgtgatgatctttctgctgctcaatgtcaccgggtggcactcctacttctggatctncatagtccactggctctgctgcttctgattgggacgaagctggagcacatcataaacaggctgggctacgaagtggcctcgaagcacgccgccgggcaaggcgaagggggcatcgtggtgaagccttcggacgagctgt

SEQ ID NO: 54823 - protein, 136 aa, Zea mays
  misc_feature: Ceres CLONE 1482918
  misc_feature (128)..(128): Xaa is any aa, unknown, or other
MRIWMHWENTIQQEGSSAPKMIARVQKIRFIQDRCKGYEKAAWVIIWLRSFFKQFYGSVSNDDYIAMRLGFVMEHFRGHPKFNFYDYMIKALEKDFKRVVSIKWYYWIFVMIFLLLNVTGWHSYFWIXIVHWLCCF

SEQ ID NO: 54824 - DNA, 688 bp, Zea mays
  misc_feature: Ceres CLONE 1482925
  misc_feature: Encodes the peptide sequence at SEQ ID NO. 54825
aagctggagctccccgcggtggcggccgctctagaactagtggatcccccgggctgcaggaattcgcacgagaccattacctagaacatcctaatcgaaaagctcgattcggccgttttccgcatccacggtgccaggcgaccgccgccgcttccctactcacccttggccggcgacgacgagcgcccactacggcaggatgacgacgctcaggaacctcaagatcaagacgtcgacgtgcaagagaatcgtgaaggagctgcgctcgtacgagaaggaggtggagaaggaggctgccaagaccgccgacatgaaggagaagggcgccgatccctacgacctcaaacagcaggagaatgttttggctgagtcaaggatgatggtcccagactgccacaaacgacttgaaactgcactggctgacttgaaagcaacactggctgaactgaaggagtcaaatgagcaaggtgccgagattggagaagctgagagtacaatcgcagaagttgaagcagttgtcaagccagcagaagattaaactaaaaaaaactcttggtttgctgaactgttagcgcacatcctattttctcatattcagcccttgtgagcttattacgatatgtttgaggcgtcaaatcctgtaccattatcatcacttctgtcttgaaatttgagttttatgttccca

SEQ ID NO: 54825 - protein, 112 aa, Zea mays
  misc_feature: Ceres CLONE 1482925
  misc_feature (6)..(99): Pfam Name: TBCA Pfam Description: Tubulin binding cofactor A
MTTLRNLKIKTSTCKRIVKELRSYEKEVEKEAAKTADMKEKGADPYDLKQQENVLAESRMMVPDCHKRLETALADLKATLAELKESNEQGAEIGEAESTIAEVEAVVKPAED

SEQ ID NO: 54826 - DNA, 693 bp, Zea mays
  misc_feature: Ceres CLONE 1482932
  misc_feature: Encodes the peptide sequence at SEQ ID NO. 54827
aaagctggagctccccgcggtggcggccgctctagaactagtggatcccccgggctgcaggaattcgcacgagaccattacctagaacatcctaatcgaaaaatacggcataccacactagagccgccgccgccgccgtttcgcgcaccgtaccctagccctcgtcagcggcggcttcgagctcatccagccatgacgttcaagcggaggaatggcggacgcaacaagcacgggcgcggccacgtcaagtacatccgctgctccaactgcgccaagtgctgccccaaggataaggctatcaagcggttcttggtgaggaacattgttgagcaggctgccgtgagagatgtgcaggaggcctgtgtacatgatggatatgttctacccaaattgtatgcaaaggttcatcactgtgtctcatgtgcaatccatgcgcacattgtccgggtccgctctcgtgagaacaggaggaaccgtgagcccccgcagcgcttcagacgccgggatgatggcccaaggcctggtcagggcccgccgcgcccaggcggtgcagctcctgcagctgcagctgctgctgctcctcgtacctaagttctggaattagtttcggggcttagttttgtgaaacattacctgttttgagaaaccattgttactgtatccccttgatgtcaaactttttagcacaatttg

SEQ ID NO: 54827 - protein, 132 aa, Zea mays; identical to SEQ ID NO: 6773
  misc_feature: Ceres CLONE 1482932
  misc_feature (1)..(114): Pfam Name: Ribosomal_S26e Pfam Description: Ribosomal protein S26e

SEQ ID NO: 54828 - DNA, 702 bp, Zea mays
  misc_feature: Ceres CLONE 1482948
  misc_feature: Encodes the peptide sequence at SEQ ID NO. 54829
atagctggagctcaccgcggtggcggccgctctagaactagtggatcccccgggctgcaggaattcgcacgagaccattacctagaacatcctaatcgaaaaatatacgccgccatcttcgcaagccaccgcaaccgaagcccgccttcgccgccgctgcctctgcgatccccgcaaggtcgcaaacatgtctaccgtgctccagcgcccgacccccggcacggtccagtgcttcggccgcaagaagacggctgtggccgtcgcctacaccaagccggggcgcgggctgatcaaggtgaacggcgtcccgattgagctcatcaggccggagatgctccgcctcaaggccttcgagcccatcctgctggcggggcgctccaggttcaaggacatcgacatgaggatccgcgtccgaggcggcgggaagacgtcgcagatctacgccatccgccaggccgtcgccaaggggctcgtcgcctactaccagaagtacgtcgacgaggccgccaagaaggaggtcaaggacatcttcacccggtacgaccgcacccttctcgtcgccgaccccaggcgctgcgagccgaaaaagttcggtggtcgtggcccccgcccccagttccagaagtcctacccgttgagcgctccgctgccccccccttgccggaaccttgcctgtgttgtcccaccctgccagttcgatgc

SEQ ID NO: 54829 - protein, 171 aa, Zea mays
  misc_feature: Ceres CLONE 1482948
  misc_feature (17)..(149): Pfam Name: Ribosomal_S9 Pfam Description: Ribosomal protein S9/S16
MSTVLQRPTPGTVQCFGRKKTAVAVAYTKPGRGLIKVNGVPIELIRPEMLRLKAFEPILLAGRSRFKDIDMRIRVRGGGKTSQIYAIRQAVAKGLVAYYQKYVDEAAKKEVKDIFTRYDRTLLVADPRRCEPKKFGGRGPRPQFQKSYPLSAPLPPPCRNLACVVPPCQFD

SEQ ID NO: 54830 - DNA, 694 bp, Zea mays
  misc_feature: Ceres CLONE 1482958
  misc_feature: Encodes the peptide sequence at SEQ ID NO. 54831
  misc_feature (516)..(516): n is a, c, t, g, unknown, or other
caaagctggagctccccgcggtggcggccgctctagaactagtggatcccccgggctgcaggaattcgcacgagaccattacctagaacatcctaatcgaaaaattatcctccctttgattgtttcatacgcttcgctgatctcacccccttggaagcaacactcgatgaccgattgatacaatgcgtcttgtatccaaactgccgccgactccgccgccggtgccgggcgcactcatcatgctgcacgtgtacgatggcgaggagatcctgcacacgctcatctggtgcctcaccaacatcatctcccctgtgagaggcaaccttctggtacacgtccatgcccgtggcactcgtcaggtctacgccaccatgctacagctcaggaacatgatcacctcggacgtgctggaaactgtcgagagttacgtcaacgctttcttagaagacgcgagtcgactatgccaatcgcgctctgcgcggtccaacctcacgctaaggtcctacaccatggcangaagacgcagagccacagagacgtcatctacgacgccaccatcaagatggccttagacctgttcgtcaaggacattcatggttacggctccatcgcaggtctctctttggaatattctgcagtcaatgcgctgatatctgctcatgtgctgtactcatgttatacgctctatcatcaa

SEQ ID NO: 54831 - protein, 110 aa, Zea mays
  misc_feature: Ceres CLONE 1482958
  misc_feature (93)..(93): Xaa is any aa, unknown, or other
MLHVYDGEEILHTLIWCLTNIISPVRGNLLVHVHARGTRQVYATMLQLRNMITSDVLETVESYVNAFLEDASRLCQSRSARSNLTLRSYTMAXRRRATETSSTTPPSRWP

SEQ ID NO: 54832 - DNA, 890 bp, Zea mays
  misc_feature: Ceres CLONE 1482958-R
  misc_feature (1)..(1): n is a, c, t, g, unknown, or other
naacgtttttcactcgaatctagttgttgagctaggtaagggaagacacagcactgcaatgggatgtgaagtgtgtacatatatgcttatatagtcgcccctgaaagattattggctcagctgcggcgtacatgcaaggagactttctactccttgggcctcttgacaatgaggaccgggcatttgcagttctgcgcgcagtggttgctgacgctgcccaagaacgccctctggatgaagccgtaaccatagatgcccatgacgagcaggtccgccgccatcatggtggcggcgtcgcagatgacgtcccgcgggtccccgctctccaccatcatctataccttgacgtgcaggtggcccacgcacaagcgcttggccttgtagatcgccgatgacaacaccgcgtgggcgcgcctctatacggtcgtcagctgatgcgaggttatcaggaaccctgcggtgccgatggcggaatacaccgggcgccggagacgatggttgacgagcaccagcgagtagcctcctgccgggaagactacgttcgcgagacatccgttgagcgcgtgcaggctcacctcgtcgacatccatagtcaccatgatgctgttccaggaaccaggtacagcgacagcgctcgtgtccatacgagaggcactgggatcactcggagaactatcgttgcttgcaccgggggtgaagcacccagaaatgggttacaacttttcgatcgggatgctgcggcctttcgactagaaaaagttctccggtaaataggttctcctggcgaaatacgcggcctaccccccgtgggaatctctcaggggttaaaagagggggccgcgacaccttaagagtggagagacaaccaaggggttttgctccaccatgta

SEQ ID NO: 54833 - DNA, 694 bp, Zea mays
  misc_feature: Ceres CLONE 1482967
  misc_feature: Encodes the peptide sequence at SEQ ID NO. 54834
  misc_feature (421)..(421): n is a, c, t, g, unknown, or other
  misc_feature (422)..(422): n is a, c, t, g, unknown, or other
caaagctggagctccccgcggtggcggccgctctagaactagtggatcccccgggctgcaggaattcgcacgagaccattacctagaacatcctaatcgaaaaaccaaagatttactcaatttatcccagacgagacacacactcgcaacgaccggaccgtcgaatctctcgactccggcgacatgtcgacggcggtggcagaggtgcggccgccctacgggttccccggatccgggaaggggagcggcggcgggtatgggaaggaggcgcacttgggccgcggccgggaagaggaggagcgacggcttcttcatagaggaggaggaggttgaagaagacgtgctgactgacaactcgtcgatcggggcaccgtctccctcgggatcgtcgaccggtgagaactcgtcgtcggaggccgcnnggggacgacgggggaggaggaggtcgagagcaagctcaagtagggtgatgtgctcggctgcttggacgcgctcgaggactccttgccgatcaagaagggcctctcgagcttctaccccggcaagtctaagtcgttcaccagcctcgccgaggccacggcggcggcggcggcggtcaaggaggtgctggccaagccggagaagcccttcaacaagcgccgccgcatcctggccaactggtccaggcgagcctcctgcagctcgctggccacgg

SEQ ID NO: 54834 - protein, 146 aa, Zea mays
  misc_feature: Ceres CLONE 1482967
  misc_feature (56)..(56): Xaa is any aa, unknown, or other
MGRRRTWAAAGKRRSDGFFIEEEEVEEDVLTDNSSIGAPSPSGSSTGENSSSEAAXGRRGRRRSRASSSRVMCSAAWTRSRTPCRSRRASRASTPASLSRSPASPRPRRRRRRSRRCWPSRRSPSTSAAASWPTGPGEPPAARWPR

SEQ ID NO: 54835 - DNA, 692 bp, Zea mays
  misc_feature: Ceres CLONE 1482979
  misc_feature: Encodes the peptide sequence at SEQ ID NO. 54836
aagctggagctccccgcggtggcggccgctctagaactagtggatcccccgggctgcaggaattcgcacgagaccattacctagaacatcctaatcgaaaagcggtcatccgtcaggtcagggtcagcagcattctcccttccaaatgccgtcctccccgtggcctcccgctgccggagcgccgccgccgcagcagcgagcggcgcagggcacggtctccaccgtggcgccggagcgtctacccgtcgagggttcccgatctgggccagcgaaggaggaggacacggctcggcttccgtctgtcgactactactcagagctaaagaccctggagcatgcatagaaaaccaaaaaatatcagggtaagcttgcagcacggttgaaggccaaatatttttccaacaagacttttgaagaaggatatgtgtttgaagaaattgttatagaatcaaagaccgtccggttaagcaggtggccgtttacaaggttgtttgcagatccagcaagattttgccgagaaaagagctctactgagaagggcatttctcgacctctggctggtgaagccatgccagatgactaggcacctcattaatatctgactcctggcatgtggcaactatccatcatgaccacccgacagataagaaccatagtttgcgtcactaacctgtatctgttatccttaaaat

SEQ ID NO: 54836 - protein, 65 aa, Zea mays
  misc_feature: Ceres CLONE 1482979
MPSSPWPPAAGAPPPQQRAAQGTVSTVAPERLPVEGSRSGPAKEEDTARLPSVDYYSELKTLEHA

SEQ ID NO: 54837 - DNA, 688 bp, Zea mays
  misc_feature: Ceres CLONE 1483002
  misc_feature: Encodes the peptide sequence at SEQ ID NO. 54838
aaagctggagctccccgcggtggcggccgctctagaactagtggatcccccgggctgcaggaattcggcacgagaccattacctagaacatcctaatcgaaaaacaaactcatccacagcttcccgactttgtctgttctgcttcgctcgcgggcgctcatctccactcctccgatggcgccgccacccaccagcccctcattcctccgcccgccgccgctgccacaccacccgcaccctcgcctccttttgcgacctccctccgcctctttccgcgtcgccgaaatactcggcggtcggggcctctgcaatggtgaggtcggcgtccgcaaagaactcgcatccgactccaccacctcctcgcccgcgccctctcctcctccttcgacagattctcctccgcccgcggttgatccggacgcgttcgagaaggagatgatgggcctcacaggcggcttccctggcggtgaggtcggcctcaaggacttcgtagccaagaacccgcctcctcccaagaaatcagaatcccagccccaagccacgctctccgcgccgccgcggccgccggagctgccgctgttcttgcccggcatggtggtgctggtcaagaaccccaacaacgcctaccacatgtactgcggtatcgtgcagcgcgtcagcgacggcaaggtcgcggtgctcttcgagg

SEQ ID NO: 54838 - protein, 171 aa, Zea mays
  misc_feature: Ceres CLONE 1483002
MAPPPTSPSFLRPPPLPHHPHPRLLLRPPSASFRVAEILGGRGLCNGEVGVRKELASDSTTSSPAPSPPPSTDSPPPAVDPDAFEKEMMGLTGGFPGGEVGLKDFVAKNPPPPKKSESQPQATLSAPPRPPELPLFLPGMVVLVKNPNNAYHMYCGIVQRVSDGKVAVLFE

SEQ ID NO: 54839 - DNA, 687 bp, Zea mays
  misc_feature: Ceres CLONE 1483005
  misc_feature: Encodes the peptide sequence at SEQ ID NO. 54840
aaagctggagctccccgcggtggcggccgctctagaactagtggatcccccgggctgcaggaattcgcacgagaccattacctagaacatcctaatcgaaaaaagacgataaaatgttatcttctacctccttagctgctcttatacatggccgcccccattatcctttccctgcgtcgaaagcgcatcttttcctagctctccccaacaaccctacccgtttcctggcctccgcctccacccgggtcgactatgctccccagtggcctctccgcgcctccgacggagagcgggacaacctcgtgcacgagctgacggtgcccgattcttcgctgacgcctgcaggagcagcgcacgaatctcaatggctcagggagacactgtacaagtcgctcgacgacgagtactgctcggagccggccaacttggacatcagcagcaccgccgcgcggtcgtatcccgaatccctgatagagcggcagtctaatccgggagagatctcgctgacgatggtgagccacctggacaagctgtcgtacagggagagctcccacggcaccttctcggccggcaacgctgaaatccgttttgtcgctcagaagatggaggacgccctgcctcatgaatgagggtagtgcccgacctcgagtttctatatggcacgactttttgtgaacccctaggcta

SEQ ID NO: 54840 - protein, 171 aa, Zea mays
  misc_feature: Ceres CLONE 1483005
MLSSTSLAALIHGRPHYPFPASKAHLFLALPNNPTRFLASASTRVDYAPQWPLRASDGERDNLVHELTVPDSSLTPAGAAHESQWLRETLYKSLDDEYCSEPANLDISSTAARSYPESLIERQSNPGEISLTMVSHLDKLSYRESSHGTFSAGNAEIRFVAQKMEDALPHE

SEQ ID NO: 54841 - DNA, 691 bp, Zea mays
  misc_feature: Ceres CLONE 1483029
  misc_feature: Encodes the peptide sequence at SEQ ID NO. 54842
aagctggagctccccgcggtggcggccgctctagaactagtggatcccccgggctgcaggaattcgcacgagaccattacctagaacatcctaatcgaaaaatcttcgcttctgactccgctgggccaccagctttgaccggcgcgctgccttgccctccgctactgatcctgccgaccccactcccccgcaggatcggcggccgcggccgcgaggtcggacccgacatccgcgagcggcggcggcaacgacggaggcaaccgcaagatgttcgggcgcgcgccgaacaatagcgactccaccaagtactacgagatcctcggcgtgcccaactcggcgtcccacgacgatctcaagaaggcctaccgcaaggctgctgtcaagaaccaccccgacaagggcggtgaccccgagaagttccaggagctcgcacaagcctatgaagatttgagtgatccacagaaacgtcagatttaagatcagtatggtgaagatgccctcaaggaacgaatgggcggaggaggatcccctgatgatccattcgacatcttcacatcattttctggaccctcttttggaggagctggtggaaacagcacgtgaagaaggctaaggaggggataagatgtagttcacccacttacagtttctgctggagatctttacgacggcagctcacagaagctctctc

SEQ ID NO: 54842 - protein, 69 aa, Zea mays
  misc_feature: Ceres CLONE 1483029
  misc_feature (13)..(70): Pfam Name: DnaJ Pfam Description: DnaJ domain
MFGRAPNNSDSTKYYEILGVPNSASHDDLKKAYRKAAVKNHPDKGGDPEKFQELAQAYEDLSDPQKRQI

SEQ ID NO: 54843 - DNA, 760 bp, Zea mays
  misc_feature: Ceres CLONE 1483071
  misc_feature: Encodes the peptide sequence at SEQ ID NO. 54844
ctagctggagctcaccgcggtggcggccgctctagaactagtggatcccccgggctgcaggaattcgcacgagaccattacctagaacatcctaatcgaaaaaattcaggctatcatccagtcatcccatcagcaggaggcggggagagtgacttggccgtggcccgtgggggggagagtgagagctgccaaggatcgcatcgaaggaagctaggagatcatccagccgccggcaagaaattaggcagcagcagtacgtcgaggaagatgtgcatggaccgagctgccgtgccggtgaagagggtctggctcggcatcgccgcgcgcctcggcctccgccgaaagaccggcctggggaagctgcggaaggatgtgcggatgtgtgattaccgcgacgttgcacgtcatgtgggagatgcttcccccccacagaccggcatggtgctcgctggcggtaaaaaggagggctgcctccgatcccggccgcccgtccgcccccgggaagccgaaagaaacgcgggggagggggcttcggttcaattactggctggcgcgtttctgaggatagaattaagcctggcctggtggaatcctaacctcggcttaatacctccctgtgagaaatcccaaaggttgggcgaagggattattgaaacttcccccccgcgaaccaaaaaaatatcttcttatccgcgtaaacccggaggtttgttccgtccctcccattccacgcgataacacctaaaaagccacccaaaca

SEQ ID NO: 54844 - protein, 156 aa, Zea mays
  misc_feature: Ceres CLONE 1483071
MCMDRAAVPVKRVWLGIAARLGLRRKTGLGKLRKDVRMCDYRDVARHVGDASPPQTGMVLAGGKKEGCLRSRPPVRPREAERNAGEGASVQLLAGAFLRIELSLAWWNPNLGLIPPCEKSQRLGEGIIETSPPRTKKISSYPRKPGGLFRPSHSTR

SEQ ID NO: 54845 - DNA, 659 bp, Zea mays
  misc_feature: Ceres CLONE 1483073
  misc_feature: Encodes the peptide sequence at SEQ ID NO. 54846
  misc_feature (387)..(387): n is a, c, t, g, unknown, or other
aaagctggagctccccgcggtggcggccgctctagaactagtggatcccccgggctgcaggaattcgcacgagaccattacctagaacatcctaatcgaaaactgaagtgcctgccaccacgccgcgccgcgcccgcgatacaacgacttcctgcagtcctgcgctgcgcccctcctttccgcctccacgctgccgacgtccaccacacagcacggtcgagtcacccgatccctccatggcggcggcggtggcggcggtcgcggctgccacgacggcggaggacgaggcgcgcctgctgcgtctggaggagcaggcggagcacggcggcggcggcgcctgggactacctctgcctcgcccgccggctccgcgcccgcccgcccgccnacgtctccgcgtcgggctcgctctcctcacaaaacgctcgctcgctccggtctcgcctcagaacagtggacgctctacgagcaggtggcccacgcggcatggattgcagcgtctcgatgtggcaaagactgtattggagtctttcaaagcatttctggcaccaccggttgccggctaaacctcctctgttgaagcaaaagtgatggcctaacctgaaaaactaccccaattctgaaatcacctttgaaccattgcccaaaagaaattgcttg

SEQ ID NO: 54846 - protein, 117 aa, Zea mays
  misc_feature: Ceres CLONE 1483073
  misc_feature (51)..(51): Xaa is any aa, unknown, or other
MAAAVAAVAAATTAEDEARLLRLEEQAEHGGGGAWDYLCLARRLRARPPAXVSASGSLSSQNARSLRSRLRTVDALRAGGPRGMDCSVSMWQRLYWSLSKHFWHHRLPAKPPLLKQK

SEQ ID NO: 54847 - DNA, 676 bp, Zea mays
  misc_feature: Ceres CLONE 1483075
  misc_feature: Encodes the peptide sequence at SEQ ID NO. 54848
aaaagctggagctccccgcggtggcggccgctctagaactagtggatcccccgggctgcaggaattcgcacgagaccattacctagaacatcctaatcgaaaacaattaatggtcatccaatctctgaaaaagcccttaagaaggcagagaagaaagctggtcctgttgacccaggtacatattggtacgactaccatgctggtttttggggtgtcatgggacgggaatgtattggcattgtccctccatttattagagaatttaattatccgatggccaaaaattgtgccggtggggatacaggtgtttttgtcaatggcagagaactgcatcaaagagatttagatttacttgtaggaagaggactaccacggacatctggcatgtcatattctattgagatgtcaggcaatgtaatcgatgaagcaactgggaaaaaactgcgcagtcttggaaaacttgctcctacgattgagaagttgaagcgtggttttggcatgcacgtccctgaagagttcagataagctggttctagtgctgaatattggctttgccaattatccactccacaaggctgaccatggggtgccaaaccaacgatttctgcgattgtgatgttaaatcctgcgatagtgatgttaaatcgcatgcttctctgaattggactggggctct

SEQ ID NO: 54848 - protein, 102 aa, Zea mays
  misc_feature: Ceres CLONE 1483075
MGRECIGIVPPFIREFNYPMAKNCAGGDTGVFVNGRELHQRDLDLLVGRGLPRTSGMSYSIEMSGNVIDEATGKKLRSLGKLAPTIEKLKRGFGMHVPEEFR

SEQ ID NO: 54849 - DNA, 702 bp, Zea mays
  misc_feature: Ceres CLONE 1483095
  misc_feature: Encodes the peptide sequence at SEQ ID NO. 54850
  misc_feature (1)..(1): n is a, c, t, g, unknown, or other
nagagctggagctccccgcggtggcggccgctctagaactagtggatcccccgggctgcaggaattcgcacgagaccattacctagaacatcctaatcgaaaaaaccaaacagcgagcgcaaggaagaaaggtcgaagcgtcgtctctctcggcacggagcctagtgcccggcctcgtgagatccgaaattcagaatcgaggatggcgacgaccgcgactaggcggtggtggaggcggcacgacggcggcgacgatgacccagacgacctcgtccccatggacacccaagagcaagaagagctggtccggtctctggaggctaagcaggcgcagcaaggccgccgttggaggcgcgtcttcgcggggttcctcctaggttacgcggccttccttgtctactccagtttccatcatgcttggtctccctgggagctgcggtaccatgcttacttcatggaagatttgcctgtaccaatggtcataattgcagattggatagctgctctagcatgcctatttgctgtgaaaggattactacagaattcaggcccatcaaagaagtggatgtggtattcttgctatgttggcattttggtagccatcttttggacatactacatcttgaggttgccaagaattcgatgggatgttgcatggctcccactcggtcctttgatggctggtgcattgagcctgtatgg

SEQ ID NO: 54850 - protein, 166 aa, Zea mays
  misc_feature: Ceres CLONE 1483095
MATTATRRWWRRHDGGDDDPDDLVPMDTQEQEELVRSLEAKQAQQGRRWRRVFAGFLLGYAAFLVYSSFHHAWSPWELRYHAYFMEDLPVPMVIIADWIAALACLFAVKGLLQNSGPSKKWMWYSCYVGILVAIFWTYYILRLPRIRWDVAWLPLGPLMAGALSLY

SEQ ID NO: 54851 - DNA, 701 bp, Zea mays
  misc_feature: Ceres CLONE 1483103
  misc_feature: Encodes the peptide sequence at SEQ ID NO. 54852
  misc_feature (701)..(701): n is a, c, t, g, unknown, or other
aaagctggagctccccgcggtggcggccgctctagaactagtggatcccccgggctgcaggaattcgcacgagaccattacctagaacatcctaatcgaaaatgttcggcttcgtcagcttcgtctacgccgagacggtgaggatcatcctgtgcaagggaaacccgcacttcgtgtgcgacgcgcgcgtgctcgtgaagccctacaaggagaagggcaaggtccccgacaggttcaggaagctgcagcacccgcacctcggcgacttcgccggctgcacgtcgcccaccggattgctggattccagggaccccttcgatctgcagcagccacagatcggaccaaggatgatgtacggggtcgggaacatcgccaaccacgaggcgttcctgaggaggaagctcgaagagcagcagcaggccatcgagctggagggccgccgcttcatggggctgcatctcctcgacctcaagatcaggggccaccacctcggttcctcccccgccacgaccgtcgtggcgcaaggcgagggcggcaagggcaatggcaatggcaatgccttccagctggaggatgtcatcgtccaagatactcctacgaagatgaacagtaacagcgttgcaatgagtgcgcctgcagctgctgtatctgctgcagccgatgcagggagcgagcacgaggagcagcaggaagcagggccn

SEQ ID NO: 54852 - protein, 200 aa, Zea mays
  misc_feature: Ceres CLONE 1483103
MFGFVSFVYAETVRIILCKGNPHFVCDARVLVKPYKEKGKVPDRFRKLQHPHLGDFAGCTSPTGLLDSRDPFDLQQPQIGPRMMYGVGNIANHEAFLRRKLEEQQQAIELEGRRFMGLHLLDLKIRGHHLGSSPATTVVAQGEGGKGNGNGNAFQLEDVIVQDTPTKMNSNSVAMSAPAAAVSAAADAGSEHEEQQEAGP

SEQ ID NO: 54853 - DNA, 664 bp, Zea mays
  misc_feature: Ceres CLONE 1483316
  misc_feature: Encodes the peptide sequence at SEQ ID NO. 54854
tctttcctagtggatcccccgggctgcaggatgccgcacgagaccattacctagaacatcctaatcgaaaaagattgcaagtccgtatgtcgccaacatgaaccaccaggaccagcccgtccgcaccggcaacgtctacccaccgacggccgtcaagcgagaggcgaggcacgagcgggacaagatcattgaacaaggagatcagctgggcggcgccctccacgtcgaccagacagatcttcccgccggcagacgtatggtcaccgccagcgcaggcggccaggtgatggcacagttcaccgtgcccgtgccgggcaccaaggtcgcggagtgttattgatgcggtcaccctcggcgaggccctccatgcggcggtgcagacgtcggcgggcgacaagccggtgggcctcgccgacgctgcggcgctgcaagccgcggaggcgcgcgcgacggggctgggcggcaacgtccgcggcgagcgtggcggccgccgagcagcaggccgcggagacgaacgcgaagccagcggatgacggaggcggtggcaaccgggtgacgctcagggacaagctggtgggcgacgccgctgcggccatggccgccgacaaggcggcctcgagagaggacgcctcataaggtggcggctggcgccgccaagaaatag

SEQ ID NO: 54854 - protein, 80 aa, Zea mays
  misc_feature: Ceres CLONE 1483316
MNHQDQPVRTGNVYPPTAVKREARHERDKIIEQGDQLGGALHVDQTDLPAGRRMVTASAGGQVMAQFTVPVPGTKVAECY

SEQ ID NO: 54855 - DNA, 680 bp, Zea mays
  misc_feature: Ceres CLONE 1483322
  misc_feature (36)..(36): n is a, c, t, g, unknown, or other
  misc_feature (302)..(302): n is a, c, t, g, unknown, or other
  misc_feature (389)..(389): n is a, c, t, g, unknown, or other
  misc_feature (396)..(396): n is a, c, t, g, unknown, or other
  misc_feature (402)..(402): n is a, c, t, g, unknown, or other
  misc_feature (435)..(435): n is a, c, t, g, unknown, or other
  misc_feature (646)..(646): n is a, c, t, g, unknown, or other
tccccgcggtggcggccgctctagaactagtggatntcttgggctgcaggaattcgcacgagaccattacctagaacatcctaatcgaaaaatcctactgctggacatctaagggcccacctgaaaaaacccttgcgccgctgagctgagtctccttcctttctcccgtcgcctccgcctccgccttcagtttagcctccaagcaggggcgccgcgcggggtattctgtccgtcgttgagggtagagagtcacttgcaccgggggagcggagatgaagccggctgtggggatcgtggtgtcnaacaagatgcttttgtcggtggtggttgcagtggaccgtctcttcctttttttgtccccccccgcgggggggggggggggggccaanttcatgncccccnaccattactactcctgcaaaattgaaaacccgntttgggtgggtggggctgggcccttgacccaacccaacccttgggtgtttcctgaattcccccgcccagctaagggtacccttccccccctgccaacccctcccgggaaccgtgggagcaattttcaaaaagtggggggggcgccccgacggtccctctgcagttccccccgacgccgcggtcggcgggggctgggtttctctccgttgcntcgtgcgggtccctcgcggacatcggctgccatc

SEQ ID NO: 54856 - DNA, 703 bp, Zea mays
  misc_feature: Ceres CLONE 1483327
aaagctggagctccccgcggtggcggccgctctagaactagtggatcccccgggctgcaggaattcgcacgagaccattacctagaacatcctaatcgaaaaatctcgctccatcatatatcttgaggtcgactctatgattctagacagtagctggttagctttctggaacattttggactccataacatcaaaatccagggggggtccaagcacaaaatgcaatggacagtagagcggatttaagggccttgacggtgccgccgttctggacgtcgtgtccgtcaaagtggtggccttggccaaggtaatcgcgttgaaccacgtctccctttccgccgctgggtcaacaccctatcaggcgccgtaccgatctgacttgatgaggcctgcgtgactcggagtgaccaatgaaaactgcaagcgtcaatattttgttcaaattacatgtattatttgtagtgaatatacatcattactataaccagtgagattagatcggtagattccctgtactaaatccaaataatagaccgatatagggtcgatggtggatgcagggtgtaaatagcatgcactattgaagaacgtgtaatctcatctccaacgtggaaatagcacttagcaaggtgatggcgcactacgagaacgatcctgctaaggaagatttttggggtcgaagtgccccaaagtaataaatcaa

SEQ ID NO: 54857 - DNA, 692 bp, Zea mays
  misc_feature: Ceres CLONE 1483330
  misc_feature: Encodes the peptide sequence at SEQ ID NO. 54858
aaagctggagctccccgcggtggcggccgctctagaactagtggatcccccgggctgcaggaattcgcacgagaccattacctagaacatcctaatcgaaaagcacgagacaattacctagaacatcctaatcgaaaagaattttcttttcagctctggagtctggaccttgtccattcccttttgctcgcgcacgcgctcgtctctccaagcctcgaaccgcatctccggcggcctagtggaacgcgaagatggcgacggcgctcggcctcggtgcgcgctccggcctccgactcctgtccgcaggcgccgaggccgcctcagcaacgtcttctcgtgcattccattctactggcacaaggaggatgggggcgcacgctcatgatgagccatactacgtccacgccaagcacatgtacaacctgcacaggatgaagcaccagcagcttaaggtgtgcctcgctgtgctggctgcggtgggcactggcattggagtccctgtgtatgctgttgttttccagcagaagaagactgcatctgcataatctgaaacgccgaggcggcacgacatgaaaacatgcctgcccgtgaaatttcttttcccatttcccacatagcattttgagaggttcaggctggagcttcagttttgcttggccatttctctctctatatatttttttctctcttgc

SEQ ID NO: 54858 - protein, 97 aa, Zea mays; identical to SEQ ID NO: 32167
  misc_feature: Ceres CLONE 1483330

SEQ ID NO: 54859 - DNA, 694 bp, Zea mays
  misc_feature: Ceres CLONE 1483339
  misc_feature: Encodes the peptide sequence at SEQ ID NO. 54860
  misc_feature (604)..(604): n is a, c, t, g, unknown, or other
  misc_feature (675)..(675): n is a, c, t, g, unknown, or other
aaaagctggagctccccgcggtggcggccgctctagaactagtggatcccccgggctgcaggaattcgcacgagaccattacctagaacatcctaatcgaaaaaatcgaaaaaaatcgtcctacgcttctgcctcctcctccacgaggtgaggaaaccctagcgactgaccatggcgttgctcccgcgcaccgcacggttggccttcctctctaccccgcggtcgtactccgccgccgccgctgccgctgcgggcgcctccccgacctccccagcgccatacgggggcgcgcccccaccggcgatgtcgaagacggccgagttcgtggtctccaaggttgatgacctgatgaactgggcgcgtaagggctcgatttggcccatgaccttcgggctcgcctgctgcgcggtcgagatgatgcacgccggcgcgtcccgctacgacttcgaccggttcggcgtcatcttccgtccctcgccgcgccagtccgattgcatgatcgtcgccggcacgctcaccaacaaaatggctccagccctccgcaaggtttatgaccaaatgcctgagcctatatgggttatttcaatgggcagctgtgccaacnggtggtggatactaccattactcctactctgttgtacgtggatgtgaccgtatagtccccgtggacatctnacgtccctgggtgcccacc

SEQ ID NO: 54860 - protein, 115 aa, Zea mays
  misc_feature: Ceres CLONE 1483339
  misc_feature (36)..(108): Pfam Name: Oxidored_q6 Pfam Description: NADH ubiquinone oxidoreductase, 20 Kd subunit
  misc_feature: SWISSPROT Homolog: EC 1.6.5.3 NADH dehydrogenase (ubiquinone)
  misc_feature (101)..(101): Xaa is any aa, unknown, or other
MSKTAEFVVSKVDDLMNWARKGSIWPMTFGLACCAVEMMHAGASRYDFDRFGVIFRPSPRQSDCMIVAGTLTNKMAPALRKVYDQMPEPIWVISMGSCANXWWILPLLLLCCTWM

SEQ ID NO: 54861 - DNA, 550 bp, Zea mays
  misc_feature: Ceres CLONE 1483340
agagctggagctccccgcggtggcggccgctctagaactagtggatcccccgggctgcaggaattcgcacgagaccattacctagaacatcccaatcgaaaaatcccaagaagagccgccctacctattccttctcccagccgtcgagctgcccaacccagagcaccagcagccctcaccttcttcctctcggccgggtcttcaaacgagccccgctcgtcctgggagccgccgccggtctccgttctggacgaacgttcaagggaaatggcattttgtggaaggcctccaatggaggccaaaaaggggggcaaaaaaaaccctgggggggggggggggggatttttttggggtaaaaaaaaccccccccttggggttcccaaaaatttggggggggcttctccccccccccccgggggggaaaaaaaaaaaaaattccccccaaaggggggggggtttttttttaaaaaaaaaaggggggggccccccccccccccccccccctgttaatagactccccccccccccaaaaaaaaaaatttattggggg

SEQ ID NO: 54862 - DNA, 885 bp, Zea mays
  misc_feature: Ceres CLONE 1483349
gttgacctcgtcccttccaacgaaactaagggagagaagaagggaagacaaaagctggggatccccgcggtggcggtcgctcttttctctaaaggacccccgggctgcaggaattcccacgaaaccattacctagaacatcctaatcgaaaaaactctgcccagctaagctaagctccctccgtccatcggcatggcgactaccactactacaatcctcctcctcctcctcgtcgcagccacagccgtctcggcggccgacctcttccgtgtaccaaaacgtgtaacccgccgttcaccgttccccgcttcgatgtcattaattgacgcttcaccacccgaccgaacgaacgacaacggcacaccttctttcccccttcaaaccaagggcggggcctcctttcgcaaggacgaggtataagaacacccgactttcaccttcccaacttcctcgttggcgtaataattcctcccccccccgttgttttatacaccacctctctctagaaatggaaggaatctaataccatcccctcccactaatgctccacaacaaaagaaaaaccccacccccccaccatccatatctctgtgtccggaccatacttaaatgcaccgcgacattataacgagaaccatgtacgacagaccaaacagacaacgaccagccgacgcaccctcacggaaaatcataaaatcaaaagataaataaagaatcctaacccagatcaaaatacctcaatgctctaaacaaattctcaagaagagcagaacacttaataaacatacccgtttttggctcgctacgtctggctcctattactactccctcccaacacggcgacgccggatcccgttcagagcacataacaagtaagatactcta

SEQ ID NO: 54863 - DNA, 907 bp, Zea mays
  misc_feature: Ceres CLONE 1483357
  misc_feature: Encodes the peptide sequence at SEQ ID NO. 54864
  misc_feature (35)..(35): n is a, c, t, g, unknown, or other
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (905)..(905): n is a, c, t, g, unknown, or other
  misc_feature (907)..(907): n is a, c, t, g, unknown, or other
tgggggggccgcgcccccccccccccaacctattnnaaaacgcnnnnnnnnncccccgggactccccgcggtggcggccgctctagaatagtggatcccccgggctgcaggaattcgcacgagaccattacctagaacatcctaatcgaaaactataggaagacgttcaagcaggaggagatcagcaacatcgcaactctcctaattggttcagccgctggtgccatctccagcactgccaccttccctcttgaggtggcccgcacgcaaatgcaggtaggagcagtaggagggaggcaggtctacaagaatggtgttccatgcgcactacctgctaatggaaaaggaaggggggtgggcggcctgtacgaggggcttcggacccaagctgccctccagttgacgccccggccccaggttttttccttcccgtgggggggggcggcgcggggggaaaaatccttgtttctcaaaaaccaatgaaaccacccccagtgtggaccccccacacccgcggtagggccacccgggacggaggggggctgatgaccttctatagtcgctctcggcccgccgaataacccgcttcggggtattgcgccccgcgggggacgcgatagcccctcccccccccccgtccctcccgccgcccggcaccaacggcagaccccgacaggaaatgatattgagtccgccccaccctctcgccacgctcaagcaaatccgacctacccagccgatcgagaagcaaacacacgacgaacaactataaacaccacaccccaccccgctcttggaggagtgcgcgcggccgggaacaagaaaagacgaacgcgccgtgggaggacgcgaacgggccggaacgcagggcgcggttgaagttgcgggaccccgccgcctatccncn

SEQ ID NO: 54864 - protein, 70 aa, Zea mays
  misc_feature: Ceres CLONE 1483357
MQVGAVGGRQVYKNGVPCALPANGKGRGVGGLYEGLRTQAALQLTPRPQVFSFPWGGAARGEKSLFLKNQ

SEQ ID NO: 54865 - DNA, 784 bp, Zea mays
  misc_feature: Ceres CLONE 1483360
  misc_feature: Encodes the peptide sequence at SEQ ID NO. 54866
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (25)..(25): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (431)..(431): n is a, c, t, g, unknown, or other
  misc_feature (774)..(774): n is a, c, t, g, unknown, or other
ttgtccctcctcctcctnnnaatanaaannnnnnncctttnnnnntcatagctgggactccaccgcggtggcggccgctctagaactagtggatcccccgggctgcaggaattcgcacgagaccattacctagaacatcctaatcgaaaacttctgtatgacaccaagggccgcttccgccttcactctgtcagggatgaggatgctaagttcaagctctgcaaggtcaggtctgtccagttcggccagaagggcatcccctacctgaacacctatgatggccgcaccatccgctacccagaccctctcatcaaggccaatgacactatcaagctcgacctggagaccaacaagattgttgacttcatcaagttcaacgttggtaacctggccatggtgactggcgggcgcaacactgggcgtgtttgggngaacaagaacaggcacaaccataagggaaccttccacaccctccacgttgaggatgcccagagccaccactttcgccacccgaactgggcaatgaattcaccatttggcaagggcaccaagccatggggggagcctcccctaggcccagggtatccaccttaaccctcctttgacgacaaaatgaaagacgcatggcccctgcccagagctgcagccaaacgcccgtatctgaagccacttcaattcctttctgctataagccaggctatttcgcaacggacaagcaaaatcaaggtcccccggcaaaccctccctatttctacagcctctgccccatatcgnccggtcgact

SEQ ID NO: 54866 - protein, 66 aa, Zea mays
  misc_feature: Ceres CLONE 1483360
  misc_feature (13)..(13): Xaa is any aa, unknown, or other
MVTGGRNTGRVWXNKNRHNHKGTFHTLHVEDAQSHHFRHPNWAMNSPFGKGTKPWGEPPLGPGYPP

SEQ ID NO: 54867 - DNA, 692 bp, Zea mays
  misc_feature: Ceres CLONE 1483361
  misc_feature: Encodes the peptide sequence at SEQ ID NO. 54868
aagctggagctccccgcggtggcggccgctctagaactagtggatcccccgggctgcaggaattcgcacgagaccattacctagaacatcctaatcgaaaaaaaaaacagaagcagttctccaggcaatagactagctagatgcgcatcaccaaagagtagctttcgtctagaacgaagaaacaccccccactacatggccgcgctcagttcttgtgttgcttctggaggcctggcacttcaggccacccttgtggtttctcctcctcgccgccgcgggactccagtcgtcatctccgtatcatctcatggtcgccgcccaagtcttatcggctccaccatgaatccttcaggcatggctccgatcaaaagaactacacgaattcgtgcggttcatccatgccctgcaaattcgttaggaggaagcctcaccatcatcccaatacctgacctgctttcatcatggctctggatgttcggagcggccatagctgcagcagtgcctctttacagaaggttcagagcattagaagataacgtaaagaagacggcggaggcggcgatcgaggtgatcgactcggtggcggaggcgaccgagaaggtcgccgacgaggttgcgcaagcgttccccggcagtgaaactctcaagcaggcagcctccaagattaagacgatcgcggatgagatcgagga

SEQ ID NO: 54868 - protein, 165 aa, Zea mays
  misc_feature: Ceres CLONE 1483361
MAALSSCVASGGLALQATLVVSPPRRRGTPVVISVSSHGRRPSLIGSTMNPSGMAPIKRTTRIRAVHPCPANSLGGSLTIIPIPDLLSSWLWMFGAAIAAAVPLYRRFRALEDNVKKTAEAAIEVIDSVAEATEKVADEVAQAFPGSETLKQAASKIKTIADEIE

SEQ ID NO: 54869 - DNA, 679 bp, Zea mays
  misc_feature: Ceres CLONE 1483369
tggagctccccgcggtggcggccgctctagaactagtggatcccccgggctgcaggaattcgcacgagaccattacctagaacatcctaatcaaaaaagactagagcaggaggacggatagcgcctgttattatgtttgtttccagacaaggccggggaggcagcgaacgagccgacggaaacggatgctggagactccgtgcatccccgcgaactagtgtccggcgacgacgatatcgactactccgtcgagcctgatttctaccaccccgacctaaatgacatcgatgagagtgctgtgaacatactgactataggccgctcatctgacgccgtgcttagctgccccgatctgtttcgctaccctgtgcttggattgtgttatgcctgagaagtacgtagacacagtaccgttgcgatgttcgttcataactgctacatcctcatctgatcaggtcctgctttagggcacgattgtgagctggattcgagcatgaggaaggcttggtgatccagctgcctcatctgatcgcgagagcgatgggcagtcctaccactccgtctgctgctagctctgatcatccgagtgtggagtgttggacgattactgagtgtaccatttctttagcgtgctccctagctgctcctgaatgccgtgaactgttgctctgtcagtacg

SEQ ID NO: 54870 - DNA, 799 bp, Zea mays
  misc_feature: Ceres CLONE 1483370
  misc_feature: Encodes the peptide sequence at SEQ ID NO. 54871
  misc_feature (28)..(28): n is a, c, t, g, unknown, or other
  misc_feature (33)..(33): n is a, c, t, g, unknown, or other
  misc_feature (36)..(36): n is a, c, t, g, unknown, or other
  misc_feature (37)..(37): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
ggaggtgtttcggggggggggggcgtcnctctnttnntcacttnnnaaaaagctggaactccccgcggtggcggccgctctatcactagtggatcccccgggctgcaggaattcgcacgagaccattacctagaacatcctgatcgaaaaacggacgcacacgcacctcacctctcacaattccaagcccaccagtccaccactctccgcttcgcttcttgtcgctgcggcgcgcggccatggtctccctccgcttccctaccgctgcaatcccccgcctcccgccatcccaggcccccaacggcgtcgccatcgccgccacggtcgccgctgcagccgcggccgcagctgcagtagcggccagcttgaccctcacgggcaagtccaccggccggccagtcccgcaccctgcccctctctgggaatccctctccctggccgacgcggcggcccccagctccgtcgaaccccggaccggcgcgacattccccaccgaggccgccgttgggcgccgcctactcggcataggcctccggaagaacaaggtcctcgggctcaagtccatcgacgtctaaccattcagcggggtatgcgtgacaacaacgattttgaagcccccaccctgaaggaaaaagaactccaaaatttctcccgtactcgcaaacctgaaaggggaaaacggttgatacctggattcatacgtatgtgcgcgttaaaaaccgtcgaaaaataaacagaagtaaagaggttaaaggcctggacaaaatttgggtttcaatgcgccaaagggatcaccaat

SEQ ID NO: 54871 - protein, 111 aa, Zea mays
  misc_feature: Ceres CLONE 1483370
MVSLRFPTAAIPRLPPSQAPNGVAIAATVAAAAAAAAAVAASLTLTGKSTGRPVPHPAPLWESLSLADAAAPSSVEPRTGATFPTEAAVGRRLLGIGLRKNKVLGLKSIDV

SEQ ID NO: 54872 - DNA, 790 bp, Zea mays
  misc_feature: Ceres CLONE 1483377
  misc_feature: Encodes the peptide sequence at SEQ ID NO. 54873
ttttttccccccgcctccgcccttatagatagcgcttgaacccgccccccattcaaactgtcactccacgcggtggccaccgctctttcatactggatcccccgggctgcaggaattcgcacgagaccattacctagaacatcctaatcgaaaaatcgcgtctaaacccttgtctccttcttatccccacctccctcgcggatcactcgccgccgccgccggccgcagacatcgccgtgatgctgtccctgtcgagggcgatcgggaggaggctcttctcctccgccgaggccgcgtcaacggttgcggtgaggacggcgcaaaacccgctcgaggagttcttcgaggtcgagcgaagcaccgaggagggcaagcctcctccccactacggtcgcacctggaaggcttctgaactgcgactaaaatcttgggatgacccacaaaaattgtggtatgttcttctaaaggaaaccaccccgctaatgacacaacgaacaaatgctgcattcccaaagccatgaaggttcccaaatcctagaacgaatttcccaggtaaaagaaatcaatgctgcccaataaaggatggtcttgactgaacatgggttattaacggaaccccaatcccaggaaaatctttcggaaatggaaacgggaatgataaaatggccctgtggaattccacttcgcaaggcatttcctccccttggggaacttttttgatagggaactttatttaaaaacaaacctagccggcccaatcccgagtccgacctcttttctcttcccacca

SEQ ID NO: 54873 - protein, 93 aa, Zea mays
  misc_feature: Ceres CLONE 1483377
  misc_feature (31)..(93): Pfam Name: MRP-L47 Pfam Description: Mitochondrial 39-S ribosomal protein L47 (MRP-L47)
MLSLSRAIGRRLFSSAEAASTVAVRTAQNPLEEFFEVERSTEEGKPPPHYGRTWKASELRLKSWDDPQKLWYVLLKETTPLMTQRTNAAFPKP

SEQ ID NO: 54874 - DNA, 784 bp, Zea mays
  misc_feature: Ceres CLONE 1483378
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
aaaaagttaaggannnnaaagaaagagaagaacggaaaggaaataacgcccccccagcaaaactggaactcaccgcggtggcggacgctttttaactagtggatcccccgggctgcaggaattcgcacgagaccattacctagaacatcctaatcaaaaatcatcggccgtcgcattttcacagacagcatccattccacagtcaccagagcactagaggagagcaacaaccgacaagagcaaagtgagatcgtcgtcagcgagcccagcagatacgagagagaggatggcggacatcgcgtagctggtggcggagcagttcaagaatacggcaaggcgaggcgcccccggcggggacagcggcagcagcagcgggagcggcggcgagacaaggaacttccgggccgtggaccaagggggggaactcggggggggagagaccgccaccgaccgccgcgtccgggggtcagattctaccccccccccttggtgttgtgggggggtgtccccccccccccggtggtgggggggtaggacaaaggacctctttctccggacaaacctagctaggcccgactttccaaaggcttttcccccgggagcaagtgggccaggtggacaaaggggagggccgggtccctggcaccccccgtaacaaaaggctgggggaaaaaccacagacaaatttatggctccaacgattgggcgcggggtagggaggagaggggaccccccccggccccgcgggaaaataagcgaactagttgccacaaaaaaaaaaaag

SEQ ID NO: 54875 - DNA, 743 bp, Zea mays
  misc_feature: Ceres CLONE 1483385
  misc_feature: Encodes the peptide sequence at SEQ ID NO. 54876
  misc_feature (16)..(16): n is a, c, t, g, unknown, or other
  misc_feature (17)..(17): n is a, c, t, g, unknown, or other
  misc_feature (33)..(33): n is a, c, t, g, unknown, or other
  misc_feature (743)..(743): n is a, c, t, g, unknown, or other
ttttttctctggccgnnccttcccccctttcgnccaggcacttttttaaaaattggtgctccaccgcggtggcggccgctctataactagtggatcccccgggctgcaggaattcgcacgagaccattacctagaacatcctaatcgaaaagttttccccgccgccgcctccaagcgcccccgcgagccagctccggcgaagtcgacagcaccaagcatggcggacacgaaggcgtcacccgcggtgacgctccgcacgcgcaagttcatgaccaaccgcctcctctcccgcaagcagttcgtgctcgaggttctccaccccggccgcgccaacgtctctaaggcggagctcaaggagaggctggctaagatgtacgaggtgaaggatcccaactgcatcttcgtcttcaagttccgcacccacttcggaggcggcaagtctaccggattcggtctcatctacgacaacgcccactcaaccaagaagttcgagcccaagtacaggcttatcaggaacggtcttgctaccaaggtggagaaagtcgcgcaagccgatgaaggagaggaagaacagggcgaagaagatccgcggtgtgaagaagacaaaggctggggacgccaaaaagaaatgagcaaggtttcagtggactttaacccgtcttgagttcaaataaaaccctgttcgccgtcagaaattttgtaccccatgtccgcaatgctttgatccaaaaaaaagaagtttn

SEQ ID NO: 54876 - protein, 148 aa, Zea mays
  misc_feature: Ceres CLONE 1483385
  misc_feature (28)..(112): Pfam Name: Ribosomal_S24e Pfam Description: Ribosomal protein S24e
MADTKASPAVTLRTRKFMTNRLLSRKQFVLEVLHPGRANVSKAELKERLAKMYEVKDPNCIFVFKFRTHFGGGKSTGFGLIYDNAHSTKKFEPKYRLIRNGLATKVEKVAQADEGEEEQGEEDPRCEEDKGWGRQKEMSKVSVDFNPS

SEQ ID NO: 54877 - DNA, 757 bp, Zea mays
  misc_feature: Ceres CLONE 1483392
  misc_feature: Encodes the peptide sequence at SEQ ID NO. 54878
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (50)..(50): n is a, c, t, g, unknown, or other
  misc_feature (51)..(51): n is a, c, t, g, unknown, or other
  misc_feature (440)..(440): n is a, c, t, g, unknown, or other
tttttgtgtctgnnnnnntntatactggccggccnncncccccccctttnnaacaaactggagctccccgcggtggcggccgctctattactagtggatcccccgggctgcaggaattcgcacgagaccattacctagaacatcctaatcgaaaaacccctcgagatctctccctccccgcgccgccatggacgcagttgactcggtagtcgacccgctccgggagttcgccaaggacagcatccgcctcgtcaagcgctgccacaagccggaccgcaaggagttcaccaaggtcgccgcgcggactgcgatcggcttcgtcgtcatgggattcgtcggcttctttgtcaagctcatcttcatccctatcaacaacatcatcgtcggctccggctgatccgtaaacctcaggctagtggctgcaggagtggaaaatggcntcactaccttggaggcagcaccgttttcacctcccccaccccccgcaaagcaattcctttaggacttgtgttgccaaagggcaactcccttatcttttcctctcttgaggtcgtgtggtagatctggaactcttttgtacctggtgtccaaatagccttttgtggatcaacggggggaaaaaattaaatgggttaccggtggtccttaaaaaattaaaaaaaaaaaacaaaaaagctttatcgaatccccgttcaaccctccgaaggggggtgcccccgggtaccccaatttccccccctaataaggggaagtccgt

SEQ ID NO: 54878 - protein, 69 aa, Zea mays; identical to SEQ ID NO: 51077
  misc_feature: Ceres CLONE 1483392
  misc_feature (10)..(66): Pfam Name: SecE Pfam Description: SecE/Sec61-gamma subunits of protein translocation complex

SEQ ID NO: 54879 - DNA, 824 bp, Zea mays
  misc_feature: Ceres CLONE 1483400
  misc_feature: Encodes the peptide sequence at SEQ ID NO. 54880
  misc_feature (36)..(36): n is a, c, t, g, unknown, or other
  misc_feature (37)..(37): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
aggttttctttttctcttgctcagaccttttttgtnngaagtacnnnnnncatagctgggactccccgcggtggcggccgctctatactagtggatcccccgggctgcaggaattcgcacgagaccattacctagaacatcctaatcgaaaatttccatcctgtcgtgggatcccagccaccgccgctagaagaagagctcggcgattcccaggtcccgcgagaatatgccgaagcagatccatgagattaaggacttcctcctcaccgcgaggaggaaggatgcccgctcagtgaagatcaagaggagtaaggatgttgtcaagttcaaggtgcgctgctccaagtacttgtacacgctctgcgtcttcgatgctgagaaggcaaacaagttgaagcaatctcttcccccaggttttgaccgtcagaggaggtctgattggatacatggcaacccccgagttgaacctacccccgccttctttatcagtaaccagagcatgctactcctatgtacctttttggaaccttacgcctattaaaacctgtccagggttggaatggcctgggatccttgcctttttttggaagaaatacccaatttacccttcgtttcaagggatgccaaggtaaaaaaaaaaaaaaaaaaaaaagctttatccgaataccggtccaaccctccgaggggggagggccccgggacaccccaattttccccccctctataatggagtcccgtaattaaacgccgcggccttcacttgggcacgtttcggttctttacaaaccgccccctgtgacctggggaaaacaaacccctcgtgc

SEQ ID NO: 54880 - protein, 104 aa, Zea mays
  misc_feature: Ceres CLONE 1483400
  misc_feature (2)..(69): Pfam Name: Ribosomal_L38e Pfam Description: Ribosomal L38e protein family
MPKQIHEIKDFLLTARRKDARSVKIKRSKDVVKFKVRCSKYLYTLCVFDAEKANKLKQSLPPGFDRQRRSDWIHGNPRVEPTPAFFISNQSMLLLCTFLEPYAY

SEQ ID NO: 54881 - DNA, 671 bp, Zea mays
  misc_feature: Ceres CLONE 1483403
  misc_feature: Encodes the peptide sequence at SEQ ID NO. 54882
ggagctccccgcggtggcggccgctctagaactagtggatcccccgggctgcaggaattcgcacgagaccattacctagaacatcctaatcgaaaaacctccccactcgagccagccagccagccagccagccgcttgggcgccatctctctagagcttcgtaccctcgaagagagatccggcgcggcccaataaacacccggctcactacagactcgcagatggccggcctcaggatgaagttcgtcgccgtcgccgccatggccgccgcgctcgtggcgtccgccgcagccgccgaggcccccgccccggctcccgcgtccgacgccgcggccgccgtacccctcgccgcggcctccctcgccgccgccgccgtcggctacttcttctgctagatccgcgctggatacgtggttcctgctccaaaatatgattcgtctggtctggcgcgcgtgagtccagctcgtgtgtcgtgtgtgtctctgtgtgaggtgtcggcgggccgtgtgtgtatgtatggagtccgcccccggcgcctgcggcgaaagaagtgtgccccgtgctgggtgggtacgtgacttcgacgcgccactgtttgtcggcggcgatcatggaactaccctgccgggcgtttctcgggttaccaagggagaggaatttatttgattcca

SEQ ID NO: 54882 - protein, 57 aa, Zea mays
  misc_feature: Ceres CLONE 1483403
MAGLRMKFVAVAAMAAALVASAAAAEAPAPAPASDAAAAVPLAAASLAAAAVGYFFC

SEQ ID NO: 54883 - DNA, 707 bp, Zea mays
  misc_feature: Ceres CLONE 1483408
  misc_feature: Encodes the peptide sequence at SEQ ID NO. 54884
  misc_feature (1)..(1): n is a, c, t, g, unknown, or other
  misc_feature (2)..(2): n is a, c, t, g, unknown, or other
nnccaaagctggagctccccgcggtggcggccgctctagaactagtggatcccccgggctgcaggaattcgcacgagaccattacctagaacatcctaatcgaaaaaccaatcgcccacaagcgctcgcaggagaggtcgaaaccctagcttttgcggcggcggcgagagaagatgatctacgacgtgaactcccccctcttccgttccttcctcagccagaagggcggcgccgacaagaggaaaatggaggagcataaaccaaaggagcagaggcccaaggctaacgagaacaagcctgtgatgaacgaatgaatatctccagaagctttgttcaatgtgcaaccaagtccgatgtccgtttgctctggtcagcttaaaaccaacgcttccaataatcctatattggtgacttagtttccccttatagtgttatttgctcggcttgaacatggcaacggaaatgaaacttgaactacctatggtactgtcatcaatttgagactcccatggttgacaacttttgtgcagctctcctgttacagccgtcgtggttggtacagaattgtgggatgcgtcatgttttcatgcttgcttgcttcacattcttgccctattgtaatgattgagcaagcagtatctactgtaggtcataggacggatcttcggccgttgcatagcatcgaaatccgtagctctgtttgttgg

SEQ ID NO: 54884 - protein, 46 aa, Zea mays; identical to SEQ ID NO: 7044
  misc_feature: Ceres CLONE 1483408
  misc_feature (1)..(46): Pfam Name: Wound_ind Pfam Description: Wound-inducible basic protein family

SEQ ID NO: 54885 - DNA, 664 bp, Zea mays
  misc_feature: Ceres CLONE 1483414
  misc_feature: Encodes the peptide sequence at SEQ ID NO. 54886
tggagctcaccgcggtggcggccgctctagaactagtggatcccccgggctgcaggaattcgcacgagaccattacctagaacatcctaatcgaaaaatagcttcgtctgtataccctatatctctatagccaacacacacacaaatactctccattccattccatctcaaaggatagaataatgggcggtctctccaccaagcttttcgtggtcctcctcctgctcgtttgttacaccgggacgcaaggcgggccggtgactatggtgtcggcgaggaagtgcgagtcgcagagcttccgcttcaagggaccttgctcgagggacgccaactgcgcaaacgtctgcctgaccgaaggtttcaccggcggcgtgtgcaagggcctacgccaccgctgcttctgcaccagggactgctagtactgcctcgtctcgcctcgcctcggctcgtgtcctgcgtgtgcatagccgcagcggatcagtaaaacatgcatgcatgcgttaccgaatatttggcagtaccagcaagttaatggattaaataatatgtaatggaacaaagcctgttttgaacgtggaactgctgagtgctagcagcgctcgtgtttattggcatatatgaactctatggcgcgtttggactttaaaaaaaaaaaaaaaagcta

SEQ ID NO: 54886 - protein, 78 aa, Zea mays
  misc_feature: Ceres CLONE 1483414
  misc_feature (32)..(78): Pfam Name: Gamma-thionin Pfam Description: Gamma-thionin family
MGGLSTKLFVVLLLLVCYTGTQGGPVTMVSARKCESQSFRFKGPCSRDANCANVCLTEGFTGGVCKGLRHRCFCTRDC

SEQ ID NO: 54887 - DNA, 749 bp, Zea mays
  misc_feature: Ceres CLONE 1483416
  misc_feature (749)..(749): n is a, c, t, g, unknown, or other
ccccgcggtggcggccgctctagaactagtggatcccccgggctgcaggaattcgcacgagaccattacctagaacatcataatcgaaaaaaggagccagggccgctccgctccgctccgctcgtgctctgctcctgctctctctctctctcggcgtcgattgggcgaccgccgccgcctcccccaggtcttcgctgggcccgtcgccggcgccgagcacccaccagggcaagttttacttgataatgtggacatcaagacgttgcaattaaagcgacttagagacccagatcggattggtgaatcaagaacctactctttttgcaactacaattccttgagaatattcttttttgggaaaacctgaaggcgacaaagggcagaaggttgggtcctacaaattcttttccccacccaaatttaaaggagcccctagctttctggaaggacaaccccaaagtccctttcaaggttcaaaattggccggggatgaaagggtggaacaaaaaaaaaaattttgggaagggtccaaaatttttggcttaagggccccaaacccccccttttggtggtgctcttaggggggggttttttttttgtgggggaacccccccgggccccttaggcgctcgtttttttttttggggggggggccccccctttttggggcggggggccaaagggggcgcttattttttacatttttcccctgcacccgtgtaatagagggggggcccctcctctttttn

SEQ ID NO: 54888 - DNA, 838 bp, Zea mays
  misc_feature: Ceres CLONE 1483417
  misc_feature: Encodes the peptide sequence at SEQ ID NO. 54889
  misc_feature (11)..(11): n is a, c, t, g, unknown, or other
  misc_feature (54)..(54): n is a, c, t, g, unknown, or other
  misc_feature (700)..(700): n is a, c, t, g, unknown, or other
  misc_feature (767)..(767): n is a, c, t, g, unknown, or other
  misc_feature (789)..(789): n is a, c, t, g, unknown, or other
ttttttttttnctttcccttttattatatgatgttgaacttcgccgccacaaanatggaactccccccggaggaggaggctctagaattagtgtatcccccgggctgcaggaattcgcacgagaccattacctaaaacatcctaatcgaaaaccagtcgagtctcagcaagaaagatgtgggggaaaggaaagaagcgtttcggcggtggcggcagcggtgagcccgcggtcaagcgccaggccgcgagggacgatggcccctccgaatccgctgaagactgtaccgtcttatccgagatatcgaagaacaagaaggtgtccgttaagagctggaaagacagggtcttcgacgacttacgcgagatctacttcaaggaccgcgagagtctccccacccgcaaaggtatatcactctagtctagatcagtgaaagatactgcacggacaacttttaatgccttaaattgaggcaaccccaggaaaatacattgatggtaagccgcctagtaagtcaacgtgatcagagcgagctctttggcttctttctctgatttgaaggcacggaatgtaaagagaagtaaattatttgatagcctcaaaaagatagccccaaataagcatctttgtcccaccttgaacccatccttctttgtcaataaactgagcacggatttggccacgaatagcctactgggttgngccgtactctccgtagcgtaagctatctataaaagctacaacccttctcagttaccccacaagaagncatcaccttaactacaactttnttaataactcaccacacccgacccctatcatccgcctctcataaatcga

SEQ ID NO: 54889 - protein, 80 aa, Zea mays
  misc_feature: Ceres CLONE 1483417
MWGKGKKRFGGGGSGEPAVKRQAARDDGPSESAEDCTVLSEISKNKKVSVKSWKDRVFDDLREIYFKDRESLPTRKGISL

SEQ ID NO: 54890 - DNA, 651 bp, Zea mays
  misc_feature: Ceres CLONE 1483418
  misc_feature: Encodes the peptide sequence at SEQ ID NO. 54891
  misc_feature (260)..(260): n is a, c, t, g, unknown, or other
  misc_feature (261)..(261): n is a, c, t, g, unknown, or other
  misc_feature (587)..(587): n is a, c, t, g, unknown, or other
tggagctccccgcggtggcggccgctctagaactagtggatcccccgggctgcaggaattcgcacgagaccattacctagaacatcctaatcgaaaagaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggaggcccgggaacggcgtccnngcggcgggtgaaccttgccggcgagggtgaacctcccttccggggggggcccccgggcccctcggggtaaccccaaatgggggaaaaagggggggggctccccccccccccccgggggggggggtgtttaaaaagggggggggggggcccccccccccaaaaaaaaaggcgcggggggggtgtttttttaaaaagggggggaaaaaaccccggggggggcccccccccccccgagaaaaaaacgcccccctccaaaaaaaaaaaaaaaaaaaaagaaggggcgcgcccccctcccctttttctctcgtgggggggggggggggggncggcggccccttcttttttttggttgggggtggagagaaaagaaaaaaccaccccccccccccc

SEQ ID NO: 54891 - protein, 55 aa, Zea mays
  misc_feature: Ceres CLONE 1483418
  misc_feature (33)..(33): Xaa is any aa, unknown, or other
MAARSSSQQLVAAAVLAAALLLLAAGGPGTASXRRVNLAGEGEPPFRGGPPGPSG

SEQ ID NO: 54892 - DNA, 806 bp, Zea mays
  misc_feature: Ceres CLONE 1483419
  misc_feature: Encodes the peptide sequence at SEQ ID NO. 54893
  misc_feature (1)..(1): n is a, c, t, g, unknown, or other
  misc_feature (22)..(22): n is a, c, t, g, unknown, or other
  misc_feature (27)..(27): n is a, c, t, g, unknown, or other
  misc_feature (422)..(422): n is a, c, t, g, unknown, or other
  misc_feature (765)..(765): n is a, c, t, g, unknown, or other
ntttcgcgcccctctctcctcngcggncgcggagtggagaagaaacaccaaacgggaagcagggagctccagaggaggcggtcgctctagactagaggatcccccgggctgcaggaattcgcacgagaccattacctagaaatcctaatcgaaaaacactcgatcgcagtttgcagaaagctagaagacacaagaacatggcgtccaagcgactcctcgagctagtagctctccagctcgccgccgttttccttgccgtctcaggagcagctaacgacgaccaagcccaaccgaggaaggacgacggcggcgagaacaaagccgacgtgcaggactaccgtggtggcggcggcggctggcgcggtgggggtggctaccccggccgtggctacccgggtgggggcggctaccctggaggaggncgcggcggttaactgtaggttgagggtgctagcaacagagagcacccccgccgcatgccggtgctgctcgggcgacgaagaggtcccggagcccctgtaccgccggaagtccaccgagggacactacggaagcagagccacactttcgagctgcgaagatggggtgcccccccgcccccttagctatagcgtaattaataagccccacagtccgaagcttggtcctacaataaggccccaagtcccaggtaaagattagtacagcagtacaggcacattaggatcgcgcgtgctttttgattatctcatagaagataacagctggcagtacccgtgattgctngacggcgtgtccctccagcgtgagctctcctagctgggaag

SEQ ID NO: 54893 - protein, 78 aa, Zea mays
  misc_feature: Ceres CLONE 1483419
  misc_feature (1)..(75): Pfam Name: GRP Pfam Description: Glycine rich protein family
MASKRLLELVALQLAAVFLAVSGAANDDQAQPRKDDGGENKADVQDYRGGGGGWRGGGGYPGRGYPGGGGYPGGGRGG

SEQ ID NO: 54894 - DNA, 825 bp, Zea mays
  misc_feature: Ceres CLONE 1483430
  misc_feature: Encodes the peptide sequence at SEQ ID NO. 54895
  misc_feature (33)..(33): n is a, c, t, g, unknown, or other
  misc_feature (34)..(34): n is a, c, t, g, unknown, or other
  misc_feature (47)..(47): n is a, c, t, g, unknown, or other
  misc_feature (787)..(787): n is a, c, t, g, unknown, or other
gactctcacttcccacgccgcctccccgcccgnncgaaacgaaatanaaaaactgggactccccgcggtggcggccgctctataactagtggatcccccgggctgaaggaattcgcacgagaccattacctagaacatcctaatcgaaaactaacccctccttcgtttgcccatcctcgtgacggctcctcgccagtcgcctcgtctctccctgccgcgtcgcctccagttccgcctccgccgcgcctcccgcctccgccgcgcctgacgaacgcagtataggactgtgcaggtagagaggaggagggtccggcgagatggggatgcgagataaaaagcggaaccagaagcgagtgctcgcgcgccgtaccgcggcaccgcgcccaggcgagggcaaggatttcctgccgctggaaagaagccccggtaaaaaacatctgaaggtgcaggagcctgaagagcccgaaaacaccagccacaatccgcctacattgggcataatcccccatgagtttctaccatgtacgaaaatgaaaagggttcttttaaagcaagtttgggggatattaaaaaaggcttaagaatcgcctcgtaaccgccaagaagaggaaaagtccaaagcacatatggaatttcatttgaactatgaagaaacccatgcaagaagacaaaaggggcgctacccaggatggagaatggaaataaactatccttcctggggttgggaaacccaccacattgacaagatttgcaatttttggctgaaaaaccacagaacaaaaggttncatacacacaacaaaaaagtggacaaaagcgcgccgaa

SEQ ID NO: 54895 - protein, 87 aa, Zea mays
  misc_feature: Ceres CLONE 1483430
MGMRDKKRNQKRVLARRTAAPRPGEGKDFLPLERSPGKKHLKVQEPEEPENTSHNPPTLGIIPHEFLPCTKMKRVLLKQVWGILKKA

SEQ ID NO: 54896 - DNA, 673 bp, Zea mays
  misc_feature: Ceres CLONE 1483433
  misc_feature: Encodes the peptide sequence at SEQ ID NO. 54897
  misc_feature (648)..(648): n is a, c, t, g, unknown, or other
tggagctccccgcggtggcggccgctctagaactagtggatcccccgggctgcaggaattcgcacgagaccattacctagaacatcctaatcgaaaaatcaacaaaatttgattttcctttcctttccttttccacccccgactattacccctcctcccactccacggagaagcgaaaccgacctttccccctcccccgcattccacctcgcggagatccagtccagccctagggtttcgccagcggcgagccaaactccacgagcgggggaagaggggaaagcagggacgacgagggggcagccatggggcagcagtcgctgatctacgcgttcgtggcccgtggcacggtcatactggccgagtacacggagttcaccggcaacttcaccaccatcgcctcccagtgcctcatgaagctccccgcaagcaacaacaagttcacctacaactgcgacggtcacactttcaattacctcgtggaagacggattcacatactgtgttgttgctgttgaatcggtggggcaacaaattcctattgctttcatggatagggttaaggaggatttcacaaaaaggtatggtggtgggaaagctgctactgctgcagctaacagcctcaatcgagagtttggatcaaaacttnaagaacacatgcagtattgtgtgga

SEQ ID NO: 54897 - protein, 122 aa, Zea mays
  misc_feature: Ceres CLONE 1483433
  misc_feature (115)..(115): Xaa is any aa, unknown, or other
MGQQSLIYAFVARGTVILAEYTEFTGNFTTIASQCLMKLPASNNKFTYNCDGHTFNYLVEDGFTYCVVAVESVGQQIPIAFMDRVKEDFTKRYGGGKAATAAANSLNREFGSKLXEHMQYCV

SEQ ID NO: 54898 - DNA, 656 bp, Zea mays
  misc_feature: Ceres CLONE 1483437
  misc_feature (656)..(656): n is a, c, t, g, unknown, or other
agtggatcccccgggctgcaggaattcgcacgagaccattacctagaacatcctaatcgaaaaaaaaaaaagccacttagctcacaccatgaacccttctccgcaatctccccgacctcgatcccgcctccacccaatggcgtctctccctaacggtggcggcgcagcctcctctggctcatgtgtcgagcaccctgtaagaaaatcattcgacttcggccaaaagctctgcccaaactcctacaatagacacaaaaaagagacgttctgtctccacaattcaaagaacacacagtcatctccgttcttacgataaaaagtccagttacataaatagtctgtagttaacgggtataacggtttcatctctactaaatattccacccccccgcgcatgaaatagcactatgtaccagataaaacgtataaacacgattgaaatccaataatagccttgcaaaaattggatgttgacaaagcccacaaataggaaaaggaatttaaagacaagatggaccgtgataaaaagactaagatttgaattacacaacggaaccctaacattgttattaagctcagttaatagaatctatccgggaacgaagacaaattagaatttaaataccataaaaagctaatgaagagggccatacccn

SEQ ID NO: 54899 - DNA, 795 bp, Zea mays
  misc_feature: Ceres CLONE 1483442
  misc_feature (16)..(16): n is a, c, t, g, unknown, or other
  misc_feature (17)..(17): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (795)..(795): n is a, c, t, g, unknown, or other
tttttttttttcaccnntgnnnntgggaggggaaagcccctctttaccttttgtggagggagtcctccccgggggtgggggccgctctagaactagaggatcccccgggctgcaagaattcgcacgagaccattacctagaacatcctaatcgaaaaatcactggctctcttcatcttcgtcttccgcatcctcctgggcttccttgtccgagtcgctgccgttgtcatcgcccccggtggggcttgtgctgttctggtaatgcgcctgctgcggggcaagctggagcctgctgccctagatgcggtaccgaacgcagtgattgctgctggaggcgacctcggaggacacgcccgctctccgcgtgccgttgccgtccgaaaggatcgggacaggccatgggcgtggagcgaggcggaggacgcaccgcccgaggcctaggagagctccttctggctcttgtggaagagatgcacgcgctgaacctccagctgccgggaggagaccaggagctcccgctccatgctgaagaatcctggtccctcttggaagtctcctggggctcggtacacctccccatagccgtcggatcgccctgcgccagctgcgagcagactctggcgcgcgggctgatgctgctcttccacactcaaagaccagtgcgggccggtctggagagttctatctaaaaaacttgtcctcttaggccgatacgccaccctaagagaggcggctcatcccgctgcggagaaggacctcagatatgagatcccaacaaggctggagacaacaccgn

SEQ ID NO: 54900 - DNA, 724 bp, Zea mays
  misc_feature: Ceres CLONE 1483573
  misc_feature: Encodes the peptide sequence at SEQ ID NO. 54901
ggagctccccgcggtggcggccgctctagaactagtggatcccccgggctgcaggaattcgcacgagaccattacctagaacatcttaatcgaaaaaacaacaaaatggatcgtggcccactggaccacggtcgtagacagcccggctgggcgtcgaagtctctccgctcaagacacgggcccacgtccacagatcggaggagagcactggcttgtatccctctctcgtctctccagcgacggcagcgggcgagggttacgcgaaggcgaagcggagtagtggaagcagaggcggcagccatggccgtgatggagaagctcaagatctttgtcgttaaggagcccgtagtcgcggcctcctgcctcatcgctggattcggtctctttcttccagcagttgtccggccaatccccccattcatggcagaccgcggaacaagttcctccacctcttctaaatgatgtggttggcagtgtcaccgggcaagaaaagtagtgaacttgcattgttttctcatgccaatgttgccccacattttcttccccggggtttttcctggcgaccaaattgaagggttttcccaaaatcccgggcctgaactccaaaaggaatcggcgaaaaattcttggacccggaatcattaatgggaaggtggcatttttgaaaaggttcccccccccaaaagggtggaaaaatgcgcctccccaaaaaaaaaaaaaaaag

SEQ ID NO: 54901 - protein, 53 aa, Zea mays
  misc_feature: Ceres CLONE 1483573
MAVMEKLKIFVVKEPVVAASCLIAGFGLFLPAVVRPIPPFMADRGTSSSTSSK

SEQ ID NO: 54902 - DNA, 715 bp, Zea mays
  misc_feature: Ceres CLONE 1483574
  misc_feature (702)..(702): n is a, c, t, g, unknown, or other
tccccgcggtggcggccgctctagaactagtggatcccccgggctgcaggaattcgcacgagaccattacctagaacatcctaatcgaaaattttttctggattttaggctgttcgtaacccctacaacaatgatccgtatcagctccggtaaatttagcggagccctccggacggtttctccatcgcccgctatcgcgtcgcctttgacttttctccgacggtaaatttattcgtcacgccgtcggccgcatataggactgtctacggatctgagtgagcatctctcgggcggaatcgccgagccgacgcagcttcgccaccaactccgcggcgttcgacgccgggcaccgccgtgcgcacggcagcgaacttcctctgctcgcactgatgctgccgctacacatcctcctgcgctccttcgacgaaccgctcgaaccaccatggtggccgcggcgttcgacgtcggccaccaccgtgcgcagggcggcgactgcccgtgctccaccttcggcccagcggacactggcagacaacgacgacatcacgcccttctatgttgttgcctcctccggcggacgtactcctgcgctccttctccgacgaaccatggcgctcgaccaccgatatgaagacaacaactctcctggtcgacgaaatgtctccaaagcaaaatagagatcaactatgttttttttgtccnataggagtttatg

SEQ ID NO: 54903 - DNA, 579 bp, Zea mays
  misc_feature: Ceres CLONE 1483593
  misc_feature (334)..(334): n is a, c, t, g, unknown, or other
  misc_feature (365)..(365): n is a, c, t, g, unknown, or other
  misc_feature (510)..(510): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (541)..(541): n is a, c, t, g, unknown, or other
ctggagctccccgcggtggcggccgctctagaactagtggatcccccgggctgcaggaattcgcacgagaccattacctagaacatcctaatcgaaaaacacttccagtgccgagcaacaagctcgtttccgcatacgcccaaggcgaggcatttcatcgaacataacgaccccccgttccaaaccatgccgctcacgaagctccacccctccctcgccgccgcctccacgctgaccccgaagcatagcctgaacgcaaaccgcgttgtggccctgaccccgtcggcgtcccaccgcagcggcggtctccgggtctcccgcgctcggtggcggnggggcagccaacaaggggggtcacttggaangggcgctgtggggggacttaacccccgggaactgttttttcaagggcttcccctttttcccaaagttttcagggggggaaaaaaaggggggggggggaaaaaaaaaaaaagagggggggggggggcgaaaaaaaaaaaaaaaaanannnaaaaaaaaaaacaaaaaaaaaaaaaanggggggggggggggaaaaaaaccaaacccccccccccc

SEQ ID NO: 54904 - DNA, 803 bp, Zea mays
  misc_feature: Ceres CLONE 1483596
  misc_feature: Encodes the peptide sequence at SEQ ID NO. 54905
  misc_feature (37)..(37): n is a, c, t, g, unknown, or other
ggggcccgccccctaatcccggaaagcgtgcgcctcnccatatcccccccaaaaccggaactccccgcggtggcggccgctctatactagtggatcccccgggctgcaggaattcgcacgagaccattacctagaacatcctaatcgaaaaaccgataccgtctccgcctttccttccttttgcgctagcttccacagcatcaccaccgccgccccagctcgcttccctccccgctacacggacacggccgctcagcgctcaccaccgcttccatgctcctcgcctcgtctcccgctcgcgagacgtagctccagatcctctcccccacccacggcagcaccgcattaccctcagatccacccccgcgagcctcatttcagatccacccatgcgcctcccggtccttttcgccctggaggtggtcgccatgacggcggcagcttcggcggccgaggccgcgcccaccctggtggctcaaggatggtgcaccgtctgtccgaagagggccggctggaaccgggcccgcgcatggggttgtggccgcagcgcggaaacggggggctactaccgcgcgctgctgaagaacgatctccaacgggcaaagcggcggctcgcggggcaagaaacagggtcctcctcgctctccaagggcggaaagaacctttctccccccggcaacgaacttagggctggttaatacttaccctttggcgagaaatggattgggaaagccctactaaacatccttttttggggtatgcactggggatcaatgggaagtgtggacccgggtctctgtggg

SEQ ID NO: 54905 - protein, 102 aa, Zea mays
  misc_feature: Ceres CLONE 1483596
MRLPVLFALEVVAMTAAASAAEAAPTLVAQGWCTVCPKRAGWNRARAWGCGRSAETGGYYRALLKNDLQRAKRRLAGQETGSSSLSKGGKNLSPPGNELRAG

SEQ ID NO: 54906 - DNA, 734 bp, Zea mays
  misc_feature: Ceres CLONE 1483597
  misc_feature: Encodes the peptide sequence at SEQ ID NO. 54907
  misc_feature (229)..(229): n is a, c, t, g, unknown, or other
  misc_feature (397)..(397): n is a, c, t, g, unknown, or other
  misc_feature (410)..(410): n is a, c, t, g, unknown, or other
  misc_feature (411)..(411): n is a, c, t, g, unknown, or other
  misc_feature (422)..(422): n is a, c, t, g, unknown, or other
  misc_feature (423)..(423): n is a, c, t, g, unknown, or other
  misc_feature (447)..(447): n is a, c, t, g, unknown, or other
  misc_feature (477)..(477): n is a, c, t, g, unknown, or other
  misc_feature (592)..(592): n is a, c, t, g, unknown, or other
ggagctccccgcggtggcggccgctctagaactagtggatcccccgggctgcaggaattcgcacgagaccattacctagaacatcctaatcgaaaaaggaaagcggtcagaattggagtgcaagcgacgcgtcgagccccatcccgttcccgcgcctcgccgagagatctgcaccgtcgtcggcaccaacccgtcagtccgtacgtcgtccgcgccggcgaacgagtanagatggaggagacggcggcagcggctacggctgagaaggcgtcgtcgtacaggtactgggtgcgggaagccaccggcgacgccgcgccgctccccgtcccgcgcaagctcgaccccgccgccaatgggaaacggaacccgccgccccttcggctcccgtctggaatcnggctgggacttgnngaggaaagaanncctcactcatgggggctatagtanggaaaaaggattttgctggggctcctctanggttctttggaagttccctcaccgggagaaggcgttcgtcttgaatgaaattggtccaagtggttccggggaaggcctcttttccgggcccttgtgccgccccccgaacgaaggngggatttatttcccacttcgcttgggatttttaagggggggagggggtaggttaaggagaaaaaccagattccaggcccctttaacctttcccaagatttttttctttttcggggaaaaccaaaaaccccccaggggggcct

SEQ ID NO: 54907 - protein, 70 aa, Zea mays
  misc_feature: Ceres CLONE 1483597
  misc_feature (56)..(56): Xaa is any aa, unknown, or other
  misc_feature (60)..(60): Xaa is any aa, unknown, or other
  misc_feature (64)..(64): Xaa is any aa, unknown, or other
MEETAAAATAEKASSYRYWVREATGDAAPLPVPRKLDPAANGKRNPPPLRLPSGIXLGLXEERXPHSWGL

SEQ ID NO: 54908 - DNA, 787 bp, Zea mays
  misc_feature: Ceres CLONE 1483603
  misc_feature: Encodes the peptide sequence at SEQ ID NO. 54909
agacccttcctattttccacaataataaaaactacctttcctcacactgggactccccgcggtggcggccgctctagaactagtggatcccccgggctgcaggaattcgcacgagaccattacctagaacatcctaatcgaaaaactgccgcacgaatcgagccgccgaaaaggcgcaggcgaagccagcggggagagaaaacgggcgggatccccaccgcctcgcgcgcagcggcggcggcggcggcaatggaggtcacctcctccccctcgccttccgcgccgccgccggcctcctcgaagccggcgctccagctcaaccccgcggccgtcctcctccgccgcctgccgaccccgaccccaacagcggcgacgcccgtcaccgcgacggcgccccccgcgcggcccgccaccgcgtccaacccgctcgcggccttgctcgtccccttctggcgcggcccccccccagcgccgaaacagccggtccaccccgcctccgccgccgcggcgcggagggcggcggagcaacatgaggcggaggccgaggcggaggcgcggcaactggtggggtgcgcggtgcctctgttccgggcgtacttggcacagctgccgtggcacggcggcgcgcgggcctggattgccaaaactgttcccgcgctatggtcactattgcgggcccccattggtcccgctgcaaggaagtcgggttcgtggctctggaaccgcccgcccggtctacaacctttaactttgggtgctatctggccagaaatggccttttaccccc

SEQ ID NO: 54909 - protein, 179 aa, Zea mays
  misc_feature: Ceres CLONE 1483603
MEVTSSPSPSAPPPASSKPALQLNPAAVLLRRLPTPTPTAATPVTATAPPARPATASNPLAALLVPFWRGPPPAPKQPVHPASAAAARRAAEQHEAEAEAEARQLVGCAVPLFRAYLAQLPWHGGARAWIAKTVPALWSLLRAPIGPAARKSGSWLWNRPPGLQPLTLGAIWPEMAFYP

SEQ ID NO: 54910 - DNA, 700 bp, Zea mays
  misc_feature: Ceres CLONE 1483607
  misc_feature: Encodes the peptide sequence at SEQ ID NO. 54911
  misc_feature (679)..(679): n is a, c, t, g, unknown, or other
taaccgcggtggcggccgctctagaactagtggatcccccgggctgcaggaattcgcacgagaccattacctagaacatcctaatcgaaaactcgtctcgtttcagttcctcgtcgccctcgccacttcgccgccgccgctttggctccacccagtccgcttccggcatccgcccatggctgcggcccccgcccgccacctcgccgcggccttcacggccgccgctgcgcaccagcgcgtcgcgttcaggcgcgtccaggtccgggccccggtgtccgcctctctctccttcccgccgcgccatcccgcgccattttgcggcagggccagcctcgcctgccccgccgccgcctctctctccgccccctccggcgccgcgcctccgggctccgtgccattcaacctcctgccgcccgactccgaccctttcatcgagtgggacccgcccccgggcgactccgccgcctcgccgctcgctggcggcggtgcttccgggggcgccacgctggtcgtgctgctcggctggctcggcgcgcgccagaagcacctgcgccgctacgccgacctctaccgcgagcgcggggtcagcgcggtgcggttcgtcgtgcccgtgcgcgagctcgtcgggctcgacctcggccgccgcgtcgagcgcaggttcgccgaactctccgagcangttcgcccgtggtgcgacgcc

SEQ ID NO: 54911 - protein, 175 aa, Zea mays
  misc_feature: Ceres CLONE 1483607
  misc_feature (168)..(168): Xaa is any aa, unknown, or other
MAAAPARHLAAAFTAAAAHQRVAFRRVQVRAPVSASLSFPPRHPAPFCGRASLACPAAASLSAPSGAAPPGSVPFNLLPPDSDPFIEWDPPPGDSAASPLAGGGASGGATLVVLLGWLGARQKHLRRYADLYRERGVSAVRFVVPVRELVGLDLGRRVERRFAELSEXVRPWCDA

SEQ ID NO: 54912 - DNA, 667 bp, Zea mays
  misc_feature: Ceres CLONE 1483608
  misc_feature: Encodes the peptide sequence at SEQ ID NO. 54913
  misc_feature (455)..(455): n is a, c, t, g, unknown, or other
  misc_feature (648)..(648): n is a, c, t, g, unknown, or other
gggagctccccgcggtggcggccgctctagaactagtggatcccccgggctgcaggaattcgcacgagaccattacctagaacatcctaatcgaaaaattatacgaaggaataccttgaggagactgtcgggtcatgtactagaagaatggtcctctatcaagaatatgtgaagggcatatcgtcaacagggatgcaatccaattgtggttttgaagggcaagttaatgcatgctggactcacaaaatgactactaaggaactagatacaatacggtttgccggttttctagtttcagttattcatggaaggtacgatatcattgcacaattgtgccatgcaaaacgtctagcagaaaggcttcttcctgttgcaagaatggtagtacctcatggtgcacatctagtaagccatgaaagaccagacgaggtgaacaatgcacttatggatttgantaaggcccacaaatctgcgataaaactgaagagtggtcagcccagcctgaagacacgtcgggtaagcttaagaagactaaacacctccctatttctctgaaagcaaattgttcgggggcaatctcttacgctgcatcctcatcagaaaccggggcgctcatttctgcaggaccatcaccgtcacggtgcgacngatgcaggcgtaaacccac

SEQ ID NO: 54913 - protein, 135 aa, Zea mays
  misc_feature: Ceres CLONE 1483608
  misc_feature (103)..(103): Xaa is any aa, unknown, or other
MVLYQEYVKGISSTGMQSNCGFEGQVNACWTHKMTTKELDTIRFAGFLVSVIHGRYDIIAQLCHAKRLAERLLPVARMVVPHGAHLVSHERPDEVNNALMDLXKAHKSAIKLKSGQPSLKTRRVSLRRLNTSLFL

SEQ ID NO: 54914 - DNA, 732 bp, Zea mays
  misc_feature: Ceres CLONE 1483610
  misc_feature: Encodes the peptide sequence at SEQ ID NO. 54915
  misc_feature (668)..(668): n is a, c, t, g, unknown, or other
ccccgcggtggcggccgctctagaactagtggatcccccgggctgcaggaattcgcacgagaccattacctagaacatcctaatcgaaaagtgctgatctttccaccgtcgcatacaggcagcaggatgctctttattcccctgtgtcagcttcagcgaagctaatcccattccagtgcccgtaccgcgccgtccctatcgtgccggatcgccacccgctcgctgcgcccccacctcccccccctcgccggttcgccacttcgccccacctccgcgcctcagatccatccccaatccggcaaccctagcgccgggttcctcctcctcgtctccgcccgccgccgcctccattgccagaggtgatcgagggggagagacagagcttgggtggtcggattagggagacacccacgggaggatgtccagaaggtcggtgaacccgagccggcgggtggcggacgggggcttgccgtccttcggcggcccgttccaccctaagtcacgctcgcctcccgtgctcaccattgccctcgtcgtcctgggtgtcatttttctcattgcctacttcaacagcagccccaggtgtaactgttacgagcaaagagactgtgaccaggtctgaaggttcttgcacatcagaaattatgcgggcgcctcccatatcttangaaggcatatggcaatgccatgcaaaaggttctccatgtaggcccctgatagttgtacagtaat

SEQ ID NO: 54915 - protein, 67 aa, Zea mays
  misc_feature: Ceres CLONE 1483610
MSRRSVNPSRRVADGGLPSFGGPFHPKSRSPPVLTIALVVLGVIFLIAYFNSSPRCNCYEQRDCDQV

SEQ ID NO: 54916 - DNA, 949 bp, Zea mays
  misc_feature: Ceres CLONE 1483614
  misc_feature (592)..(592): n is a, c, t, g, unknown, or other
  misc_feature (949)..(949): n is a, c, t, g, unknown, or other
gccccccttccccttattcccttttttttagacctctccctttctctcaaactggagttcaccgcggaggcggacgctctatattagtggatcccccgggctgcaggaattcgcacgagaccattacctagaatatcctaatcgaaaatccctcatacaagacgaggaccccctccgaatgcgagggttcaagcgaccgacggtgaacatggtggaggacggtggcccaccgacgtcggcgctggaagaggccctcaagcccttccaggaaagatgctccgaggatgagatacccatagcggaaactggaagccttgctgtacaacaaatatggtccgagcggaggatataaaggaagattcctctggcggggaagggactctattccgaactaaaatgtggattactggcgaatgatccgcattgaaatgtgaaaaaaaaaaaaaaacttactccgggcaaaatcaaaaaaattccggttacccccctcaacccccccaaaaatttctttgggtattgccaggacgggcggaaataccacctactacggaagccgggccctggagaaagggccggtatacataaaaaaccncccaaccatccccaactagtgttttcccccgccccccggcccttgtggttcatattccataccccgggggagataattttgtgggaacaccacctcttccaagaaaaatttcgtattcctgcgccgccctcacacatataaagagtttgggcgcccccaagatcgcacccaaaccccgcctatatttctcatatttgcgcggttcccaggcgtactgtcctcacatgtattggtaacaaacgtttgatttggggttactcaatctcgcggctcttttgtacccaatgtagtgatcattatttcgccatccacaccaggcgattccataccataaaaaccgcttcccgtctgcctctn

SEQ ID NO: 54917 - DNA, 804 bp, Zea mays
  misc_feature: Ceres CLONE 1483617
  misc_feature: Encodes the peptide sequence at SEQ ID NO. 54918
  misc_feature (31)..(31): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
gtggttttcccccccgtcctttataaccccncccnnnncccgtttntnnnnccatactgggactccccgcggtggcggccgctctagaatagtggatcccccgggctgcaggaattcgcacgagaccattacctagaacatcctaatctaaaattattacatgctgcatgttgggggcccttcgccttccgaaggtcctcacaaacaggatttaacagtatttctggagtataatgtgacaacaggaatcttcggattccagtcggcatcacactacaccagaacaatacgaaggtttatacagcgcccaaggtgtgaccacgaaagcttcggcgtggcaaccaaaagtgaaaccgaccttaaagatgacaagggctatttagacctccatagactactatagaattattatcaagtgtaaagggcatgaatggaaaaacgtatgcccttcgtcctcctacctataaataggtgaacccaacccccggactgttcccgccgcgcctcgccattccaccttcgtcccccccccgcacttgtcttcccgttccgtccgcacacaaaaaatgataatggtttctccatgcctctcgaaccttgcagggggggccccggcacccacattccgactctatattaagatcctattatggcctaactacccaataccccttcctctttaatgggtccgaattgaacaaacccccaacaccccttacccccccccaacccagaatcgagcaactcctccgccccctccccgccccagggcccagattcatcccgacatcccccccccccccc

SEQ ID NO: 54918 - protein, 80 aa, Zea mays
  misc_feature: Ceres CLONE 1483617
MLHVGGPSPSEGPHKQDLTVFLEYNVTTGIFGFQSASHYTRTIRRFIQRPRCDHESFGVATKSETDLKDDKGYLDLHRLL

SEQ ID NO: 54919 - DNA, 897 bp, Zea mays
  misc_feature: Ceres CLONE 1483619
  misc_feature: Encodes the peptide sequence at SEQ ID NO. 54920
  misc_feature (33)..(33): n is a, c, t, g, unknown, or other
  misc_feature (34)..(34): n is a, c, t, g, unknown, or other
  misc_feature (37)..(37): n is a, c, t, g, unknown, or other
aggctgttttcccccgcagtccccgggtccccnnccnaaaaacaccccaaaactgggactcaccgcggtggcgggcgctctagaactagtggatcccccgggctgcaggaattcgcacgagaccattacctagaacatcctaatcgaaaaatccaaaattcccagtccgcgatacaagaccaatccaatccaatccaatcccagcggaagtggaagcagcttcatttccttccttgcagctagcagcgatgattcttgtggcgatagtggcggagctgctcgaggagtacaccgcgctggtggcgcgggtgctggagcagctgctcaacgacgcgccgttaccgcgccggatgcgcttcctcatgctgcggaagcctccccttcgtgccggcgactctggccccgccgccgttgtcggatggttttctacgtaaccacccgaaccctgattattggcctccgattttatgggggcgcaccccgggggtattgccgcggcgttggcccccccctccccacctaacccctgccccttgagggccgcctagggcccataaaacatggcacggtccgacccaagggccacccgcgcggggggcgccccatcgccttattcgaattagggttagggcgaaactttcccggtagagcccaagatccccaccgcggcggtgagatagcggcgctccatgtaagagtctgtgccctttgagggggcctcccacgctgctccgtaaaacaaattttttggctccgcgctggtgtcccgcggcaaaaatacctttccccgcgcggcggtgtccgtaacagtaggccacaaaaagtttttttgtgtgtactctcgctcccacccgcggaggggggcctgcgggtgtatccattatatccccctcaaaa

SEQ ID NO: 54920 - protein, 61 aa, Zea mays
  misc_feature: Ceres CLONE 1483619
MILVAIVAELLEEYTALVARVLEQLLNDAPLPRRMRFLMLRKPPLRAGDSGPAAVVGWFST

SEQ ID NO: 54921 - DNA, 695 bp, Zea mays
  misc_feature: Ceres CLONE 1483621
ggagctccccgcggtggcggccgctctagaactagtggatcccccgggctgcaggaattcgcacgagaccattacctagaacatcctaatcgaaaaatcaaatttttcgtgagctaccatcgccgagccatcgtacagaatagagagagggaaagagaggttggccgccccgctgactgctcggggcggcgccgtcggtggtccggagtcggaccagggagcttcaccaggttgcactgtggtgtttcggagcctcgtcgcgtgagggcgaatagtggggatccgacgatttctcaccggagatcagggaaacattgccggccgcccgccaccgtggccaagggagtctgcgctgcgattgccgaacgtgatatgttcccaagcttgagtgaaccaatgatcaagccttggtgatcaagagttcaagttctttgagttctacaaggttgaagaccctaagcatctatttagtgaaggcaagtgttctctgaccaacttatgtcctattcacatgaaaacttacattcccccacaacatgattcaatctaaggattgactaactttctatttaccatgtccttgtttaccttatggattggattgtaatgattatcttaaatgttagcacttaaacttaatcaatgaacatgatgagatatatttatgataaaaaaaaaaaaaaaaaagcttatcg

SEQ ID NO: 54922 - DNA, 729 bp, Zea mays
  misc_feature: Ceres CLONE 1483622
  misc_feature: Encodes the peptide sequence at SEQ ID NO. 54923
  misc_feature (465)..(465): n is a, c, t, g, unknown, or other
  misc_feature (487)..(487): n is a, c, t, g, unknown, or other
ggagctccccgcggtggcggccgctctagaactagtggatcccccgggctgcaggaattcgcacgagaccattacctagaacatcctaatcgaaaagtgcctgctggtactgctcctctctttcgacaagttcctcttccactacctgaagcgccgctggttctccggcggcagcggcgccaccgtcccaaggccccccgccaaatcgaggcggaacatggcggccgccaagtggagcgagacggccatgctcgttatcgacatgcagaaggacttcgtggacccggcgatgcgcagcccgatgctggtggccggtggcgaggccgtcgtccctgccgttgccggggccgtcgccgtcgcaagggagcgcggcattttcgtcgtctgggttgtcagagagcatgacccttctggaacagcatgtgaactttcccgtaggcaccattatctgggggaaaaggtccnacattgaaaagtctgaaaggancgaacctggctaaatggctttgttatcaagaaggggaaaacaagttggggaaaacaaaatttggggtttctttccaaaacttcttgatttggcccgaaaacttgggaaaaaaaaaattgttttttgtggagttaaaacccaaattttttcccaaaaagggttttcaattttaaccgggggaaaaaaaaaattccgttttttatttaaaaaaaattttggaaaaaaaaaataattttttttaa

SEQ ID NO: 54923 - protein, 84 aa, Zea mays
  misc_feature: Ceres CLONE 1483622
  misc_feature (83)..(83): Xaa is any aa, unknown, or other
MAAAKWSETAMLVIDMQKDFVDPAMRSPMLVAGGEAVVPAVAGAVAVARERGIFVVWVVREHDPSGTACELSRRHHYLGEKVXH

SEQ ID NO: 54924 - DNA, 722 bp, Zea mays
  misc_feature: Ceres CLONE 1483635
  misc_feature: Encodes the peptide sequence at SEQ ID NO. 54925
  misc_feature (722)..(722): n is a, c, t, g, unknown, or other
ggagctccccgcggtggcggccgctctagaactagtggatcccccgggctgcaggaattcgcacgagaccattacctagaacatcctaatcgaaaacccgaccctcgtggcctcgtccaacgttcgtgccgcttgctgggccgccgacgcgccaggccgctggagcagctcgcctgccccccacgccgtgcccctcgctcagcctgcgccgcctcgcacacctcgcgccgctagcccggccggagccgctcttcttccaccgcgatcgccagctgccgccgctcctctaatggtgacgaggtggcgccagaagagcccgggcctcaagatcctgtggatctggaccctgggcaccgccgcaattgtggtcggcggtatcgtccggatgcgggtaaacgatgtgcagaagatccttcgggaagaagaggaagccgccgctaccgccacggccacgtcgccccccagcgagcgagtcctgaaagacgaagagtagaacaggaagtggagagttttgcgccatttgagctgggggatgcatctgtatcgggcccataatgtagtatctccattttaaaaaaggtttgagtttaggaaaagaattgtttactgtagtgattcaataacccttcaccctgtctgcattacactttcatatatgatgtgaaacgtttggtgacaagaaaaagaaaaaaaaaagcttatcgatacgtcgaccttcgagn

SEQ ID NO: 54925 - protein, 67 aa, Zea mays
  misc_feature: Ceres CLONE 1483635
MVTRWRQKSPGLKILWIWTLGTAAIVVGGIVRMRVNDVQKILREEEEAAATATATSPPSERVLKDEE

SEQ ID NO: 54926 - DNA, 486 bp, Zea mays
  misc_feature: Ceres CLONE 1483636
  misc_feature (197)..(197): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (465)..(465): n is a, c, t, g, unknown, or other
ccccgcggtggcggccgctctagaactagtggatcccccgggctgcaggaattcgcacgagaccattacctagaacatcctaatcgaaaagaacaggacgcgcacgagacgaaaccgccgccgcccatggccgactccggcgccctcgtcgtgacggaaggcgcggcagcagcaccccgctgaagccagatcgcggncgaagcggggaaccaaccgggctgctggtttaaaaagggggggtccagggaagaaaaaactggttggggcccgcccccggggccctttcccgggggggcccccccctctaaaaggggccccctccaaaagagaaaaacaccccccttttttttttttagggggggggggttttttttttccccttttaatcacccgccgcgtttttttggggggggggggggggggcttttttttttttttttcccnnnnnncccccccccccccccncccgggggggggggggggggg

SEQ ID NO: 54927 - DNA, 681 bp, Zea mays
  misc_feature: Ceres CLONE 1483641
  misc_feature: Encodes the peptide sequence at SEQ ID NO. 54928
  misc_feature (371)..(371): n is a, c, t, g, unknown, or other
  misc_feature (436)..(436): n is a, c, t, g, unknown, or other
  misc_feature (445)..(445): n is a, c, t, g, unknown, or other
  misc_feature (448)..(448): n is a, c, t, g, unknown, or other
  misc_feature (528)..(528): n is a, c, t, g, unknown, or other
  misc_feature (542)..(542): n is a, c, t, g, unknown, or other
aagctggagctccccgcggtggcggccgctctagaactagtggatcccccgggctgcaggaattcgcacgagaccattacctagaacatcctaatcgaaaaaagacccgcacgcgaacgccctccctgccgctccgccgtttcgcgtgggagtcgtttcgaaaaagtctgtttcgcgagcggtgaggactgaggagtgtggaggcctaaaaccatggcggcgagcatcgggatcatggacggcgcctacttcgtcggcaggggcgagatcctgcactggatcaatgcgaccctccagctctccctcgccaaggtcgaggaggcagcgtctggcgcagtgcagtgccagctcatggatatggttcaccctgnagtggtgcccatgcataagggtcatttcgatgcgaagacagaatatgacatgatccagaactacnaggttcttncangacgtgttttcacagctgcggatagggcagaatattgaggggtcacagcttggttaaagacggccattggaacacttggnagtcctttcatggntgaaaagaaattgggaatcttgggatggttgaaattatggaccgaaactacacccttggaaaaaggaggtccaagggatgccaaaacttggcttccaaagggttccaaaacccctttaaatctttgaagcgcatagggt

SEQ ID NO: 54928 - protein, 90 aa, Zea mays
  misc_feature: Ceres CLONE 1483641
  misc_feature (53)..(53): Xaa is any aa, unknown, or other
  misc_feature (75)..(75): Xaa is any aa, unknown, or other
  misc_feature (78)..(78): Xaa is any aa, unknown, or other
  misc_feature (79)..(79): Xaa is any aa, unknown, or other
MAASIGIMDGAYFVGRGEILHWINATLQLSLAKVEEAASGAVQCQLMDMVHPXVVPMHKGHFDAKTEYDMIQNYXVLXXRVFTAADRAEY

SEQ ID NO: 54929 - DNA, 834 bp, Zea mays
  misc_feature: Ceres CLONE 1483646
  misc_feature: Translation starting site: 214
  misc_feature (30)..(30): n is a, c, t, g, unknown, or other
  misc_feature (49)..(49): n is a, c, t, g, unknown, or other
  misc_feature (610)..(610): n is a, c, t, g, unknown, or other
ttccccccccccccctcatttattttcttntccccaccccccccccacnaaaactggagctccccgcggtggcgggcgctctagatctagtggatcccccgggctgcaggaattggcacgagaccattacctagaacatcctaatcgaaaagatcgattcgtctccgatctcctccttcgaccgccgccaccttcgtctccgagactccgacgatgtcctccgccgccgatgaggatgcgttgtcgtctgacaaggggaagaagagggaggaggacggcactgacgggaggagccaacgtcaggagggtgtcgaggtggccgacgggaaagtggatctaggagacctgtacggcgcggcggcggggtgggtagaggcgcggaccagctgcccgcacatcggcaccatgccacccgctggtgctgacgatgtcgcgcgcgtgccttcacccgactctccgggcttccgatgtaccaacctccgccccaaactgagtaatgcttaatatgcaaaagatgggctcttgcggcccgtttttttcagcgcccagatgggggggggtatccttccagatacctgcggccctggtcctttggccttgtagctcccgnggactctggtcaagctccggcggttttctcattggggaatccgcgcctaagtatggttctggcccattcgttgaaatccgcccccccccgggtttgcaggggtggtaaaatttgcggggggagggtattgtaaaccccgtccacccacgttaaccgattggcctatgagagtagccgggcgtgttctcggtgatcctggggcaaaacagatgtgaaacgtgtga

SEQ ID NO: 54930 - DNA, 719 bp, Zea mays
  misc_feature: Ceres CLONE 1484117
  misc_feature: Encodes the peptide sequence at SEQ ID NO. 54931
aagctggagctccccgcggtggcggccgctctagaactagtggatcccccgggctgcaggaattcgtctcacccctagaaaaaaccactcatcaccagctagtagctctagcaaagcacttgccatctaccgaccgccgcattccaaacagcccgacgagctaacagagcggcaggcacctcctccaggaacatggcccgcacgcagcagttggcagtagtggcgacagccgtggtggccttggtgctgctggcggcggcgacgtccgaggcggccatcagctgcgggcaggtggcgtccgccatcgcgccctgcatctcctacgcgcgcagccagggctcagggccctccgccggctgctgcagcggcgtcaggagcctcaacaacgccgcccgcaccaccgccgaccgccgcgccgactgtaactgcctcaagaacgccgccgccagcgtcagcggcctcaacgccggtaacgccgccagcatcccctccaagtgcggcgacagcatcccctacaccatcagcacctccaccgactgctcccgggtgaactgaaccctaaacgactacgacggcccccggcggccgccctgaagacgaaccacaaccatcccgccctccttccgcgccttgcggttcggaccgtccatgaccatatcttaccttcgcatgaacaccaactttgcatgtctaccaactactcttgaataaaaaaaacg

SEQ ID NO: 54931 - protein, 120 aa, Zea mays
  misc_feature: Ceres CLONE 1484117
  misc_feature (31)..(116): Pfam Name: Tryp_alpha_amyl Pfam Description: Protease inhibitor/seed storage/LTP family
MARTQQLAVVATAVVALVLLAAATSEAAISCGQVASAIAPCISYARSQGSGPSAGCCSGVRSLNNAARTTADRRADCNCLKNAAASVSGLNAGNAASIPSKCGDSIPYTISTSTDCSRVN

SEQ ID NO: 54932 - DNA, 708 bp, Zea mays
  misc_feature: Ceres CLONE 1484118
  misc_feature: Encodes the peptide sequence at SEQ ID NO. 54933
  misc_feature (708)..(708): n is a, c, t, g, unknown, or other
aaagctggagctccccgcggtggcggccgctctagaactagtggatcccccgggctgcaggaattcgtctcacccctagaaaaaaccgaagcttctcagtagtaaatggcggctccctcctccaccggcgacaccatcatcagctcctgctgccgcctcgggcctccctctccgcccgaacaagccgctgcaggcgctcgcacgccgcaggcgccagcagcaagcgtgtcggcgtcacacgctctgcgcggggcgtgcgtggcacccgcgccgtgccctgcgatagatatggctggccgccgccacatagcgctggcccgacaccgggaatacgtcgacacgtggaccgacgccatgcgcgccgcgcgcaccaaggcgccggcacggtggattgagctcatgcagagaccaccgtggagcgcctactcactggagaacggcgagcccgagaacctgtctcgcccgaccgagcccagaaggttcgacagcatcttcggtctcggagggctcgcgggacttactggcgccgccgacatctggtctcacggtggtgcgactccgcacggacagcttctcactctgacgcaccacgggcaacttgcgtaattctgaggctgcaagaaaaaaaaagcgacaaatgtggaaaatcgagggtttcattgtctcaatatctcacgaattcctgtctgccacttaaaaaaaaaaaan

SEQ ID NO: 54933 - protein, 105 aa, Zea mays
  misc_feature: Ceres CLONE 1484118
MAGRRHIALARHREYVDTWTDAMRAARTKAPARWIELMQRPPWSAYSLENGEPENLSRPTEPRRFDSIFGLGGLAGLTGAADIWSHGGATPHGQLLTLTHHGQLA

SEQ ID NO: 54934 - DNA, 685 bp, Zea mays
  misc_feature: Ceres CLONE 1484119
  misc_feature: Encodes the peptide sequence at SEQ ID NO. 54935
  misc_feature (439)..(439): n is a, c, t, g, unknown, or other
  misc_feature (509)..(509): n is a, c, t, g, unknown, or other
aaagctggagctccaccgcggtggcggccgctctagaactagtggatcccccgggctgcaggaattcgtctcacccctagaaaaacaaggtgctgaagcaggtgcacccggacattggcatctcctccaaggccatgtcgatcatgaactccttcattaacgatatcttcgagaagctagctgctgaggccgccaagctcgcgcgctataacaagaagccaaccatcacctcccgtgagatacagacttccgtgcgcctcgtccttcccggggagctcgccaagcacgccgtctccgagggcaccaaggccgtcaccaagttcacctcggcctaggctgcgctgccgccgcttgcaggattgtctcctgtgttcacgtgtattgctgtagttaggtgctgctggtttctgtctgtacccatctgtctgtagcaactttngtatctgataggaccgtaatggtgcttatttaacccagctatatgtttctatgtgaatcatctctctatncggtgttgagtacctttatattgtgatgatgtggatgtgatttataaaatgcgtcagtttctaccgctaaaaaaaaaaaaaaacgaaacgctcaaggtacccattcccccctaaagtgagccgaattaccccccgcctcactgggccgccctttttcaaccccccgggacggggaa

SEQ ID NO: 54935 - protein, 66 aa, Zea mays
  misc_feature: Ceres CLONE 1484119
MSIMNSFINDIFEKLAAEAAKLARYNKKPTITSREIQTSVRLVLPGELAKHAVSEGTKAVTKFTSA

SEQ ID NO: 54936 - DNA, 836 bp, Zea mays
  misc_feature: Ceres CLONE 1484122
  misc_feature: Encodes the peptide sequence at SEQ ID NO. 54937
  misc_feature (9)..(9): n is a, c, t, g, unknown, or other
  misc_feature (13)..(13): n is a, c, t, g, unknown, or other
  misc_feature (19)..(19): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
ttttttttngttnttgttnttttggnnnnnnnnnnnggccgnnnngcaaactggagctccccgcggtggcggccgctctagatctagtggatcccccgggctgcaggaattcgtctcacccctagaaaaaaccccctctcgctcgcctccccgccactcccctcccgtccctatggcggccgttaccacagccactgccgccgcgtcctcctcctccttcctccaccgccgaagccccgcctgcctgcgcgccacgctccgcgccgcgccgcggcactgccgcaactccagctccaggctcgcctgccgcgccgccgaggtgtccggggccgaatcgtcctcggccgcggcggagggcgcgcgaagaggcgggggctcgtcttgggtgcccgtggttgctcttgtcgtgttttttctctcaaagtgcccccgtgatccggcaatgacattgatgagatcttgctgcctcacccacaagaaccaggatcttcccacaaccaaaaaccggatcgcgcaatggtagcgccgccttacaccccaagggccctcctccgacgcggagagtttctgtgattgtacgcggtgacacaggtctgcctcctataactataacccccccccctcttatcctcgcgcacctgggggaagctgacaacaaaaaggtaaccccccaatacttctccttcttctccctactaccgcttccaacgcgacgcaacatcgcctacccaacccgaggaagggagccaactgcccgatagagggaggaaggtgggagtgagaaatagaataagatctcgccactagagaacaacacacgactgtaatcccttaag

SEQ ID NO: 54937 - protein, 116 aa, Zea mays
  misc_feature: Ceres CLONE 1484122
MAAVTTATAAASSSSFLHRRSPACLRATLRAAPRHCRNSSSRLACRAAEVSGAESSSAAAEGARRGGGSSWVPVVALVVFFLSKCPRDPAMTLMRSCCLTHKNQDLPTTKNRIAQW

SEQ ID NO: 54938 - DNA, 813 bp, Zea mays
  misc_feature: Ceres CLONE 1484125
  misc_feature: Encodes the peptide sequence at SEQ ID NO. 54939
gaagctggagctcaccgcggtggcggccgctctagaactagtggatcccccgggctgcaggaattcgtctcacccctagaaaaaaagcagatagcagcaagctaagcaagtgccaaccaacgagtagcaggaaacatgtctccgcccgtcaagatcctcggccactacgcgagcccgtactcgcaccgcgtcgaggccgctctgcggctcaagggcgtgccgtacgagctggtccaggaagacctgggcaacaagagcgagctgctgctcgccaagaaccctgtccacaagaaagtgccccgtgctcctccatggcgacagggcccgtctgcgattccctcctcatcctccaataacttcgactaaggctttttacgggccctccatccggggggggggggcgcccctcacccttgccttccccccgttttccgcgcggaacttttttgggactccaagttcttccccactcctctccctggggtgatgaaactgggtgttatagtgttaatgtcgcaatatatcccctttggtgtatagaaaagccaaagggagaaaacgggggggtgtcccgggtgagggggtacctttgtctcgggaagattttttttctgtggtgtggaatccccttcggtgatccctcttgatattaaccttacctctctccgtttgtggccttttgatatcgctgtgtcgctgagtagttggattctctacggttcctttttcttgaacctcgccatacggttccccccctcttttctctgtctgcttctttgtgtcgattctatgtctttttttatgtttctgtgt

SEQ ID NO: 54939 - protein, 76 aa, Zea mays
  misc_feature: Ceres CLONE 1484125
  misc_feature: SWISSPROT Homolog: EC 2.5.1.18 Glutathione transferase
MSPPVKILGHYASPYSHRVEAALRLKGVPYELVQEDLGNKSELLLAKNPVHKKVPRAPPWRQGPSAIPSSSSNNFD

SEQ ID NO: 54940 - DNA, 713 bp, Zea mays
  misc_feature: Ceres CLONE 1484130
  misc_feature: Encodes the peptide sequence at SEQ ID NO. 54941
aaagctggagctcaccgcggtggcggccgctctagactagtggatcccccgggctgcaggaattcgtctcacccctagaaaaagcccgaccccaactcacccgacgcccagctccccgagtcgcaccgcatctccctcagggtgacgtcgccgtacgggaacagcatgcactacgcggagaacgtgcagtcgggccacttcgccttcacggcggcggaggccggcgactacctggcctgcttctgggctcccgaccacaagccgccggtcaccatcgggttcgagttcgactggaggagcggcgtctccgccaaggactatcccagcgtcgccaagaaaggcaaggtcgatatgatggaattggagctgaagaagctagaggaaactataaaaaatatacatgaagagatgctttatctgcgtgaaagggaagaggaaatgcacgacgtgaacaggcgaacgaactcaaggatggcttggctagggttcctctccctcggcgtctgcttatcagtggcaggtttgcagctgtggcacctgaagaccttctttgaaaggaagaagttgttgtagactgtagttggcccatgggtcacagtagacctcagcgcaggtgtaacctatttttggcggaactgcccatccgttacggaacttggaatcccatgtaacaaacggtatgtccgactttgaaaaaaattctttcagcctgt

SEQ ID NO: 54941 - protein, 135 aa, Zea mays
  misc_feature: Ceres CLONE 1484130
MHYAENVQSGHFAFTAAEAGDYLACFWAPDHKPPVTIGFEFDWRSGVSAKDYPSVAKKGKVDMMELELKKLEETIKNIHEEMLYLREREEEMHDVNRRTNSRMAWLGFLSLGVCLSVAGLQLWHLKTFFERKKLL

SEQ ID NO: 54942 - DNA, 555 bp, Zea mays
  misc_feature: Ceres CLONE 1484141
aaactggagctccccgcggtggcggccgctctagactagtggatcccccgggctgcaggaattcgtctcacccctagaaaaaagccgctcctgccattacacgtcccgagagcagcgcctgagcggagcccaggaggccaggacccatggccgtcaccgccgtcgcggcgtctatgtccgtggcgcaggggctcgggaagccccctctgcgccgggcagcaaccgcgacgttcgcttccgggggggttggggttttgggcccccggtttttttggggggggccccgggatgggccctctttccgggggctcttccccgccatttaggaagcaaaccccccccgcccaaaaaatgtgtggggggccccctggggggccttttttttgggcggcccctttttgtgttcctcccgaaaggtcccgcaaaaacccccccccccccggaatatttcccccccccccccccctcaaaaaaaaaatttttccccccccccccccaacatattttttccttcccaaaagaaaaaaggtgttttttttttttccccccccccat

SEQ ID NO: 54943 - DNA, 700 bp, Zea mays
  misc_feature: Ceres CLONE 1484143
  misc_feature: Encodes the peptide sequence at SEQ ID NO. 54944
  misc_feature (613)..(613): n is a, c, t, g, unknown, or other
aaagctggagctccccgcggtggcggccgctctagaactagtggatcccccgggctgcaggaattcgtctcacccctagaaatcgttcgaggactggggccaggggaaggcgctcaagtgccccgacctgaacctggacctctgcatcagcccgccgtgccaggaggaggaggaggccatgctgctgacgccggtgaagcgggaggaggccgggctctgcttctgctgcagcctggggctccccaacagcgcggactgcaagtgcaccaacttcctcgggctcacgaccgccatgctcgacttcagaagactccagatgaaatgagagcttccatccatctctgtctgtctctctctgtaacttcacccctgataacacgcactactagtagtcaccaactgatttgtcgcaacattctgtctctctctctctctctctctctctctctctgtatatacatatatatatatatctggatatgatagagccacatatatctccacttcctggcgttgatccccatcgacgcctccgtgtctaggctggatgaatcaatgagcaacccatcctgcgaccctgaaaaagaggccccgaggatcttggagaaatccnagtcaatcacctgtgcgaaggagctgtactcttcgaagtatgatttgtctgaacagcttccttgcgagaccccaggcgtgatgcata

SEQ ID NO: 54944 - protein, 48 aa, Zea mays
  misc_feature: Ceres CLONE 1484143
MLLTPVKREEAGLCFCCSLGLPNSADCKCTNFLGLTTAMLDFRRLQMK

SEQ ID NO: 54945 - DNA, 741 bp, Zea mays
  misc_feature: Ceres CLONE 1484146
  misc_feature: Encodes the peptide sequence at SEQ ID NO. 54946
ctagctggagctccccgcggtggcggccgctctagaactagtggatcccccgggctgcaggaattcgtctcacccctagaaaaagctgcatggcatgcacttgtatttcttgtgcctgcttaatgctgggctatccgccggtctcttgctctgatagcttgctccaggatgcaggtacgtacgtagatcaatccatcgatcgctagctagctgacgaccatggcgtccctctcctctgccgccatcaccgccccttccttcacggccgcgcccgctcgcgcagtggtcagcacgaggtccttcaccgtgcgtgcctctctccgcaaggccactgccaccgccgccgtgggcgttgccgccagcgtcctgcttgccggcggcggcgccatggaccacgatgtgctgctgggcacaagctacggcgggctcgtcttcgagcccatccagttcaccgtcaaggcctgcgacaccatcaccttcaagaacaacgccggcttcccgcacaacgtcgtgttcaacgaatacgaggtgccgagcggcgtctacgcctccaaaatctcgcatgaggagtacctcaactgcgccaggcgagacctactccgtcccccttccccgtggcgggcaccttacgccttctactggggagccctcaccaaggagcacgaaagggtccggcaaaatccccctccaactaaaaacaacctatgccatttccatgaattttacgctccgttaaaaacc

SEQ ID NO: 54946 - protein, 174 aa, Zea mays
  misc_feature: Ceres CLONE 1484146
  misc_feature (59)..(147): Pfam Name: Copper-bind Pfam Description: Copper binding proteins, plastocyanin/azurin family
MASLSSAAITAPSFTAAPARAVVSTRSFTVRASLRKATATAAVGVAASVLLAGGGAMDHDVLLGTSYGGLVFEPIQFTVKACDTITFKNNAGFPHNVVFNEYEVPSGVYASKISHEEYLNCARRDLLRPPSPWRAPYAFYWGALTKEHERVRQNPPPTKNNLCHFHEFYAPLKT

SEQ ID NO: 54947 - DNA, 730 bp, Zea mays
  misc_feature: Ceres CLONE 1484147
  misc_feature: Encodes the peptide sequence at SEQ ID NO. 54948
aagctggagctccccgcggtggcggccgctctagaactagtggatcccccgggctgcaggaattcgtctcacccctagaaaaaaaaaggcgcaacacgcgcgcgggcggtgaacgatatgcatccgctggcgctggtggaggcgctcgtcggggaacggcagcactgggcgccggcggtgcggcacgcggcggcgtgggcgggggcgctcgcgctcgcggtgtccgtcgcgtcgttcgcgccggaggcggccttcgtgtgggcgctggcgggaggcggccccgtggcggcgtgcgcggccgggacggtgcgcgtgccgctggacggcggaagggaccacgtctgcgtgcccggcgcgatggccgggcggtccggcatcgacctgctcgtgccgccggcgttcgcggggctcgcggtgggcgcgtccgcctgcttcgtcagggctctcgccatcgggccgcgccacgacgagtaccacctaaacccgtttctggcttgggaactgaggcatgccttactggatttcctcccggttggcaaagcgtacaaaaaaacccggggggctaccctgaaacttggacattaacccccgggttaattaattggcacctttcccctggaaaaaaaaaaaaaaaaccggccccctcggggggccccaattccccccataagggggagggtaaattcccccgccccccttggggcggttttttttaaaaggcgggagaagg

SEQ ID NO: 54948 - protein, 155 aa, Zea mays
  misc_feature: Ceres CLONE 1484147
MHPLALVEALVGERQHWAPAVRHAAAWAGALALAVSVASFAPEAAFVWALAGGGPVAACAAGTVRVPLDGGRDHVCVPGAMAGRSGIDLLVPPAFAGLAVGASACFVRALAIGPRHDEYHLNPFLAWELRHALLDFLPVGKAYKKTRGATLKLGH

SEQ ID NO: 54949 - DNA, 852 bp, Zea mays
  misc_feature: Ceres CLONE 1484148
  misc_feature: Translation starting site: 223
  misc_feature (18)..(18): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
tttttttttttttttttnttttttttnnnnnnnnnnaaacctatnnnnntcacactggagctcccctcggtggcggccgctctagaactagtggatcccccgggctgcaggaattcgtctcacccctagaaaaaattctgagccagacaatcaaaagctaccccctatccgatccaaccctctctggctgctcctccgtccggccggcatcggcagtgcaggatggctctgaggatgtgggcgagctcagccgccaatgcgctcaagctctcggcgggcggcggcggagcccgggctgctgctgccggcccggccttctctatctccaggttcttctccactgttcacgatgggttgaagtacactcagtctcacgaatgggtcaagacgacgggcgacgtccccccccgttgggcatcacggaccatgctcaaggccacctggggaaaagggggtgtttcgtggagctgccccaacccccgtcacaaaaggtcgcccccgtgaaggaccccttctggcaaccgtggaaaagtggtcaagggcctacacatcaaccgttaacttccccccaatctctccggcagaaggcccttccaagggtcaaatggccaaaaaatggtcaaaaaaaacccccccggcccttgtataaaaatccaaagccccctataccaaaggaaccggggtggattatttacaaagtggtgaaaatcctaaaaacttccccggtggggaaggggggatacttcctttttttgtaaactcccccccacaaatatatcacaaaaaaatcttgtagaaataaataaaaaaaaacctcctactttaaaaaacaaaagagtcccttatacacag

SEQ ID NO: 54950 - DNA, 711 bp, Zea mays
  misc_feature: Ceres CLONE 1484159
  misc_feature: Encodes the peptide sequence at SEQ ID NO. 54951
agagctggagctccccgcggtggcggccgctctagaactagtggatcccccgggctgcaggaattcgtctcacccctagaaaaaatcttccaccgcgcttcgcccactcgctccagccgcttcaccgcgccgccaccgccaccgcgaggatgccgttcaagaggttcgtggagatcgggcgcgtggccctggtgaactacggggaggactatggccgtctcgttgtcatcgtcgatgtggtcgaccagaacagggcacttgtggatgcccctgatatggtcaggtgccaggtgaacttcaagcggctctcacttactgacatcaagattgacatcaaacgtgtccccaagaagacagccctgatcaaggcgatggaggaagctgatgtgaagaccaagtgggagaacagctcatggggcaagaagctgattgtccagaagaggagagcatcgctcaatgactttgataggttcaaagtcatgctggcgaagattaagaggggcggtgctatcaggcaagagctcgccaagctgaagaaggcgtccacggcttaaggagtctctttccgtgaatgtcatgttagagtttttggttatgagttggatcaccaattcgattgagcgttgtcaaaaccagaattacccatatgttccctgtaaacccatttcaactttatcaagcacgggcgtgctcaagatacttttggccata

SEQ ID NO: 54951 - protein, 134 aa, Zea mays; identical to SEQ ID NO: 12674
  misc_feature: Ceres CLONE 1484159
  misc_feature (44)..(120): Pfam Name: Ribosomal_L14e Pfam Description: Ribosomal protein L14

SEQ ID NO: 54952 - DNA, 881 bp, Zea mays
  misc_feature: Ceres CLONE 1484160
  misc_feature: Encodes the peptide sequence at SEQ ID NO. 54953
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (19)..(19): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (34)..(34): n is a, c, t, g, unknown, or other
  misc_feature (42)..(42): n is a, c, t, g, unknown, or other
  misc_feature (43)..(43): n is a, c, t, g, unknown, or other
nnntttttttttgtgtttnttgtggtnnnnaaangccacggnncccatactggagctccccgcggtggcggccgctctagaatagtggatcccccgggctgcaggaattcgtctcacccctagaaaaaacggagaaaaagaaagaggagctcggacaaggcagcgccatcgttcggtttccttgctgaattcccgatcgctcgcccgctcgaaaagaaagaagctagcttttagcatggcgtctctggcgttcggcagcaccgtagcggcggccgtggcggcgacctcggggaggacgcggccggcgcgccggtccgtgctggtcgtgccgcccgctgccatcaggggcggcccggcgccggccaaggaggagaagggcctcggcgagaccatcttcggcttcctcttcaagaaggaccagctggtggaaaacagaacccgctcctcaacaaggtcgagcgccgacgccgagcccccgctctcccgcggccaagaacgaccgcccggcacagaaggtctggccggcgggcgaacgacaggctgtcagcgggcgaggggggttaccaacctgcggacggtccttcgggcggggcctctttcgcccaagaaaaaaccaccctgcaccggcgggccgttggttttatgggattatggcgcaaacgcacgaagcctgggaatatgcgccccttctgacgccggcgaaaaaaggaactgcctcaatataactttatacagtcgaccgccgatgggtggcgcgccgaacccagcgggaccaccctcaagggagaaaaaaaaggggaacgcgcacgcccgatctttgctcgtgcgccgaggggtaacaactatattacttaacgaaccgcgacgccgccctccgaccg

SEQ ID NO: 54953 - protein, 215 aa, Zea mays
  misc_feature: Ceres CLONE 1484160
MASLAFGSTVAAAVAATSGRTRPARRSVLVVPPAAIRGGPAPAKEEKGLGETIFGFLFKKDQLVENRTRSSTRSSADAEPPLSRGQERPPGTEGLAGGRTTGCQRARGVTNLRTVLRAGPLSPKKKPPCTGGPLVLWDYGANARSLGICAPSDAGEKRNCLNITLYSRPPMGGAPNPAGPPSREKKKGNAHARSLLVRRGVTTILLNEPRRRPPT

SEQ ID NO: 54954 - DNA, 803 bp, Zea mays
  misc_feature: Ceres CLONE 1484161-R2
  misc_feature (16)..(16): n is a, c, t, g, unknown, or other
  misc_feature (788)..(788): n is a, c, t, g, unknown, or other
ccaattgcgtacctcnagcgtctcgtttttttttttttttttgagtttccaactgaagttcattctaattgagctgcgcgttttctttacaaagagtatcagatcacagatcgcgttcgggaaacaataaagaaaaccgaacagcttcaggcagaggggtggatgcggcggcccgtactaactgtgcctgcgagatgtgtgcgtcaatgttgagctcatcgcatgccgatccgcggatcaactgacgatcagaaccttggagggaacaccctcggacctcgccaccgccggcggaatcctcagcgctccggccgcaagaaccgacaacgtgccactcctcgcggctgccttcctaatcctagcggagaggttggtgcaataatgcctgcgccgcaataagaagcgtcagcggtgcgcgtctgagggcgccgcctcagctcctcgacggcttgaggcgcttcccggccggcttggccaggtactctagcgaccccacggcggcgagcgatgcgaatgactgcgacttgccgctgaagaacctgtacagggacctcttgaagggacggagctgcgtcatgagggatgacatctagaagcgatccgatgacggagcggagccggacgattgtggcgacatacgcgagctacgccgacgaacacagcgactccctccacatggacatgcacatgggttctgatatcgatggatatgccattcttttttttcctaggcgggaaacgaaatctcgtgggcccctgccggatgtgggaaaaagtagaaggggctnccatgatgcgtccca

SEQ ID NO: 54955 - DNA, 933 bp, Zea mays
  misc_feature: Ceres CLONE 1484161-R
atcctgttgagctgttctttttattgcaaagagatcagatgtcagactccttgggaaacatatagaaatccgatcggcttcaagcagaggggtggatgcgagcgcccgtactaactgtgcctgcgagtgtgtgcctcaatgttgagctctcgcaggccgatccgcggctcaactgacgatcaccaaccttggaggcaacgccctcggccctcgccgccgccggcggcatcctcggcgctgccggccgcaatgaccgacaacgtgccattcctcgcggctgccttcctaatcctagcggagagcttggtgcaataccgtctgcgccgcaatgagaggcgtcagcggtgcgcgtcgagggcgcggccgcgctcctcgacggcttgaagctctccccggccggttgggactggtcgactcccgaccccacggacccgaacgatgggatcgacgtacgcacttgccctgctgtaacctcgacactgatcttcttgaagggaaggagctccgtcgtcgaggatgtcatctagaaccgacttcgatcagcgagccgcagcccgacgcagggggcgacaaacgcagagctcggccgattgaaacacggcactccctccagatttggaaaggccctgaggttcctgataaaccatggatgatccgatgtcaatctttcctgggcggtgagacgaaaacctgggaggcccgggggatctggtaaattctagagcggccgccatgatgggtggaaaaatccaaaatttgtttcccattaaagaaagctaaattggggccctggggtttttcttgggggtgacagtaactcctggaaaactggtggaccccccaaatttcaaacaggctaccaacccggaggaacaacggggtaacctccgctttcccaaagggataagcccccctgttatttcggggccctcc

SEQ ID NO: 54956 - DNA, 714 bp, Zea mays
  misc_feature: Ceres CLONE 1484161
atagctggagctccccgcggtggcggccgctctagaactagtggatcccccgggctgcaggaattcgtctcacccctagaaaaaacaccgggtcacaaccgctgcttgcttgcttgcgatcggctttggattcggggagctgctggatgcctacttcttgttctgactgggagggcgcacgagttcgcgtacgcggagcaggaggaggacatcggctcgcctccggattcacgaacccccggccacccccacatatagggagaccgcaacctcgtcggaatgagctcgacgacgacaccacctcctccggctcccgctccggttcgcacctcttcgagatacccgccctcatgactcaactccctcccttccagccgggcctgcccaggttcgacgaccgccagcctcagtccttcgcctcactcgcccccgtgcggtctctagaggacatgaccaagcccgcccagaagatcctccatccgtcgccaatctacggccgcgccctcgacgcgcaccgcggacgcctcatctcgacgctcatgtcttattgcaccacgactaccgctagtattcacaaggcagtcgctcagaccgatacgatatcgggtctcgaagcctgctcccccaagatgcctccggtcgccggaaggatctaagtcctgtctgcccacggacggatcacaagttgaatcaccgatctgacttgctgatccc

SEQ ID NO: 54957 - DNA, 699 bp, Zea mays
  misc_feature: Ceres CLONE 1484163
  misc_feature: Encodes the peptide sequence at SEQ ID NO. 54958
ggatcccccgggctgcaggaattcgtctcacccctagaaaaaatcccccggtatcttgcaatcacgtcgaacataagctctcgatctcaccgacaccgaggaagaagagatcaatggcgtctgaccagggagtcgtgatcgcgtgccacaccaaggctgagtttcacgcccacatgaccaaggcccaggaagccggcaagctggtggtcatcgacttcactgacgcctggtgcggtccatgccgcgccatcgccccactgttcgtcgaacacgccaagaagttcactcaggtcgtcttcctgaaagtggacgtggacgaagtgaaggaagttattgcggcctaccagggcgaggcgatgccgaccttccacttcgtcaagaacggcaagacggtcgctaccatcgtgggtgccaggaacgacgagctcctggccctgatcgagaagcatgccgcggctgcgcctgcgactgcttctgcctgaatgagatcacaacagacgaccccgtccttaacgggcagcacgtcatagctgttaatgttggcgttacttattactggctttgtacctttgtgggccaatttgtgacccagtcaaaaggtttggtttcttcctccagggcggcagcggattcgtcaaccaaatagataaaaaaaatacggacaccccctcctggcccctctatttcgccctataagat

SEQ ID NO: 54958 - protein, 122 aa, Zea mays
  misc_feature: Ceres CLONE 1484163
  misc_feature (8)..(112): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MASDQGVVIACHTKAEFHAHMTKAQEAGKLVVIDFTDAWCGPCRAIAPLFVEHAKKFTQVVFLKVDVDEVKEVIAAYQGEAMPTFHFVKNGKTVATIVGARNDELLALIEKHAAAAPATASA

SEQ ID NO: 54959 - DNA, 917 bp, Zea mays
  misc_feature: Ceres CLONE 1484176
  misc_feature: Encodes the peptide sequence at SEQ ID NO. 54960
  misc_feature (20)..(20): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
tttttttttttttttttttnttttctnnnngaggnnanntannnngcaaactggagctccccgcggtggcggccgctctagaactagtggatcccccgggctgcaggaattcgtctcacccctagaaaaatctcacgccgcaacctccctcgagcccgagcaaacaagggcggacgcggagccggcggcggagcggagatggcggagaagaagcgaggcgccggcactcgcaaggatgaggtggtgacacgcgagttcactatcaagctccacacacgcctccgcgggtgcacctttaagaagagggcacccaatgccatcaagggaatccggaagttctctcagaaagccctgggttctagttgatgttccggattgtgcgtgaaggctcaacaacgacctctggggacaaacggtttcccccagttgtggccgaggggggggccccgggctcgaaattatccccgcaaaccgcgaaccaattaagggaaaaccccctatagagagaaaaacctaccgcccccgggccacaacgggtggtgtaaaatacccccatcggctaggaggtctcctaaaagggtagtgggggacaaacacaacggattgtctaaacgatcacacacgcttcacccccccggcgctttctccatcggttaattctatagtgagaaaatgcggttctgttaggctcttatgttttgtactctctgcgcgcgcagaattacttattagtagaaaaatcgtatcctcgaagctcattccccccctctcaaaacacaccactaaaataaacacacgggaggtgttcttagggtgtgatgggcgccactcgcatcaaaacggatgtgcggtggccccgacacctttccctcggccgcagccgtggagaatacccaatatgatccccttagtgggaa

SEQ ID NO: 54960 - protein, 55 aa, Zea mays
  misc_feature: Ceres CLONE 1484176
  misc_feature (11)..(56): Pfam Name: Ribosomal_L31e Pfam Description: Ribosomal protein L31e
MAEKKRGAGTRKDEVVTREFTIKLHTRLRGCTFKKRAPNAIKGIRKFSQKALGSS

SEQ ID NO: 54961 - DNA, 801 bp, Zea mays
  misc_feature: Ceres CLONE 1484180
  misc_feature: Encodes the peptide sequence at SEQ ID NO. 54962
  misc_feature (38)..(38): n is a, c, t, g, unknown, or other
tgtgttgtttttttttttttttttttttgtttgttttnttgtaataaaacaaactggagctccccgcggtggcggccgctctagaactagtggatcccccgggctgcaggaattcgtctcacccctagaaaaaactaccaccagtaccactccactccgcgctagctgaggacggtacagcggcacagaggtgcgacgtacgacgacgacgacgcaggcgccacacatggcatcccagctctccgccgccgtgccccggttccacggcctccggggatacgccgcgcccatgtccgcggtggcagcactgccgtccgtgaggatgggcaagaagaggtcgtcgacgcacggcattcaactgaaattaacatctgctcctcttcctacctggatatggtgacgactacaaccctgatgcttgttcgctgggaggttcgcgcctgccgccctccggctacccgtatggcggactgtcgcccccgaaggttgaaaggtgcctgactcccgacctctaagacttggtggaccccgtcctggtttcccccctccgccgacctgcttggcacttcctgggttctttatggcaacatttcttctgtgtacggcattcttagcttccggatccctcaaaactccgggccccactcataccagaccgcgcgtgctccaccccccaacccccgtcccctttctaagaacctaatatcactacaccctcgattctccctctaagtgttcactagtttgcattacatgtatctgattacccaaacacgagaccacaccacaaaattatctcat

SEQ ID NO: 54962 - protein, 57 aa, Zea mays
  misc_feature: Ceres CLONE 1484180
MASQLSAAVPRFHGLRGYAAPMSAVAALPSVRMGKKRSSTHGIQLKLTSAPLPTWIW

SEQ ID NO: 54963 - DNA, 910 bp, Zea mays
  misc_feature: Ceres CLONE 1484185
  misc_feature (6)..(6): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (774)..(774): n is a, c, t, g, unknown, or other
gggggngggtgggggnnnnnncctttctctcnnnnnnnggttannnnnactaagctggagctccccgcggtggcggccgctctagaactagtggatcccccgggctgcaggaattcgtctcacccctagaaaaattcgtcggagccttgtgccccggctcggttcactgctctaggtgcgcagcgatcactagagacggcggtgccgctgctgagcgagagggatggtgaagaagcgggtctcgccgttccagaggccccaccttgaccgctaaaagtggcttaagcccagctgggggacgccaaagggtattgattcccggggtcagtggaacttcaaggtatgccccgtggttgggcgagatctggcctcgggctctgtctcctcccactgcccattggccgtcccccggcgggttcgacattgttttatagctcattgaagaggggggggggagggaattccctccttggtttcttggccaggcccccccttggttggggaggttagattttaaactctctgtttcactttgcgatgggggggtgtgtccttcgctgtcacttttctcgtccttctttttactatttagatcttctcttccgagctctggcacgtcttgtccctccgcccggccgccccgtcctggcttctttacttctgtgtggtttctttgctttaagtgttacgcgaacatattgttgtgggcgcccccctacattgtgtctgtctcctgtgcgtcgctggagcggtaagtgagtggtcaggggggcnggcggtgtagctgcggatgtcgcgaggtgtttggtgattgacatgtgttgatatgctcgaatacatccgtgtcctgcgcaataaatctcgccgaaaccctagggtggcccctcgcccttaccacacatcctaatta

SEQ ID NO: 54964 - DNA, 720 bp, Zea mays
  misc_feature: Ceres CLONE 1484188
  misc_feature: Encodes the peptide sequence at SEQ ID NO. 54965
atagctggagctccccgcggtggcggccgctctagaactagtggatcccccgggctgcaggaattcgtctcacccctagaaaaaattctgagccagacaatcaaaagctaccccctatccgatccaaccctctggctgctcctccgtccggccggcatcggcagtgcaggatggctctgaggatgtgggcgagctcagccgccaatgcgctcaagctctcgggcggcgccggagcccgggctgctgccttctctatctccaggttcttctccactgttcacgatgggttgaagtacactcagtctcacgaatgggtcaagacgacgggcgacgtcgccaccgttggcatcacggaccatgctcagggccacctgggagaggtggtgttcgtggagctgccggaacccggcacgaaggtcgccgcgggaggacccttcggcaacgtggagagcgtgaaggccaccagcgacgtcaactccccgatctccggcgagggcctcgaggtcaatgccaaactgtcagaaaacgcccggcccgatcaacacgaacccgtaacaaggacgggtggaatgttcaaagggaaacccaaacaacccccgggggaggcggaacaccctggtgggaccccccccaaatacccccaaaccattccccagggaggaaaaacacctccctttaaaaccccgggcccgcccccactaccaaaaaaggcgttggtat

SEQ ID NO: 54965 - protein, 183 aa, Zea mays
  misc_feature: Ceres CLONE 1484188
  misc_feature (40)..(160): Pfam Name: GCV_H Pfam Description: Glycine cleavage H-protein
MALRMWASSAANALKLSGGAGARAAAFSISRFFSTVHDGLKYTQSHEWVKTTGDVATVGITDHAQGHLGEVVFVELPEPGTKVAAGGPFGNVESVKATSDVNSPISGEGLEVNAKLSENARPDQHEPVTRTGGMFKGKPKQPPGEAEHPGGTPPKYPQTIPQGGKTPPFKTPGPPPLPKKALV

SEQ ID NO: 54966 - DNA, 732 bp, Zea mays
  misc_feature: Ceres CLONE 1484192
  misc_feature: Encodes the peptide sequence at SEQ ID NO. 54967
aagctggagctccccgcggtggcggccgctctagaactagtggatcccccgggctgcaggaattcgtctcacccctagaaaaagttacaatctcaaataactccgtcccttccggccttccctctatctttcgctcgctctcggcgacagctgggcgaccgtcgtcgccgccgcccttctctaggtgcccaggtcttcgccggtccctttgccgcctcttcgccgccgatgagcaccagccaggaagaaaagaagttgaaccatggggaagagaaagtcagctgctaagccacctcctaagaagcggatggacaagcttgacactgtcttttcctgcccattctgcaaccacgggagtagtgttgagtgccaaattgacatgaagaatctgattggcgaagcatcttgtagaatctgtcaggaaaacttcagcacaactgttaatgatatagtgaatggattgacaagtgtgagcgtgtcaaccctgttgaaagcgacaatgatgcgtgagctttgcccctgcgaatgaaactgttacccacaaaccgaaagggaagggggcggggattcccccaagggcattaccccatataccacccctgggtttgggaaaacactaatgggcttaattatattcgcccttgggcccccttttttttgacctttcaaaaaaaaaaaaaaagtgtggcccttagactatatggggaccacccctttaatgggggggtttgg

SEQ ID NO: 54967 - protein, 88 aa, Zea mays
  misc_feature: Ceres CLONE 1484192
  misc_feature (8)..(68): Pfam Name: Elf1 Pfam Description: Transcription elongation factor Elf1 like
MGKRKSAAKPPPKKRMDKLDTVFSCPFCNHGSSVECQIDMKNLIGEASCRICQENFSTTVNDIVNGLTSVSVSTLLKATMMRELCPCE

SEQ ID NO: 54968 - DNA, 894 bp, Zea mays
  misc_feature: Ceres CLONE 1484195
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (15)..(15): n is a, c, t, g, unknown, or other
  misc_feature (20)..(20): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (43)..(43): n is a, c, t, g, unknown, or other
  misc_feature (45)..(45): n is a, c, t, g, unknown, or other
  misc_feature (46)..(46): n is a, c, t, g, unknown, or other
  misc_feature (680)..(680): n is a, c, t, g, unknown, or other
  misc_feature (894)..(894): n is a, c, t, g, unknown, or other
nnnnnnnnnnttttnttttntttttttttttttgnnncgagtntnnaacaaagctggactccccgcggtggcggccgctctagactagtggatcccccgggctgcaggaattcgtctcacccctagaaaaaaaagccccactctctgccatctagagctccctaactgcaccggccgccacaccaccgtaccccgacccctcgacaacaatggccaccgtcctatggcagcccccgcgcgccggccttcttcttctcgccgtcctccctccgtgtccgcgccgggcccaccgcctgggcgctgcctgcgggccaagggggcttcttgtggctattaaccagcgtcaggtgttggttttttctcccttccctcctaatatgttgaagtttcttcccccctattggtaaagctttattttctcggggctcctatttcctgggaccccccttgagccccgtgcaaagagtgtaattgcacgcccccgccgccccacacacttttcccccaagacacccctccataatcaaccccgcttcgatgaaaaaggctgccgcttcccccccccccgcgggaaaccatccccacaacaaaatacgataaccatcgataaaaccccgccaagaaaaacctccgatcaaacagtctgatatcaactcaccccatccaacgatccgaacatncttggagtgatcgcacctctttttcacccccccctctctatcagtctattctcctgccgtctgttttttcattggctttactcctcatctgtccactctattaatgtaggcggtcccttaccgggggggggcaaactgagagcccgtgcggcatgtaagagaaaatacagaaaaagaactaacaaaccgatcctacactaccactacctccccn

SEQ ID NO: 54969 - DNA, 741 bp, Zea mays
  misc_feature: Ceres CLONE 1484197
  misc_feature: Encodes the peptide sequence at SEQ ID NO. 54970
atagctggagctccccgcggtggcggccgctctagaactagtggatcccccgggctgcaggaattcgtctcacccctagaaaaaaagggtatggatgacatggttatgacactgagagagagagagacagaggccttgctcgttcgttctccaccacggctccgatctgttcgcgctgctggcatagatgttcgatgcgacgacgggccaattgatgtcctgctgggagcatgtgcacagtgctcctctaggagtatggctgcctctacgcctgcttcttcactgctctgtgctgcttctgctgctgccagacctgcatgtgctgcctcccctgcctctgctgctgcggctccttatccgctcttgctccgcaggtcggaccacacgcaacggatgctggtcgcctccttctcttctacttccctaccaatgtaccatttcgtcatgagtctactcacattgattctggtggtctgcaagagcatgcataattgcgcacggatgttctaacatacctcatgagagatgttgttctcttggaactccgaaatcaggttgaggcattttgcgtcacagtttgctatgccacgttttgatgtatgaatgggcatatatactgtagtccagcatttatccagattcccagcaacctttgtcctgcccctcagttcctccaattcctccccaatcttggctctccactggccccccctatttgggacagttttttttttaagggtt

SEQ ID NO: 54970 - protein, 57 aa, Zea mays
  misc_feature: Ceres CLONE 1484197
MCCLPCLCCCGSLSALAPQVGPHATDAGRLLLFYFPTNVPFRHESTHIDSGGLQEHA

SEQ ID NO: 54971 - DNA, 840 bp, Zea mays
  misc_feature: Ceres CLONE 1484200
  misc_feature: Encodes the peptide sequence at SEQ ID NO. 54972
  misc_feature (15)..(15): n is a, c, t, g, unknown, or other
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
ttggttgtgggtttnttttnncnnnnnaggaccggggggggtgttttttcaaagctggactccccgcggtggcggccgctctagaactagtggatcccccgggctgcaggaattcgtctcacccctagaaaaagcctgccaccacagaataatggagcggcagactcgattcgtcctgctcgtcttcgccatcggggctctcctcgccagctccgccgccgcggacttgtcggcggctgctggttccctgcacgcgctgccgctgcggcgcgtggaggacgacgacgcaagcagcttcgtggaggaggcggcgtacccgccgaggagggcgctgtacgggggcgggtccatcagctacggggcgctcaccgcgaacaaggccgtctgctacggctcgtgcgccgctcgtgggcaggcgtatacccgcggctgcctggccttctacgggtgccgaggtggcccgttaattaaccccaaaccgttgcgtaacctagcattcgaatgtcttgtttaattccatggccagtttccttgtgcccgcctctcacggtgttttcttccaaataccccattctccatgcgctcaaaaaaatgcgccaaaaatcccgaatcacataatatccattggcgggtctttcccaccgtgtcctcgccaggtgtaatattttcccgacagtagagaaaatattgtgctccttctccgaattaatgtaatatcaacctgtggcgtcctcttattattccttatttgtccccctattttgggttcgtcatatttcgccgcgccgacatcgggcgccctttatttaccacccccgcgggtcaggggacaaacccccg

SEQ ID NO: 54972 - protein, 120 aa, Zea mays
  misc_feature: Ceres CLONE 1484200
  misc_feature (42)..(102): Pfam Name: RALF Pfam Description: Rapid ALkalinization Factor (RALF)
MERQTRFVLLVFAIGALLASSAAADLSAAAGSLHALPLRRVEDDDASSFVEEAAYPPRRALYGGGSISYGALTANKAVCYGSCAARGQAYTRGCLAFYGCRGGPLINPKPLRNLAFECLV

SEQ ID NO: 54973 - DNA, 893 bp, Zea mays
  misc_feature: Ceres CLONE 1484202
  misc_feature (14)..(14): n is a, c, t, g, unknown, or other
  misc_feature (15)..(15): n is a, c, t, g, unknown, or other
  misc_feature (18)..(18): n is a, c, t, g, unknown, or other
  misc_feature (22)..(22): n is a, c, t, g, unknown, or other
gctcggaggccggnntcnaaancacgttatagttacgagtaaacccagcggaccaaacttggactccccgcggtggcggccgctctagaactagtggatcccccgggctgcaggaattcgtctcacccctagaaaaagatacaaacccgtcctctgtccgtcctaccaccacagctcaccgcggtttggctttctcccctcttccgcacccgcttctcgctacggattcccactgctctttccctaacgaaggtatccatggccgggtagaggtcaggcgatcggctcctgcgcccccaggaggccacctccaggagatcctcggctggtctacttttcccctccgccaatgttcgccactagcctcaagggactgaaggagtgccgtggagatgtcttattaattttagcacgaatcataacgcgcgtggcgcgtgcttgtaattatcctttggctgtctgtgtgttctttgtggcctgcccgtgctactatatttcctggtgcgcacaaaaaagaccacgccttcctctgtccaccagctaccacaacctaagagatcgccggtgccgaaaagcctctatatatgtgtgttaattaccttatgtttctattcggtcccaacaaagaaccgattggggcgtaggcgcggtgtatgataaaccgttccaacccgctcttcccacttcatcccacgcttcctcttcttaccaaattgccccacgccattctcgctacacaaaaacatatttgctgcttttgttgttctttatcaaaccctaagttggagtcgagtatacagacgcgggacactactactgtctcggcgatatccaattacgatttccgtcctggcgttcttattactctcctctccttcttcactatctctccc

SEQ ID NO: 54974 - DNA, 707 bp, Zea mays
  misc_feature: Ceres CLONE 1484203
  misc_feature: Encodes the peptide sequence at SEQ ID NO. 54975
aaagctggagctccccgcggtggcggccgctctagaactagtggatcccccgggctgcaggaattcgtctcacccctagaaaaagacgcgacgcctcaaatcgctccctgcctctggtcacctcgcttccgctcccggctcccctccggccacccagacatcgtccgttcgctcgccaagagacaggaccggagaccatggcggaccagctcaccgacgaccagatcgccgagttcaaggaggccttcagcctcttcgacaaggacggcgacggttgcatcacaaccaaggagctcggaactgtcatgcgatcactgggtcagaacccaaccgaggctgagctccaggacatgatcaacgaggtcgatgcggacggcaacggcaccatcgacttcccggagttcctcaacctcatggcccgcaagatgaaggacaccgactccgaggaggagctcaaggaggcgttcagggtgttcgacaaggaccagaacggcttcatctctgcggcggagctccgccacgtgatgaccaacctcggcgagaagctgaccgacgaggaggtcgatgagatgatccgcgaggccgacgtcgatggtgatggccagatcaactacgaggagttcgtcaaggtcatgatggccaagtgagtaaagcctgcggtaacggtatagtaccccgcgggaattgaaggaggaaaccaaaccgtg

SEQ ID NO: 54975 - protein, 149 aa, Zea mays
  misc_feature: Ceres CLONE 1484203
  misc_feature (121)..(149): Pfam Name: efhand Pfam Description: EF hand
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 54976 - DNA, 716 bp, Zea mays
  misc_feature: Ceres CLONE 1484204
  misc_feature: Encodes the peptide sequence at SEQ ID NO. 54977
aagctggagctccccgcggtggcggccgctctagaactagtggatcccccgggctgcaggaattcgtctcacccctagaaaaaattcagattcttcgaggcgcggcgagccggcgacggcggtcggcgacatggaggccgcggtgcccagccgtgttgcgctctccgcggcgagccgcctcccaaatccccacgccgtgacaggagatagatctttcatttacaagggaagatgccaaagtcttgcaattcctatggctttgtcagcagctgcgccaggcaaaggtggtggtgtgcttgatcggccagttgagaaaactactcctggtcgccagtctgaatttgatgtgaagaaatcccggaaaatgtcgcctccataccgtgtcatcctgcacaatgacaactacaacaggcgcgagtacgttgtcaaggtcctgatgaaagtgatccctgggatgaccgtcgacaacgctgtgaacatcatgccagaagcgcacgtgaatgggctgtcagtggtgattgcctgttcccatccaagcttaaggaccactgaccttcccttaagggggaagggccccgggaacccaattcaacccccaaagtggggcctcccaaagttccaaaccttgggaatacccttgtttccccccgtatattttttaaatacccccggttccagcttaaagctaaaacgggtgggttttattccccctcacc

SEQ ID NO: 54977 - protein, 195 aa, Zea mays
  misc_feature: Ceres CLONE 1484204
  misc_feature (77)..(149): Pfam Name: ClpS Pfam Description: ATP-dependent Clp protease adaptor protein ClpS
MEAAVPSRVALSAASRLPNPHAVTGDRSFIYKGRCQSLAIPMALSAAAPGKGGGVLDRPVEKTTPGRQSEFDVKKSRKMSPPYRVILHNDNYNRREYVVKVLMKVIPGMTVDNAVNIMPEAHVNGLSVVIACSHPSLRTTDLPLRGKGPGNPIQPPKWGLPKFQTLGIPLFPPVYFLNTPGSSLKLKRVGFIPPH

SEQ ID NO: 54978 - DNA, 894 bp, Zea mays
  misc_feature: Ceres CLONE 1484208
  misc_feature: Encodes the peptide sequence at SEQ ID NO. 54979
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (47)..(47): n is a, c, t, g, unknown, or other
  misc_feature (802)..(802): n is a, c, t, g, unknown, or other
ttaaaaaaaannnaaannannnnttctcgtgcgnnnnnnggannntntccaaactggagctccccgcggtggcggccgctctagactagtggatcccccgggctgcaggaattcgtctcacccctagaaaaaagaacgatctcaatctccctagcaatctctagcagcagatcctcgtgcgaagcaaagcgctagcccccttcgtactgtcccgatggcccgcacgaagcagacggcgaggaagtccactggcggcaaggcgccaaggaagcagctggccaccaaggcggcgcgcaagtctgccccggcgaccggcggagtgaagaagcccccacccttttccgccccggccccgtcgcgctccgggagatccgcaagtaccagatgagcaccgtagctgctgattccgcaaggtgcccgtttcagcggcctgggggcgtgaaaatcgccccgggaacttccaagaccgaacctcccgcttgccagaggctccgccggccacccgggcctgcaaggaaggcgtcccagagagccggagcctcggtggggggttctttccgtggaaacacccgatcccttctgggcggctattatctcccgtcccaaaacgagcgtgcgacccagtctgtggccccaagggaacatctcccgtgcttccgcccccccccatatttcccggttgggggagacggggcactataggcgcctcctccccgcggggccggaaggatggggaagccacctaatttcgcgccgtcttctcggagcgtccggtggctcgggcccctgaaactgggggttntgaccgcccgcccggcgacccaccatttttcgggcgattgtggggtgccaatggtggggaaggtgaatgtgggggggttccccgtcacggta

SEQ ID NO: 54979 - protein, 55 aa, Zea mays
  misc_feature: Ceres CLONE 1484208
  misc_feature (25)..(25): Xaa is any aa, unknown, or other
MGKPPNFAPSSRSVRWLGPLKLGVXTARPATHHFSGDCGVPMVGKVNVGGFPVTV

SEQ ID NO: 54980 - DNA, 793 bp, Zea mays
  misc_feature: Ceres CLONE 1484211
  misc_feature (793)..(793): n is a, c, t, g, unknown, or other
tccccgcggtggcggccgctctagaactagtggatcccccgggctgcaggaattcgtctcacccctagaaaaatcttcctcctcgcgaaacgacgcggaggaggttgccggtcaggccaccgccgcgcccgcccgcccgctggagacccggtccgcagccaacgcgtgacgtaaggaggacacgcagccatggccacttcctcctcgtcgctcacaacgctccactcccgcttcctctctctcaccccttcctcgccctacatggcggcgctgccccgaccgcgattggcctgaacccctttcccttctttttcgggccctttgaccctcacccgaacacagatttgtggccttttccggtgggccgcccttcttttctcccctgtggaaaataaatgatcccttgggttttctgtgggccccccaaatcgtttttttgtctctcaaaattgggtataaaaaacaatcttatatttttttcccccgtctatttcttttttcctcccccctcttttcacttcttttttctcatctgtttcacagaagaaaaatatttctcctgtcatttattgcggcgattgcggaaaacccgaaataacacctcctcgttttgtgacttattcacagcgatctgttctttttttgattatgaaaccttcttgcgagtgtaccccgctacctcccatcccccgtattttttatatccttatattatcataataaatatctcatgtaaataataccgtttctcctcacaataatatatgttgtacacaaaaaataaatcataacn

SEQ ID NO: 54981 - DNA, 721 bp, Zea mays
  misc_feature: Ceres CLONE 1484214
  misc_feature: Translation starting site: 559
aaagctggagctccccgcggtggcggccgctctagaactagtggatcccccgggctgcaggaattcgtctcacccctagaaaaaaacggccgtggttactggaagacagctatagtcccgtgttcagttgccgtcgtgggcaccgctgaatctcggaggcgaccgccctgggacgcgaagatgcagatcttcgtgtagacgtgacgggtatctcgatcttagttggatgttggttctcgaactggtggacgaggagacggacgggatctacgacacgggcggcatcccgccgaaccagcgcgggcacagcttcacctgcaaggtcctctaggacggatgcaacctcttctattacggcatcaaaaaggtctcccccttccacctggagctcagcctccgtggctgcggccagatcgccatcttcaaccccaaagtcgatgagatatctctactcacaatcatcacacggatggattcaaccgctcttcacctggtggatgtatgagaccacttgctagttgacacgactccgcaagatctgctccaatactcgttgccatgccgctcgtttacagggtccagcatttaccctggtgctcccagttgaaagtagggggatttcataatcctgctattgaaaaaagggacggctgcgggggcctgttttcggtaaaatcaaactatctttttggcctattgcaacatggatggtttccccata

SEQ ID NO: 54982 - DNA, 731 bp, Zea mays
  misc_feature: Ceres CLONE 1484216
atagctggagctcaccgcggtggcggccgctctagactagtggatccccccggctgcaggtattcgtctcacccctagaaaattttttccctctcacctctcaatccatggacaccctccctgctctgatcccccccgatgctcgctgtgggtgccgtttgctgccccaacgccgttccgcgccccctccactccggccatgagctcctcccagtgaatccctctagtcccctgctcatctcccatggtggccgcagggagctctggatccatggccgtccgcctctgggcgtgagcagcccttggctctctcccctgcgacagacttcctccaccgggtctttttcccaaccctggggggccgggtccctggctccccattcggggcccccggttcagggcccgttaaacctcggcaaaccccttcccctgggcaaaaagggcgaagcccttgctctaaccccatttccccattggaaaaccaaatcctcccccccccccaaaaccccaaaatccttggggaacccccccctgtattcctctttatttgaaaaaaaaataacccgcgaactccctccccttggattcgcgcctcacaacttggtggacccccccccgagaagagacctccccggcgcccccccaaaaaacaacgcgcccccaccagccgccacaaaaaaaaaacctaaggcggaggaaaatttgtggcggacttgatttattttcgtcgg

SEQ ID NO: 54983 - DNA, 926 bp, Zea mays
  misc_feature: Ceres CLONE 1484218
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (9)..(9): n is a, c, t, g, unknown, or other
  misc_feature (14)..(14): n is a, c, t, g, unknown, or other
  misc_feature (15)..(15): n is a, c, t, g, unknown, or other
  misc_feature (29)..(29): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
nnnnttttnttttnntttttgaaagtatntttttnnnnnaannnnnnccaaactggagctccaccgcggtggcggccgctctagaactagtggatcccccgggctgcaggaattcgtctcacccctagaaaaactagcctctatctcattccactccgacattcacgtgcagctgtcgggagcaggcaatggcgccggatctaagcgaactcgccgccgccgctccagcccgtggcgcctacctcgccggcgtcggtgtcacggtcctcctcgctgcctccttccccccagtagccgagtcgccctgccggcgaaataacccattggtgagagacactagccaaatgcccccaagcagctaaggggattgaaagggttggcccattataacaagactcgggagcgacaaccctctttggttttaaaggggcggggaagggggcggctctaaccaaaaaccgtcccagggtcaagaggaggcccgatccccacccgcccttccgggggagaaagaaggttccccccgccccattcatggggtaaggcggccccccccctcagggggagacccagggggccgccgttggtagccccgagggggccccgctacactgacaaccgccccccccctcggagaaaaaaccacgcctatcctaccttcttctccccgctcccccctccacccctcccccgccctcgctcaaacaattcataggccacccctactctaaatgttttagcgcgtttcctcaatgattatgccgaacccacccccccccccccaccacacttttccaccccagttgagcattggacaggaccaaacacaataccgtattggggggcggcgaaaggcggcgtcctctccagcctaaacaaccccaaaatgtcttaaccactcccaccccgcgcatctctcccacccc

SEQ ID NO: 54984 - DNA, 937 bp, Zea mays
  misc_feature: Ceres CLONE 1484220
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (846)..(846): n is a, c, t, g, unknown, or other
  misc_feature (937)..(937): n is a, c, t, g, unknown, or other
nnnnnnnnnnnnnnnnnggggggcaccttccactcccgtttttgttnnnccaaactggaactccccgcggtggcggccgctctagaactagtgtatcccccgggctgcaggaattcgtctcacccctagaaaaactacgcacccactgaatcccgttcatcaagttgaggacctccttcgaatgcgacggttcatgcgaccgacggcatacatggtggtggacggtggccctgcgacctcggtgttgggagaggccctcacgtccttccatgtgaaagatcctccgaggcttgatatacgcttgcgaaacctgtgagctttgctgtttatcacaagattcgtcctagctggtgtatccgagccagcctcccctccgggcgcggaaagatctccccctaagaagcgttaaaagtttttactttcttaatgtgccttgaactggaaaagggtgaacctacgttgaaaccttaacttgggggaaaaaaaagaggttaccgattttgccctgttggacccgcgggcaggatgcccggcgcgagaagaaaggactgcgggaaattctgtggaatacagactacttctcctctgtccagtgtcccattttctcgcgtgccgcgggtgggcttcagaagggggtgcgcaaacactcacgtggtgtgggttgaatcatccttgttagtggtgggtttaccgtgcatatccattcctctaacacccttgccacgtgggtgatatttttaaaaagaaacacgcgcgggggcgccgagaagacagcgagaggccaaatggtaagcaaagcggtcccaatcccataaaaagaaaataatattaatcgcactaagcctntttatttactacatggaacctgagatccttctctctccccaccacagatgtgttggcgtgtgtctctgtcatgttgtgtctctcgacatan

SEQ ID NO: 54985 - DNA, 701 bp, Zea mays
  misc_feature: Ceres CLONE 1484224
  misc_feature: Encodes the peptide sequence at SEQ ID NO. 54986
  misc_feature (701)..(701): n is a, c, t, g, unknown, or other
ctaagctggagctccccgcggtggcggccgctctagactagtggatcccccgggctgcaggaattcgtctcacccctagttattgttcgctcccctacacgccgcgtgcgcgcgccgtgctctctctcgctcgtggggacagctgcgcgaccgccgccgccctacgccaggcgcccaggtcttcgccagtaccttcgccggcgacgaactagcacccacaggaaaatggcaagcagagcaggtggcgacggcaaggaagccataaacgagcaggtaatcgccaacacctacgccaacatgcgcaccgaaatgaaccagctctacacgaagatcacggagctggagatggaggtcagcgagcactcccttgtgatgggcgcgatcgagccgctggacccctcgaggcgatgctacaggatgaccggcggcgtcctggtggagaggaccatcagggaggtcatgcctgccgtgaagcgcaacaaggagggcctggaagaggtgattgctcgcatgcacgaggcgctggagaggaagaagaaggagataaccgagtttgagctcaagtacaagatcaagatccggaaggctgatagcgacgctgaagataaaggcggcaaaaagggaggcactgcgcaaggagtccttggtgggcctgcccgaccagtatctaaagtgattagagagacctgcgtgctacaagn

SEQ ID NO: 54986 - protein, 158 aa, Zea mays
  misc_feature: Ceres CLONE 1484224
  misc_feature (16)..(121): Pfam Name: Prefoldin_2 Pfam Description: Prefoldin subunit
MASRAGGDGKEAINEQVIANTYANMRTEMNQLYTKITELEMEVSEHSLVMGAIEPLDPSRRCYRMTGGVLVERTIREVMPAVKRNKEGLEEVIARMHEALERKKKEITEFELKYKIKIRKADSDAEDKGGKKGGTAQGVLGGPARPVSKVIRETCVLQ

SEQ ID NO: 54987 - DNA, 676 bp, Zea mays
  misc_feature: Ceres CLONE 1484225
  misc_feature: Encodes the peptide sequence at SEQ ID NO. 54988
ggatcccccgggctgcaggaattcgtctcacccctagaaaaactccaaaccctagcccagagcagccgcatcgaactctacctgcctttctctcgtccctggcggcggcggcaggatggcggcttctactgcgaggacggtgaaggatgtgaacccccacgagtttgtcaaggcctactccgcccatctcaaacgctccggcaagatggagcttcctgagtgggttgacattgtgaagactgcgaggttcaaggagctccctccttatgaccctgactggtactacatcagggctgcatctgtagcaaggaagatctacttgagacaaggcattggtgttggtggcttccagaagatttatggtggccgccagaggaatggctcacgcccacctcacttctgcaagagcagtggtgccattttcacgcaacatcctccaacagcttgcaggagatgggcatcattgatgtctatcccaatggtggacggctcatcacctcccagggaaggcgtgatctggaccaggctgcttgaaaggtttgctggttgaagcttgaccaatctcctatttggttttctataatgtcttgtttaatttgtgaaatggccacccttttttttgccctttggaataaggattttttgtgttaagaaaaactcaaggcattccttgcta

SEQ ID NO: 54988 - protein, 144 aa, Zea mays
  misc_feature: Ceres CLONE 1484225
  misc_feature (7)..(143): Pfam Name: Ribosomal_S19e Pfam Description: Ribosomal protein S19e
MAASTARTVKDVNPHEFVKAYSAHLKRSGKMELPEWVDIVKTARFKELPPYDPDWYYIRAASVARKIYLRQGIGVGGFQKIYGGRQRNGSRPPHFCKSSGAIFTQHPPTACRRWASLMSIPMVDGSSPPREGVIWTRLLERFAG

SEQ ID NO: 54989 - DNA, 930 bp, Zea mays
  misc_feature: Ceres CLONE 1484227
  misc_feature: Encodes the peptide sequence at SEQ ID NO. 54990
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (34)..(34): n is a, c, t, g, unknown, or other
  misc_feature (48)..(48): n is a, c, t, g, unknown, or other
nccccnnnnnggggccgccgttggcctgcccccncccggagaagaatnccaaacttgtactccaccgcggtggcggccgctctagaactagtggatcccccgggctgcaggaattcgtctcacccctagaaaaaaatccagccgtttcccctttccccagagattcgcatattctcgcgatgggagcggaggaagcagagggtactcccccgccgctgcccgccaccggcgagaccgcaaccacggcaagggcgcagccaatatctgcagcacaattcctctcctggaagcagcccacgcaggcatgccagaggtacgccgtaagggaaagcttgaagcagctcagaagcgagctgaatgatatcagcttcggggagcggggcaatagaaacgtgcccccaagctgtttcccaaccagaagcccctgggggggtcgaaccaacacccattttactagaaaaggggggccgggctcacgggttacccgcccttttagtggccaggcttccccccgggggggttttgtcgttgttgagcgccggcggaagttcacccccttgtccccaaaacattgggggaacatttggtttgaccaccggcggtggaacaagaaaaaaacccccccccggccgtagaggcccacttttgaggcggtggattttcacatattacctatttggggcgcgcatggtctgtgggaccgagtagccccctgtctggcaaccctccgcggggcggccccacccggtgttttgcaaagaaccgtttgttatcctccagaaatatgggtgggtagagggggggactggaagggagggagcaccacaccccggacgccgcaaggagggggaagtggagggacaagaagggggcgatgtgagtgtatactaaaatagttagcggtggggggttgccacgcccacgcggttg

SEQ ID NO: 54990 - protein, 151 aa, Zea mays
  misc_feature: Ceres CLONE 1484227
MGAEEAEGTPPPLPATGETATTARAQPISAAQFLSWKQPTQACQRYAVRESLKQLRSELNDISFGERGNRNVPPSCFPTRSPWGGRTNTHFTRKGGPGSRVTRPFSGQASPRGGFVVVERRRKFTPLSPKHWGNIWFDHRRWNKKKTPPRP

SEQ ID NO: 54991 - DNA, 703 bp, Zea mays
  misc_feature: Ceres CLONE 1484232
  misc_feature: Encodes the peptide sequence at SEQ ID NO. 54992
atagctggagctccccgcggtggcggccgctctagactagtggatcccccgggctgcaggaattcgtctcacccctagaaaactcaccctcactctccctgctgcaacccaaccaaacccgcacgacacgacaccaagtcgaggagctcgagggcaccaatcatggccggcgtgaactccagcgtcgtcgggctcaagcccgccgcggcagtgccgcaggccgccgccgcctcatcgccggcgaagcgggtgcagctggccgcgcccgagggccgccgcgccgctctgctcggcctggcggccgtcttcgccgtcacggccaccaccgggtcggccaaggccacgatcttcgatgagtacctcgagaagagcaaggccaacaaggagctgaacgacaagaagaggctggccaccagtggcgccaactttgcgcgcgcctacaccgtggagttcggcagctgccatttcccctacaacttcactgggtgccaggaccctcgccaagcagaagaaagtccccttcatcagcgacgacctctagattgagtgcgagggaaaagaaaagttcaagtgccgctcccactttttctggaatgggtgaagcatctagcaaccccgtctgatgggaaatgaaggaaatcttcccctgtcttgtcacccctagatatgtccaaactgcagggaaattaaatcttcctgtgta

SEQ ID NO: 54992 - protein, 127 aa, Zea mays
  misc_feature: Ceres CLONE 1484232
  misc_feature (8)..(124): Pfam Name: PsaN Pfam Description: Photosystem I reaction centre subunit N (PSAN or PSI-N)
MAGVNSSVVGLKPAAAVPQAAAASSPAKRVQLAAPEGRRAALLGLAAVFAVTATTGSAKATIFDEYLEKSKANKELNDKKRLATSGANFARAYTVEFGSCHFPYNFTGCQDPRQAEESPLHQRRPLD

SEQ ID NO: 54993 - DNA, 717 bp, Zea mays
  misc_feature: Ceres CLONE 1484234
  misc_feature: Encodes the peptide sequence at SEQ ID NO. 54994
  misc_feature (717)..(717): n is a, c, t, g, unknown, or other
atgctggagctccccgcggtggcggccgctctagaactagtggatcccccgggctgcaggaattcgtctcacccctagaaaaaaccgacggcatttgcatctgagttcctgattgttgtattccagtttcttctgtgagttttgtgggatcgcgaggaagaactacaaggatgtcgtgctgcggaggcaactgcgggtgcggcgccggctgcaagtgcggcagcggctgcggagggtgcaagatgtacccggacatggctgagcaggtgaccaccactacccagactctcatcatgggtgttgcaccgtccaagggcgggttccaggcggccgccggagctgataacggcgggtgcaagtgcggcgccaactgcacctgcgacccctgcgcctgcaagtgagaccacggcgatgacgctgcaaggcgtcatgggatcggaaggactcttttatcttaagctctagtataatattctagcagcgtcgtttgtgttctgttcgagtcagtcagacagtcagccgcgtggcatgggccatggcataacttgccatgcctcgctctatttgctccatcgcctttttcttagggtgggacggatggggggacgaattattgtaccgagatggtggcgccctgtcgggacaagtcctgcccccgacctcctgggaactctctaactaaaagtcaaacggggttgggtttgttggcccgggggn

SEQ ID NO: 54994 - protein, 76 aa, Zea mays
  misc_feature: Ceres CLONE 1484234
  misc_feature (1)..(75): Pfam Name: Metallothio_2 Pfam Description: Metallothionein
MSCCGGNCGCGAGCKCGSGCGGCKMYPDMAEQVTTTTQTLIMGVAPSKGGFQAAAGADNGGCKCGANCTCDPCACK

SEQ ID NO: 54995 - DNA, 868 bp, Zea mays
  misc_feature: Ceres CLONE 1484235
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
nnnnnnnnnnnnnnnggggccgccctatannnnngggggannnnnnaaaactggactccccgcggtggcggccgctctagaactagtggatcccccgggctgcaggaattcgtctcacccctagaaaaactaaaccctacccgactccgccgccgcccgccgctccgcctcagcgcatagcccgccgcgacctcatcgatcaccttcaactttcaatcatgggggacgtccatgtccaaccggaggttgccgccggagctcccaagaagaggacgtcccgcaagcacagctaccgcgggctccgacccccacgccctctgtcggcccgtcctcgggccacccccgccgatctcttccccgcgccgccgcagggacacggtccctgacggggcccccaaatggaacccccggggcgattttttttttccccccccccggggggggggggggggggcctccctccctttttcccccccgcccccgcccccagcggggcgtgcgttagcccctctcttctgcttctcggagtggcgtcctccctttctcccgcccgcgttaccacccccgcgggcccggggggccccccgccggttggcccacttccttgttggcgggtcaccccgggaggcgcacgtctggtggcctaacgacacccaccgacgccccgccccgcacgtttcttacttcctctgttcccatttccccagcaccgttgctatgccgcagatactcctcgcgcgggtctgcgctcggacgtcctgtgggttacgccgctccgcccctcgtcgctcgcctgcgtagtccgctctgcccctggcgccatgcgcgggcgccccagcgcccgtcgccgggtgtcgtcccgcctgtt

SEQ ID NO: 54996 - DNA, 688 bp, Zea mays
  misc_feature: Ceres CLONE 1484238
  misc_feature: Encodes the peptide sequence at SEQ ID NO. 54997
  misc_feature (383)..(383): n is a, c, t, g, unknown, or other
  misc_feature (385)..(385): n is a, c, t, g, unknown, or other
  misc_feature (386)..(386): n is a, c, t, g, unknown, or other
  misc_feature (393)..(393): n is a, c, t, g, unknown, or other
  misc_feature (394)..(394): n is a, c, t, g, unknown, or other
ggcggccgctctagaactagtggatcccccgggctgcaggaattcgtctcacccctagaaaaaaacttcgagacttcctccattcgcggtttgcctctctgcctccctccctcagatcctccctaagattgccatggcggaccagctcaccgacgaccagatcgccgagttcaaggaagcattcagcctcttcgacaaggacggcgacggctgcatcaccaccaaggaacttggaactgtgatgcgctcgttggggcagaaccctactgaggctgagcttcaggacatgatcaacgaggttgatgctgatggcaatggaaccatcgacttccctgagtttctcattttgatcccccccaagatgagggacggggagtcctaanannacctcanngaggcctttccccgtgttcgacaaaggacaaaaccgcttcatctctgctgctgaacttccacctgtcatgacccaacctaggtgagaaactgaccgaccaggagggggattaaatgatcccgtgaagcccacttgaacggtgatgccccaatcaactcacaggagttctggaagctgatgatggtcaacggaaaataatttccctgttctgaacctaatcccccccttgacggcaccagcgggcgccaggggcgggaaatcgactccgttttggtcccgcctcttccttccccg

SEQ ID NO: 54997 - protein, 82 aa, Zea mays
  misc_feature: Ceres CLONE 1484238
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
MADQLTDDQIAEFKEAFSLFDKDGDGCITTKELGTVMRSLGQNPTEAELQDMINEVDADGNGTIDFPEFLILIPPKMRDGES

SEQ ID NO: 54998 - DNA, 944 bp, Zea mays
  misc_feature: Ceres CLONE 1484240
  misc_feature: Encodes the peptide sequence at SEQ ID NO. 54999
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (28)..(28): n is a, c, t, g, unknown, or other
  misc_feature (33)..(33): n is a, c, t, g, unknown, or other
  misc_feature (45)..(45): n is a, c, t, g, unknown, or other
  misc_feature (642)..(642): n is a, c, t, g, unknown, or other
tttttttttnnnnnnttnnntttctttntgttntggggggggcanttttgcaaagctggactccccgcggtggcggccgctctagactagtggatcccccgggctgcaggaattcgtctcacccctagaaaaaaacgctctccgccgccacttctcctccggcatcgacgaggcgaagccccagcgcccgagtccctctccctgctcccacgacccatggcggcggatatggcgtacgcgccgccgatgaaggcgggcaaggccgggttcgaggctggcatgatggatccgcagcacaggatccgcatcacgctctcctccaagagcgtcaagaacctcgagaaaagtctgcggggatccggggaaagggccgccaggggtaaggagctcaagggtcaagggcccccgtgggggattgcctaccaggggggcctcccactcccccccccggggaagtccccccctgggggaagaaaaggaacccaacccccccggggaaatccctttttgaaataatggaggggtttcccacaaagaggggggggaacccgaacctcccgcccagagcacccaccctaaaacttttgtttataaagcgaaagattctccctcttccctctccactcctttttgaaacccagngtgtgtccccaaacggttcttcagcggtgccctcaattccactcggcaacccccctctaaataaagttgaaaaaccccttcttataactttctacaaaaagggcttttttctattgagcacaagcgatatttcttctccactttctccctcgggggggaaacctccgggggtcacaccccggagaaagcccacagtctttgtttatgacgaacaggtagtataaaagtgtcttacgccggagggttgccggcattaggaagtaaatcccctctttataaaaacacttcccgcccgtggggcg

SEQ ID NO: 54999 - protein, 99 aa, Zea mays
  misc_feature: Ceres CLONE 1484240
MAADMAYAPPMKAGKAGFEAGMMDPQHRIRITLSSKSVKNLEKSLRGSGERAARGKELKGQGPPWGIAYQGGLPLPPPGKSPPGGRKGTQPPRGNPFLK

SEQ ID NO: 55000 - DNA, 711 bp, Zea mays
  misc_feature: Ceres CLONE 1484242
  misc_feature: Encodes the peptide sequence at SEQ ID NO. 55001
  misc_feature (566)..(566): n is a, c, t, g, unknown, or other
atagctggagctccccgcggtggcggccgctctagaactagtggatcccccgggctgcaggaattcgtctcacccctagaaaagtcgcccccctatcccgcgtccgggcttacccgatggcacggctgcactggcttgaggctgtcctgccgctggggatcatcggcggcatgctctgcatcatgggcaacgcccagtatttcatccacaaggccgcgcacggcaggccgaagcacatcgggaacgatatgtgggacgtcgccatggagcgccgcgacaagaagctcgtggaacaatcctccggcaactagggtattgatcaacctcaaacttttctggatgttgacgaacctcgttcaaaagcacagaagtactgctcttttgtttcctgtacaattggaaccaagacttgtttgtttcgctttgaaatatcaacagttcggagaataatctgtatctgacatctgtttaattgaacaaagccaaatactttgtcaattgtgtatgcacaattatttccgccaccggggcagatccatgaacaccgaaaaaaacacgtttcgcgnaggatatagcacaatcaaaaccaatatgcaaccccgaattactataatcttcaaaaatcttaattgtaaatcagcgaatataaataaaaaaagcgggaccccccaaggtcccccaatcccccctaaagggagtcgatatttcccc

SEQ ID NO: 55001 - protein, 64 aa, Zea mays
  misc_feature: Ceres CLONE 1484242
MARLHWLEAVLPLGIIGGMLCIMGNAQYFIHKAAHGRPKHIGNDMWDVAMERRDKKLVEQSSGN

SEQ ID NO: 55002 - DNA, 757 bp, Zea mays
  misc_feature: Ceres CLONE 1484243
  misc_feature: Encodes the peptide sequence at SEQ ID NO. 55003
atagctggagctccccgcggtggcggccgctctagaactagtggatcccccgggctgcaggaattcgtctcacccctagaaaaaaattcactccttacttcttctcctgcatcatgatcatcatcaggttctccgttccactccatggccttccctgctgagcccctactcgccgctctactcatggtcaccgccacacggctgtgggactacgtcttcgtgcgcctcgtatggaaacagaaccccatcaccaacgggttcatacagcaaggaatccatggaccctcctacatgttcttcaagggctgcaacgagcagatcaggaacatgaaggagaagaccgacggtctcatgctggacgtcggcaaccacaagtacgtcacgcagatctcgccgcactacctcctatggagggctcagtacagttatctcgaccatgaaaacgatgtaagtcctagtcccgacatgacttttcatggaaagactttaattaaaaaactccctgcgtagtacgaccccccctatccttgtcacgggaaaagaactaccaaaaattaagtccctttggccttaaaccagtcccattttaaatgggaatttggaaattaaattggaaaaaaaaattaaaaattcccatttcttttaaaaagaaaggtttgtttccccaaaaacaccctttatggttaaagaggattaaaattatatcccgaaacaaaggctcccggggttaaaacaccgggggccctttaaaaaaaaa

SEQ ID NO: 55003 - protein, 121 aa, Zea mays
  misc_feature: Ceres CLONE 1484243
MAFPAEPLLAALLMVTATRLWDYVFVRLVWKQNPITNGFIQQGIHGPSYMFFKGCNEQIRNMKEKTDGLMLDVGNHKYVTQISPHYLLWRAQYSYLDHENDVSPSPDMTFHGKTLIKKLPA

SEQ ID NO: 55004 - DNA, 683 bp, Zea mays
  misc_feature: Ceres CLONE 1484244
  misc_feature: Encodes the peptide sequence at SEQ ID NO. 55005
gcggtggcggccgctctagaactagtggatcccccgggctgcaggaattcgtctcacccctagaaaaactcccggctcagacttctgctgcagcgcctccgccgccgccgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgctctttccgcaggaagggagactagagcggatgtggtcttcaagttttgctctatgccagatactagcgtcatgaactgcctttagctaagattttccataagttgttctcgagcagctatgtgttgcatgttggctacttccaaacttatatctggtttggtttggattgtgatgaactaatggctctttgaatttatattatgatgttgacgatatttggtgacatctggtttcctgtagtcattgtcctttatcctttggattgagggttaatccagagagcacttcataaaa

SEQ ID NO: 55005 - protein, 86 aa, Zea mays; identical to SEQ ID NO: 44315
  misc_feature: Ceres CLONE 1484244
  misc_feature (30)..(84): Pfam Name: Ribosomal_S27e Pfam Description: Ribosomal protein S27

SEQ ID NO: 55006 - DNA, 713 bp, Zea mays
  misc_feature: Ceres CLONE 1484246
  misc_feature: Encodes the peptide sequence at SEQ ID NO. 55007
  misc_feature (713)..(713): n is a, c, t, g, unknown, or other
ccccgcggtggcggccgctctagaactagtggatcccccgggctgcaggaattcgtctcacccctagaaaaagtcagagtcctcgcaccgcacgcgacaagtacgcaggcagcgcagcctcgagccggctccatggagagcaagacacctcgtcctcgcgggatgcctcctcctcctgcccaccgcctcggtcgccaccgacgtcgactactgcagttaagaaggactacccggtgaaggtgagcggggtgcagatcttgcccgatccggtcgaacccgggaagcccgccactttcaagatctccgcttctactgataaaaccatcgagaaggggaagctggttatcgacgtcaagtatttcttcttctacgtgcactcggagacccgcgacatctgcggatagacttcctgcccaacgaccggcgacttcatgctgtcccaccaccagacgctgccaggcttcactccgccgggctcctacacgatctacttgaagattgtcggggacgacaacgaggagctgagctgcatctcgttcggtttcagcatacggcttcctcgcgtccaactgaacgcctcccgagcctaggcacaaaaaggcagccagccccatggaagtaaattacgggcagcacactacttgtccctatgacttttacaatatctcagccccatctaaagcttttttgtagaatgttctggagttcaactn

SEQ ID NO: 55007 - protein, 52 aa, Zea mays
  misc_feature: Ceres CLONE 1484246
MLSHHQTLPGFTPPGSYTIYLKIVGDDNEELSCISFGFSIRLPRVQLNASRA

SEQ ID NO: 55008 - DNA, 870 bp, Zea mays
  misc_feature: Ceres CLONE 1484248
  misc_feature: Encodes the peptide sequence at SEQ ID NO. 55009
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (41)..(41): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
nnnnnnnnnnnnnnnnnnnnnnnnnnnnnggaggagagggnttcttttggnnnnncccaaactggtgctccccgcggtggcggccgctctagaactagtggatcccccgggctgcaggaattcgtctcacccctagaaaaagttcccttcgttgcgtcttgaaaggggagagagagagagagaagagagagagaagagagagagagagagaggagtgggagacccgcgagaggctgccgtgtagggaccgtagactcagcgactgcgaaggagggataaggggatggccgggatcggaccgatcaggctggactgggagccggtcgttgtgcggaagaaggcacccacggcggccgccaagaaggaggagaagggccgtcaacgccgcgcgccgcgccagaggcagagattaaaggggaggaagaattacagcggctggtcaccaacaagggggggcattccagcggttacttccccagagcagggaagcgacctcgggggacgggcgcccgaggaaactcaagcctatagagttgagatcctaggtgtatacatggggaaggatacgacatagctgggccaagagccttgttggaaaaaagatcgaaatagggggcgccgaatttggcgcagggaagaagagaagggaagaaagaccaacggggggaaataaacgccatgcctggactgtagggggcagagaaggcgcgtctggtcgctggtccaacccccttgcccctcgcgtggggtcgggcagtcaggtgggttaaatggaagctggggagagggaataaaataggggaggtgcagcaggcaaagaagtgggggggacgcggtcggctgctggtgatgggagcggggaggagagtg

SEQ ID NO: 55009 - protein, 96 aa, Zea mays
  misc_feature: Ceres CLONE 1484248
MAGIGPIRLDWEPVVVRKKAPTAAAKKEEKGRQRRAPRQRQRLKGRKNYSGWSPTRGGIPAVTSPEQGSDLGGRAPEETQAYRVEILGVYMGKDTT

SEQ ID NO: 55010 - DNA, 716 bp, Zea mays
  misc_feature: Ceres CLONE 1484249
  misc_feature: Translation starting site: 180
atagctggagctccccgcggtggcggccgctctagaactagtggatcccccgggctgcaggaattcgtctcacccctagaaaaaataggccgccatattcgaaagccaccggaaccgacgcgggccttcggagccgccccagaccccgtcgcgtttgagatcccgggaaggttcctaacatgtctaccgtgctccagcacccgaccccagacacggtccattgttctcatccgacaagaagacagctgtggacgacgcctacacgcaaccggggcgcgcgcatgatcaacgtcaacggcgtcccgattgagatcatcaagaccgacatgctccgcctcagggccttcgagaccatcctgctggcggactgctccatgttcaacgacatcgtacatgacgatcctcgccccagacgccaggaagacctcggacatatactccatccgccagagcatcatctaggggctcgtctcctactaactgaagtacgtctacgagtccgcctgcaaagatgtcaatgacatcttcaccatgtactaccgcgcccatctagactgctactccagggaatctgagcaaattaatccagatgtcttggcgaccgcgccaggatccagaatactaccggctgtaaactcgacttcctgctctgccggaccagttgcctgtgattgcccaacttgtcccatcgacgactgttaccgcgtcttattttc

SEQ ID NO: 55011 - DNA, 965 bp, Zea mays
  misc_feature: Ceres CLONE 1484249-R
ctcgtttttttttttttttttcttttttcttttttttttttttttttttttttttttttttttttttttttttttttttttttttttttttttttttttttttttttcgtttcaaccccccaacttgtcaggcccaaggtgcccgacactggctttcatatttcccattttaagggacccccacccaagtttaggggcaaaccctcttcctttttttgacccccttagtagcccccaagataaaaaattttcccccgggttctgggcttcaatttggccaatttggaaaacaccgggaacttttccggcaaaagggggggcctagccccccaccggttggatttctgaaacttggtcgggggccccgaccaccaaaattttttgggttccaacacctggggttcgccaaaaaaaaggtgccgtccttcccggggaaaatttcctttaacccctttttgggggccccctccaaatacttttggtttgaggggaaaaacccctttgcaaaagcccggcggatagcgttaatttgggaactcttcccccccccccggaaacggatccccatgttgatttccctgaacccggaacgccccccccacaggattggccccaaagcctttaagcggagcatctccgggcttgttagccccatttggaagccctttaccttgtttcgccccccccccggctttggttttgggggaaaggcaaaaggctgctttatttgggcgcaaatacttggaacctgtccggggggtcgggccccttgataaccgggaataaattttttcccaccttttgcgggatttcaaaattggggagggggggagaggctggtcggcccaaaggcgccttctttttgctgggactttccccaactggcgcggggttttttttctttggtgttgacacaaatttccggggagccggtggggatcccctattttcttaatacggcgccc

SEQ ID NO: 55012 - DNA, 854 bp, Zea mays
  misc_feature: Ceres CLONE 1484250
  misc_feature: Encodes the peptide sequence at SEQ ID NO. 55013
  misc_feature (30)..(30): n is a, c, t, g, unknown, or other
  misc_feature (51)..(51): n is a, c, t, g, unknown, or other
  misc_feature (52)..(52): n is a, c, t, g, unknown, or other
gggtgggggtgtgggtgtgggggtgtgaanagttttaatggggtggagganngggcaaactgggactccccgcggtggcggccgctctagaactagtggatcccccgggctgcaggaattcgtctcacccctagaaaaaagccccactctctccatctagagctccctaactgcaccggccgccacaccaccgtaccccgacccctcgacaacaatggccaccgtcctaggcagcccccgcgcgccggccttcttcttctcgccgtcctccctccgtgccgcgccggcgcccaccgccgtggcgctgcctgctgccaatgtgggcatcatgggccgtagcgccggcagtaggggcaggctgcgtgcgcaggccacctcctacttgtagctgatcacaccggagggggaagtgtagctgcaggtggtccccggactacgtggttacattcttgggtaccagggcgaggaggacggtttcgagcctgccctaacttctgcccgaacgggggtcccgggctcctccgggcggctgggtagggtcgtcaccaggctcccgtgatacctcttccgacgcaaaagcatgccgatcgagggaagggaaaaggaggcgcccacacgagctgggggggattaaaccgtggcaaagtgcgcgaccgccagctttctgaacggtcggtcgcttcgaaaaacggcaccaaaggaagaaaaagaagcctacaccacgggtgccatatagtcctttccttgacgcggatatagtgatgtaatattatacgccaagtacacattaacaattgtgctgggtttagttttcgtagtatcagcggtgggttaataaagtaactacgaggccg

SEQ ID NO: 55013 - protein, 57 aa, Zea mays
  misc_feature: Ceres CLONE 1484250
MATVLGSPRAPAFFFSPSSLRAAPAPTAVALPAANVGIMGRSAGSRGRLRAQATSYL

SEQ ID NO: 55014 - DNA, 754 bp, Zea mays
  misc_feature: Ceres CLONE 1484251
  misc_feature: Encodes the peptide sequence at SEQ ID NO. 55015
atagctggagctccccgcggtggcggccgctctagaactagtggatcccccgggctgcaggaattcgtctcacccctagaaaaaagttcctctcatggaggcgtccttgctcgtggctcccaagccttccatgcccaggaccatcttctccgccaggcgagccggtcggagttggaggtgcctcatcgtcactaccaccatcaagcaacaactcggcacacggtcagaaagtgtggacgtcgatgcgccggtcgagcacctaacgccgccttcgaaggagacgaccggagctcgcggcggcctgctcgcctccttggcgaccaccacgaccactgcacggcattgttcccgtgccacgccttatcaggcccccgacgggtggaaaccacaccggggggtggaacccccccctggaacccccaaacccccggggcgccggttttgggcaaccttgacccggaaaactcccccgggggtttgggggaaaccaaagcccggttctttttcgggataacggttcccctttttctcggaaaaatctttgtggtggtccccccagatcccccgggaaaaaaaccccccccctagtgggtgataccccccacaaaaccctccccccccccccccccccaggggccccccccccccctggggagagccaatatcccccccttttggttgtggccccccccaccctctccacgaaataatctccgtgcaaacaaaatgggtttttttttttctcaaaaaaaaa

SEQ ID NO: 55015 - protein, 139 aa, Zea mays
  misc_feature: Ceres CLONE 1484251
MEASLLVAPKPSMPRTIFSARRAGRSWRCLIVTTTIKQQLGTRSESVDVDAPVEHLTPPSKETTGARGGLLASLATTTTTARHCSRATPYQAPDGWKPHRGVEPPPGTPKPPGRRFWATLTRKTPPGVWGKPKPGSFSG

SEQ ID NO: 55016 - DNA, 668 bp, Zea mays
  misc_feature: Ceres CLONE 1484385
  misc_feature: Encodes the peptide sequence at SEQ ID NO. 55017
caaagctggagctccccgcggtggcggccgctctagaactagtggatcccccgggctgcaggaattcgtctcacccctagaaaaacccactcctgcagtccttctccacctagctcccccgcgccaagaacacgccagctagcaagcgcgctcgatcgaataccgttaccgtgtcgccatggccgccaccgcgtctctatcagccgtcggggcgccgctgtcggtgcccgggctcaggaagccgctcggcgtgtcgtcgctccggcccctgcagccgagggcggcgaggatgacgacgacggccgtgcgggcgtcggcgtcgccctcgtccacgtccatcaaggagaaggctgcggccgggctgaccgcggcggccctggcggccgcgctggtgctgccggacgtcgcggaggccgcgcagtccggcgggctcacgccgtcgctcaagaacttcctcctcagcatcgtgtccggtggggtcgtgctcgttggtattgtcggcgccgtcgtcgccgtctccaacttccaccccgtcaagagggcctgatcgggatccctcgtatcgatcgcctcgcctgtgtcctgtcctgtgcctgggctgcctgtatccactggtggggctatatcccccggggtgtaattgattttggaaaaaggtcaaacctata

SEQ ID NO: 55017 - protein, 122 aa, Zea mays
  misc_feature: Ceres CLONE 1484385
  misc_feature (85)..(122): Pfam Name: PsbX Pfam Description: Photosystem II reaction centre X protein (PsbX)
MAATASLSAVGAPLSVPGLRKPLGVSSLRPLQPRAARMTTTAVRASASPSSTSIKEKAAAGLTAAALAAALVLPDVAEAAQSGGLTPSLKNFLLSIVSGGVVLVGIVGAVVAVSNFHPVKRA

SEQ ID NO: 55018 - DNA, 671 bp, Zea mays
  misc_feature: Ceres CLONE 1484386
  misc_feature: Encodes the peptide sequence at SEQ ID NO. 55019
  misc_feature (407)..(407): n is a, c, t, g, unknown, or other
  misc_feature (493)..(493): n is a, c, t, g, unknown, or other
  misc_feature (645)..(645): n is a, c, t, g, unknown, or other
  misc_feature (671)..(671): n is a, c, t, g, unknown, or other
aaagctggagctccccgcggtggcggccgctctagaactagtggatcccccgggctgcaggaattcgtctcacccctagaaaaatcacaagcagcatccgcacactcccaattcccctcgagcgccgcagcgagcccaagaagccgaccgccgagccccctctccagtccagtccgcggtctcggtttcttgcttacccggcgcccaatcttcagggagctccttctcgtcgtctgtctccatggccgcctcgaccaagaccgtcgccgtcctcctcgccgcggtgctcctcgcgctggtcgcgtccgcggcagccagcaggaagctggaggaggaggacgcactcctgggaagcctggccccagcccccgcgccggccgttggcggttccgcggggctgcctggcngcaggccgggggcgtgggccgtcgccgccctggtctctctcgtcgccttcctcgtgaactgagggtgtgggcatcgtgctgcgcancgcgggagatgggagggacgaatcctgcgatctggatcgctgggagaggagagggggatatttatgttcgttctgtttgttctagggtgcctctcttttgccctgtatagagaggatcatgaattttttttataataataccgtttatttgncattctttttaaaaatatgtattccn

SEQ ID NO: 55019 - protein, 75 aa, Zea mays
  misc_feature: Ceres CLONE 1484386
  misc_feature (56)..(56): Xaa is any aa, unknown, or other
MAASTKTVAVLLAAVLLALVASAAASRKLEEEDALLGSLAPAPAPAVGGSAGLPGXRPGAWAVAALVSLVAFLVN

SEQ ID NO: 55020 - DNA, 636 bp, Zea mays
  misc_feature: Ceres CLONE 1484388
  misc_feature: Encodes the peptide sequence at SEQ ID NO. 55021
  misc_feature (282)..(282): n is a, c, t, g, unknown, or other
  misc_feature (284)..(284): n is a, c, t, g, unknown, or other
  misc_feature (287)..(287): n is a, c, t, g, unknown, or other
  misc_feature (296)..(296): n is a, c, t, g, unknown, or other
ggcggccgctctagaactagtggatcccccgggctgcaggaattcgtctcacccctagaaaaagtgctctctcagaggtgggctggcttctcctccccctcttaccaagtcctcctcgggttagggttccttagggttttgtggaggggcgatggcggcggctgatgtggagtaccgttgcttcgtcggcgggtcttgcctgggccaccagcaacgagtcgctggagaatgccttcgcctcctacggcgagatcctcgactccaaggtcatcaccgaccggngnagnaacgggggnagggtcctcgccggggctttccgggcttttccgtttacccctttcctcccctcccaaagaaatttccattgggttcgcaaagccctttttttggagaaaacctttatacacggcccaaagggaactctttctcacccggccccccttaaaaaaaaacccccccccctcttttataaaaaaaggggccccccaacttctccctccttttcgtttttgtgaaagcgccgagtcttttcccccctcctttgggttttgatataacacacgacggagctttagcttttccccgccccccctgcggggcggcgttgttttatttttttattattgttgtgggggg

SEQ ID NO: 55021 - protein, 116 aa, Zea mays
  misc_feature: Ceres CLONE 1484388
  misc_feature (40)..(40): Xaa is any aa, unknown, or other
  misc_feature (41)..(41): Xaa is any aa, unknown, or other
MWSTVASSAGLAWATSNESLENAFASYGEILDSKVITDRXXNGGRVLAGAFRAFPFTPFLPSQRNFHWVRKALFLEKTFIHGPKGTLSHPAPLKKKPPPLFYKKRGPPTSPSFSFL

SEQ ID NO: 55022 - DNA, 616 bp, Zea mays
  misc_feature: Ceres CLONE 1484392
  misc_feature: Encodes the peptide sequence at SEQ ID NO. 55023
  misc_feature (347)..(347): n is a, c, t, g, unknown, or other
  misc_feature (354)..(354): n is a, c, t, g, unknown, or other
  misc_feature (406)..(406): n is a, c, t, g, unknown, or other
  misc_feature (407)..(407): n is a, c, t, g, unknown, or other
caaagctggagctccccgcggtggcggccgctctagaactagtggatcccccgggctgcaggaattcgtctcacccctagaaaaaagcagtcagcagtgaccaactcgaagcttgcgttcttgtagtagaggtcggcagcaagcggtagagcgagaggtcgagaagatgaagagcagcactctgttggcgatcctagttctccaggcccttctggtctctacggccgtggccaaaggacctgcagggccgaagaagcagtgctggtgcggcgagtgcaccagctggtcgggcgtgtggacctgcgacgacctcctcaccaagtgcgccgccacctgcaagaactgcngtccccngtctcctcacggacaagggcgccacccaagttacaggatggccgcgaacttnncctcccccgaaaactggcgggctggcaaggatccccactaggacttcattcccacagccggcacagcccgatgggatccttcccatgctccctccgcccgtccgcctttgctacaagcaagcaggcaccaaataggctagctccttggtgttgtttttcccggtttgaattggggggccctttcccagcccagaagggaaaaaggccct

SEQ ID NO: 55023 - protein, 93 aa, Zea mays
  misc_feature: Ceres CLONE 1484392
  misc_feature (61)..(61): Xaa is any aa, unknown, or other
  misc_feature (63)..(63): Xaa is any aa, unknown, or other
  misc_feature (80)..(80): Xaa is any aa, unknown, or other
  misc_feature (81)..(81): Xaa is any aa, unknown, or other
MKSSTLLAILVLQALLVSTAVAKGPAGPKKQCWCGECTSWSGVWTCDDLLTKCAATCKNCXPXSPHGQGRHPSYRMAANXXSPENWRAGKDPH

SEQ ID NO: 55024 - DNA, 637 bp, Zea mays
  misc_feature: Ceres CLONE 1484393
  misc_feature: Encodes the peptide sequence at SEQ ID NO. 55025
caaagctggagctccccgcggtggcggccgctctagaactagtggatcccccgggctgcaggaattcgtctcacccctagaaaaactagaaaaaagcactctcctatatccgccgccatcgtctcgggctctcatctctaatcttcgggttcgcgtcgcagtgtcttccgcccgggctaccaccatgccgaagcagatccacgagatcaaggacttcctgctgactgcgcggcggaaggacgcacggtcggtgcggatcaagcgggccaaggacgccgtcaagttcaaggtgcgctgctccaggtacctctacaccctctgcgtccacgacgccgacaaggccaacaagctcaagcagtcgctcccgccaggtctgactgtccaggagatttaaggtatcaagccacaaactgtgctttttttgcggtgtcagggacgtttgctccagtgttactttagtttgtaggtgggctccattgctgtgtttgaatgaattatgaagtctgagtttgggatgcgaatgatgtgtcgaacctatgagcctgtgttgtaatggttaccccagaccgcaaaggatggcaatctatcataagttaaactgattttcgtgaagaaaaaaaaaaaaaaacgagacgcg

SEQ ID NO: 55025 - protein, 69 aa, Zea mays
  misc_feature: Ceres CLONE 1484393
  misc_feature (2)..(69): Pfam Name: Ribosomal_L38e Pfam Description: Ribosomal L38e protein family
MPKQIHEIKDFLLTARRKDARSVRIKRAKDAVKFKVRCSRYLYTLCVHDADKANKLKQSLPPGLTVQEI

SEQ ID NO: 55026 - DNA, 672 bp, Zea mays
  misc_feature: Ceres CLONE 1484398
  misc_feature: Encodes the peptide sequence at SEQ ID NO. 55027
aaagctggagctccccgcggtggcggccgctctagaactagtggatcccccgggctgcaggaattcgtctcacccctagaaaaaaagcaaggagcgctacatccaagccagcagtttccatttgcaatccgaccccatcttcatcccgttgtcgcagcagcagccagcagccatccaagcagcgatggacggcggcaagaagagccggaacccgcacaaggcctccgcggactaccgcagcgaccgcaagtcagcctccgggatgagcggcgaccccaagaagggcggacgcggcggcaagttcacctgggagggcgccgacgactacggctacggctacgccgacgaggacctcggcctcatctccaagaaaggcaacagcaacagcggacgcgctagccaggcccagggaggcggcgccgctaagaaggacgacgacgagtaggcctcgccgcctcggctcgcccgtccggtcccgtcgatcgccagcaagaaccaacaagcccttctggctgtttaattccagtctcagatcgattctcatgttgaataatcatgatcatgtgggtttaggtgtcgtgctcacgagtatgtagtgtagctcctgctagcacagatccactgggcgatcgacgggccgtgcatggcctgtagatatcatctcatatgttc

SEQ ID NO: 55027 - protein, 86 aa, Zea mays
  misc_feature: Ceres CLONE 1484398
MDGGKKSRNPHKASADYRSDRKSASGMSGDPKKGGRGGKFTWEGADDYGYGYADEDLGLISKKGNSNSGRASQAQGGGAAKKDDDE

SEQ ID NO: 55028 - DNA, 665 bp, Zea mays
  misc_feature: Ceres CLONE 1484403
  misc_feature: Encodes the peptide sequence at SEQ ID NO. 55029
  misc_feature (665)..(665): n is a, c, t, g, unknown, or other
caaaactggagctccccgcggtggcggccgctctagaactagtggatcccccgggctgcaggaattcgtctcacccctagaaaacatcagccactccgtgagaagttctagtcatcacacacaccaatggcgccctccgctccccggctggtcgccggagctctcgtgatcctggctgctgtagctctggcccgtccaaacgccgagcaacggagccccggtcgctacaatgtcgccgacgcgatcgcgatgggctcaggtcagcatcgtcatcatcaggggcggacaccaccatgccatgtgtcgcctccgcccgtgttgccgccgccgtgtcctggtcaccaagatcggcgtagagaagcactggtgccgcccgccattgttctcggtgtgcaaagaaccgcgccggctccgccctcggcgaagaacgcgcaggtggagcattatagggccctattccccccccctccagcttggtcattctaggcgagggctcctgttgtaccggaacctcctaaaccgtcaagaaaccccccaagtggtttggaagttattttacctcagccaagcaaacctaaaaagctttccaattttttttccattccccccccccattttccggttggcaccacaaaaaaatttggaaccactttttttttttaacn

SEQ ID NO: 55029 - protein, 119 aa, Zea mays
  misc_feature: Ceres CLONE 1484403
MAPSAPRLVAGALVILAAVALARPNAEQRSPGRYNVADAIAMGSGQHRHHQGRTPPCHVSPPPVLPPPCPGHQDRRREALVPPAIVLGVQRTAPAPPSAKNAQVEHYRALFPPPPAWSF

SEQ ID NO: 55030 - DNA, 547 bp, Zea mays
  misc_feature: Ceres CLONE 1484405
  misc_feature: Encodes the peptide sequence at SEQ ID NO. 55031
  misc_feature (254)..(254): n is a, c, t, g, unknown, or other
  misc_feature (255)..(255): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
aaagctggagctccccgcggtggcggccgctctagaactagtggatcccccgggctgcaggaattcgtctcacccctagaaaaaagacgcaccccttcctcgtttcgccgcctccgccgacaccgactgcctacctcagctgccgtcgccatgggcagaaggcctgctagatgctatcgccagatcaagaacaagccataccctaagtccaggtactggccgtggtgtccctggaaccccaagatcagggatcnntacgatgtcgggatgaaagaaggaaggggtggtgaatgaaagttccccctaactggtgggcacccttggtctccttgggaagaaaggaaaatggctcccaggggaggggcctctcgaaggcttccccccccaatttcccctcgggaaaaaaagggtcttattgtggccccaaaattttttttcaaaaaaaaaaaaaaccccccccccccccccccataannnnagggggggggggggggtcccccccttcttattgtcccccctaaaaaaaaaaaaaaattttttgtggggg

SEQ ID NO: 55031 - protein, 47 aa, Zea mays
  misc_feature: Ceres CLONE 1484405
  misc_feature (35)..(35): Xaa is any aa, unknown, or other
MGRRPARCYRQIKNKPYPKSRYWPWCPWNPKIRDXYDVGMKEGRGGE

SEQ ID NO: 55032 - DNA, 686 bp, Zea mays
  misc_feature: Ceres CLONE 1484407
  misc_feature: Encodes the peptide sequence at SEQ ID NO. 55033
ggctgcaggaattcgtctcacccctaggaaccccccactattcctttctgctgagctcaggaaatcccctctggtctccccgtcccccattccacccgccgccgccgacgcgccgcgcctgttcaagatgaatgtggccaacctcacgaagatggcgggtgctgtgccgcctggaggaaagggcagcatgcgcaggaaaaacacggccttccacaataccccaaccccccctttatccccctttgtcggaggcggtcgcccccactccctctgttttcctaccccctggtccccttgacggcgaccttttttttttttcccccccccccaggggggggggggggggtgtattcccccttttcttcctcccccccccccgtccccgtgacctccctccgattttttcctttgccccccctcgtccccgcctccttcccctccctcgccccctcgtacccccccccgctcccctacacacccaccaccctactccccccttttttttcccccttttccctttcgcccccttccccttccccgttttcccccatcttcatctcccccccccctccccccctcctctcggtacctgtgcacccttccttccccgctccttccccccccccaccccctacccgccccccctctctccctcacgcactgaccctctcctcttccctgtcccg

SEQ ID NO: 55033 - protein, 56 aa, Zea mays
  misc_feature: Ceres CLONE 1484407
MNVANLTKMAGAVPPGGKGSMRRKNTAFHNTPTPPLSPFVGGGRPHSLCFPTPWSP

SEQ ID NO: 55034 - DNA, 671 bp, Zea mays
  misc_feature: Ceres CLONE 1484411
  misc_feature: Translation starting site: 218
ccaagctggagctccccgcggtggcggccgctctagaactagtggatcccccgggctgcaggaattcgtctcacccctagaaaaaatcacagtacgcatcgcccgcactcactagtccattataatacacgaccctcggccctcgctcccacaacaagcatcaagccagccttctctctctgctccaaaggcgcgcttccagatcgcaaccgcggacatggtcatgcacttcaacgcggcggcgacaacagcagctgcatccgctccatctccttcatctacatcggagccgatggcaaaccgtacgaggaggggccatggggtttcggccatgcctggcacggagcacaagattgatctgtgcaggttcgacgagagcttgacggaaatctcccaaaccacgaccccagtctacaacccccacaaagtgggccagtctgttcaattcctcactaacaaacgcgcttacggaccgtacggcaggaacgaaggcaccccgttccgtggccagggggaagaacaaacggcaacaccattggcttcctttggcccgcttcgggaaattgccccggaacgcaatcggggctcttaccgtgaccccttacttaataaactgaaagcccaaggatccggaatccttctggattggtatgcctaatcccacaaacggc

SEQ ID NO: 55035 - DNA, 654 bp, Zea mays
  misc_feature: Ceres CLONE 1484414
  misc_feature: Encodes the peptide sequence at SEQ ID NO. 55036
tcagaactagtggatcccccgggctgcaggaattcgtctcacccctagaaaaaaacggggatgtaccagtattttgtaaaggttgttccaacaatctacacagatatcagggggcgcaagattcactcaaatcagttttctgtgacagagcacttcagagaggcaattggctatcctaggcctccacctggtgtatatttcttctacgaattttcaccaatcaaggttgattttactgaggaaaatacgtcgctccttcacttcctgacgaacatatgtgctattgttggagggtatccttcacggttgctggcatcatagattctttcgtgtaccatggtcaccgcgccatcaagaaaaaaaatggagctcggggaagcttgggtaacccgcagttttcggcatatagcagttaggacccataagcgaaacgagttgaaaccttgtggttgcactggccccccaaaagcgaagggattttgattcccctgtgatgcattctgtagtcattcagaattggctgcccagggcaaccttttgtgttattttttgcaaaaatattattgacatggggcaaattcacaccccccttgtttaaaattctacaacaagaaaaaaaaaaaaaaaaaaccggagacccctccgaggataccc

SEQ ID NO: 55036 - protein, 86 aa, Zea mays
  misc_feature: Ceres CLONE 1484414
  misc_feature (1)..(84): Pfam Name: DUF1692 Pfam Description: Protein of unknown function (DUF1692)
MYQYFVKVVPTIYTDIRGRKIHSNQFSVTEHFREAIGYPRPPPGVYFFYEFSPIKVDFTEENTSLLHFLTNICAIVGGYPSRLLAS

SEQ ID NO: 55037 - DNA, 706 bp, Zea mays
  misc_feature: Ceres CLONE 1484419
  misc_feature: Encodes the peptide sequence at SEQ ID NO. 55038
aaagctggagctccccgcggtggcggccgctctagaactagtggatcccccgggctgcaggaattcgtctcacccctagaaaaaacatgtgcatctcagcagcactagcagtgacaaactcgaagcttgccttctagcttgtttacaccccaaaactaaaactagagtcggcggcggcaacaagcggtacgtagaggatgaagagcaggagcagcaccctgttggtgatcctagttctccaggcccttctgctctctgcggctgtggccaaaggacctgcagggccgaagaagcagtgctggtgcggcgagtgcaccagctggtcgggcgtggtggacctgcgacgacctcctcaccaagtgcgccgccacctgcaagaactgcgtccccgtctccacggacaagggcgccaccaagtacagatgccgcgacttccctccccgaaaactgcggctgccagatccactagagactcatccaattcacccatgggccacagccgatgggacccttccttccataatgcatgcctctccttccgtccgtcccgccttagcttggctacaacccaggccctaaataagctaacaaagcttggttgttggtgaaaaaaaaaaaaaaaaataccaagaacccttcgaagggtaccccaattccccccctaaaggggggaggcctatttacgcccgcgctttcatctggggcc

SEQ ID NO: 55038 - protein, 39 aa, Zea mays
  misc_feature: Ceres CLONE 1484419
MGHSRWDPSFHNACLSFRPSRLSLATTQALNKLTKLGCW

SEQ ID NO: 55039 - DNA, 661 bp, Zea mays
  misc_feature: Ceres CLONE 1484420
  misc_feature: Encodes the peptide sequence at SEQ ID NO. 55040
aaagctggagctccccgcggtggcggccgctctagaactagtggatcccccgggctgcaggaattcgtctcacccctagaaaaattaagggacacgctgtaaaaatagatttacctgtaactgtaacgagtgtttgtaatgagtgtaaagaactgccacatgccatattttcaatgggtgagaagatatagaaatctaaaaaacactcaggctatcatatatgttgttgattcaagcgatacagataggcttgtaacagcaaaagaagaattccatgccatccttgaggaggatgaacttaaaggtgcagttgtccttgtgtatgcaaataagcaggatcttccaggtgcactcgatgatgctgccattacagagtcattagaactacacaaaattaagagccgccaatgggcgattttcaaaacatctgcaataaagggagaggggctcttcgaaggtttggactggctcagtaacacgctcaaatctggaagcagctaaggagcctccgcctcgtcatgaatcatttgctggaggctaaagaatagccgatgcttgcaagtcagcgcgcaaatcccatttctctttgttttaactccaagaagttctaccaccgccatcaaattatctggtaagtgcgtgttaaaattttttggatact

SEQ ID NO: 55040 - protein, 120 aa, Zea mays
  misc_feature: Ceres CLONE 1484420
  misc_feature (2)..(115): Pfam Name: Arf Pfam Description: ADP-ribosylation factor family
MSVKNCHMPYFQWVRRYRNLKNTQAIIYVVDSSDTDRLVTAKEEFHAILEEDELKGAVVLVYANKQDLPGALDDAAITESLELHKIKSRQWAIFKTSAIKGEGLFEGLDWLSNTLKSGSS

SEQ ID NO: 55041 - DNA, 716 bp, Zea mays
  misc_feature: Ceres CLONE 1484426
  misc_feature (716)..(716): n is a, c, t, g, unknown, or other
acagctggagctccccgcggtggcggccgctctagaactagtggatcccccgggctgcaggaattcgtctcacccctagaaaaaatgtgcatctcagcagcactagcagtgacaaactcgaagcttgccttctagcttgtttacaccccaaaactaaaactagagtcggcggcggcaacaagcggtacgtagaggatgaagagcaggagcagcactctgttggtgatcctagttctccaggcccttctgctctctgcggctgtggccaaaggacctgcagggccgaagaagcactgctggtgcggcgagtgcaccacctggtcgggcgtgtggacctgcgaagacctcctcaccaagtgcgccgcccacccgcaagaactgggggccccgtctccacggaacaaggcccccaacaaataaagaatgcccgcgaccttcctcccccaaaaactgccgcctgccaaaaatccccttgaagacctcttcccaatccccccatgggccaccgccccaagggacccctccttcccccctgcgatggcttccccccccgcccccgacccccctaaggtttggccaacaacacggcccccctataatccctcaccccccccgttgcccggttgcgtctgcgcccggtaccgcaagtggggcgggcccccccccccccctataacgatcggcccaagcggggcccccccaccccccgtagctcn

SEQ ID NO: 55042 - DNA, 651 bp, Zea mays
  misc_feature: Ceres CLONE 1484522
  misc_feature: Translation starting site: 211
  misc_feature: SWISSPROT Homolog: EC 3.6.3.14 H(+)-transporting two-sector ATPase
caattgggtccgggccccccctcgagccactgcagtggtaaaggagatcagaaccaaactcggctcgagagagatcgcatacgcctgcctgcccacccacctccccttttccttcctcttcgccccagcgacgcggccgcccggagaccgagcgaggcaggcaactaaccaccgagaggcagggacaggaacaggaagccggaggcgaagatgtcgtcggtgttcagcggcgatgagacggcccccttcttcggcttcctcggcgccgccgccgccctcgtcttctcatgcatgggcgccgcgtacgggaccgcgaagagcggcgtcggcgtggcgtcgatgggtgtgatgcggccggagctcgtcatgaagtccatcgtgcccgtggtcatggctggtgtgctcggtatctacgggctcatcatcgccgtcatcattagcacggggatcaacccccaggccaagccctactacctctttgatggctacgcccacctttcgtccgggcttgccctgtgtctccgctgggcttgcagctggcatgggcatcggccatgtcggtgatgctggaatcagggcaaatgcccaacagccaaaagctttccgccgggatgatcccccaccctcttttttgccgaagcccttggtccc

SEQ ID NO: 55043 - DNA, 697 bp, Zea mays
  misc_feature: Ceres CLONE 1484523
  misc_feature: Encodes the peptide sequence at SEQ ID NO. 55044
tcgagccctgcagtggtaaagggtctgcgtgcagcgtgctcgcgaggccctgcttcctgctgcgatggggggcgagacgcacctgagcgtgcaggagctggcggcgtcgctgggcgcgctaccgccggagttcgtgcggtctgagcaggaccagccgggcgcgaccacgtaccgcggggccgccgtgccggacgcgccggtgatcgacatatcggagcccgggttcggcgcgcgcatggccgcagccgccagggagtgggggctgttccaggtggtgaaccacggcgtgccctcagcggcggtggaggagctccagcgcgtcgggcgggccttcttcgcgcttcccacggaggagaaggagcgctaccccctggacccggcgtccggccagattgaggccctacggcacccagcttgcaaaggtaccttcaagggcaaaaaagacgtgggactgacttcttcttccccgtttttccccccccccgaaaaggtggaaccccgcccgttctgggcccccggatccccccccgtggaaccggggagggcccacgacgaagcccttgccccccccatgtaatcccccctggacccccttatgttgttttcaaccccttttctcacccggggttccgggggtccccctcgggggggtcctttttggtcgcaagcctcttttctgtccggaaaaacggccccc

SEQ ID NO: 55044 - protein, 170 aa, Zea mays
  misc_feature: Ceres CLONE 1484523
  misc_feature: SWISSPROT Homolog: EC 1.14.11.19 Leucocyanidin oxygenase
MGGETHLSVQELAASLGALPPEFVRSEQDQPGATTYRGAAVPDAPVIDISEPGFGARMAAAAREWGLFQVVNHGVPSAAVEELQRVGRAFFALPTEEKERYPLDPASGQIEALRHPACKGTFKGKKDVGLTSSSPFFPPPEKVEPRPFWAPGSPPVEPGRAHDEALAPPM

SEQ ID NO: 55045 - DNA, 683 bp, Zea mays
  misc_feature: Ceres CLONE 1484529
  misc_feature: Encodes the peptide sequence at SEQ ID NO. 55046
  misc_feature (180)..(180): n is a, c, t, g, unknown, or other
  misc_feature (390)..(390): n is a, c, t, g, unknown, or other
acgattgggtccgggcccccctcgagccctgcagtggtaaagggtagttgcagcaccagcagcagaagagcagcgccagagctccagcaataatggccgagaagggcgtgaaggtgttggggatgtgggcgagccctatggtgatcagggtggagtgggcgctgcggctgaagggcgtcnagtacgagtacgtcgacgaggacctcgccaacaagagcgccgacctgctccgccacaacccggtgaccaagaaggtgcccgtgctcgtccacgacggcaagccggtcgcggagtccaccatcatcgtcgagtacatcgacgaggtctggaagggcggctaccccatcatgccgggcgacccctaccaccctgcccgggggaggttctggnccaagttccctaaaaacaattgcaacgctgctctgtacccgatcttccccgcgaccggggaggcgcaccgcaaggcggtgcccaaagcccagcgatgcctcaagacccctggaacggcctgggacgggaaaaatttcttcggggggaaccccgggggctcctccacattcgttttgggggggttcccccccctgcctccccctttttgggggggggaacggggcccgtgttccctccccaaaaagggttttcccttttaaaaaaggcctgtttcccgcctgttcccccccggg

SEQ ID NO: 55046 - protein, 185 aa, Zea mays
  misc_feature: Ceres CLONE 1484529
  misc_feature (4)..(77): Pfam Name: GST_N Pfam Description: Glutathione S-transferase, N-terminal domain
  misc_feature: SWISSPROT Homolog: EC 2.5.1.18 Glutathione transferase
  misc_feature (30)..(30): Xaa is any aa, unknown, or other
  misc_feature (100)..(100): Xaa is any aa, unknown, or other
MAEKGVKVLGMWASPMVIRVEWALRLKGVXYEYVDEDLANKSADLLRHNPVTKKVPVLVHDGKPVAESTIIVEYIDEVWKGGYPIMPGDPYHPARGRFWXKFPKNNCNAALYPIFPATGEAHRKAVPKAQRCLKTPGTAWDGKNFFGGNPGGSSTFVLGGFPPLPPPFWGGERGPCSLPKKGFPF

SEQ ID NO: 55047 - DNA, 793 bp, Zea mays
  misc_feature: Ceres CLONE 1484533
  misc_feature: Encodes the peptide sequence at SEQ ID NO. 55048
  misc_feature (35)..(35): n is a, c, t, g, unknown, or other
  misc_feature (37)..(37): n is a, c, t, g, unknown, or other
  misc_feature (45)..(45): n is a, c, t, g, unknown, or other
  misc_feature (50)..(50): n is a, c, t, g, unknown, or other
  misc_feature (793)..(793): n is a, c, t, g, unknown, or other
tttgtttccttttttgttttttttctccccgcccnancacatttnttttnccgattgggtacgggccccccctcgagccactgctgtggtaaagggggtccgttacctctgtatagagctgggacttttcttttcccaccacacacctggcactttcccgagggcaggactcttggggctccaaagccgacggatgatgggtaggagcccagctccgcacgcgggagctcagacgatcgccggcgtctgatgtggtgcgcatcctgcttggcgtcggcctgcctgggctgtacctgcaagctctggacgttggcggcatcgatcgtgggccgtccctccgcccgccgcccttactggtgcatgttcggcgcctcccttatcatctccttattgctccgccggttcgccggcgcgctcctcgagcctatcccatggctaaatgctgtggatctaaatacggcccgaagattggccccccctgcttgcttgtttcttcctgtccgacctggagcaacctcggtgttgctcagcgatacttttcgcccaggattggtggccgggaaagaccactaaaggtctgtcaatacgtcctgggcaccaaggggggccgggatttgcaaacaatggcctgccacgggcctgttacccattgggcccctatcgtcccaggcttggcgggaaagtttgggggcttccaggaatttatctcagcgccacattgtgggaaaaaaaaggggccccgcgtgtttccctttctttcaacatcttaattgtgtgttgcgagcacctcccn

SEQ ID NO: 55048 - protein, 107 aa, Zea mays
  misc_feature: Ceres CLONE 1484533
MWCASCLASACLGCTCKLWTLAASIVGRPSARRPYWCMFGASLIISLLLRRFAGALLEPIPWLNAVDLNTARRLAPPACLFLPVRPGATSVLLSDTFRPGLVAGKDH

SEQ ID NO: 55049 - DNA, 670 bp, Zea mays
  misc_feature: Ceres CLONE 1484536
  misc_feature: Encodes the peptide sequence at SEQ ID NO. 55050
  misc_feature (525)..(525): n is a, c, t, g, unknown, or other
cgattgggtccgggccccccctcgagccactgcagtggtaaagggattgcctcgcttcgctgggccggccaaagaaattgttcattatagtgaacccttatggtggaaagagaagtggaaggagtattttccagaatgaagttctccccctcattgaagcttctggcgtgctttatacgatgcaagaaaccaagcatcgccttcatgctcaagagatcgcacgttcacttgatcttaggaagtatgatggcatcatttgtgtcagtggagatggtttgatggtagaggttgtcaatggtctcctgcagagggaagactgggaaacagcaataaaagtgccccttgggatcgttccggcaggtactggaaatggaatggcacgatctctattgcatgctgctggtgaaccattctctatatctaatgctgtatttgcaatcatcagaggtcataaacgtgcacttgatgttacttctgttgtgcagggaaacacaaggttctttagtgtcctgatgcttacatggngtctggtggctgatgttgatattgaatcagagaagtataggtgggatgggaagtgctcgcccttgagttttatctcctactccgcatgctgaacctgcgaaggtacatggggcgcatccttttttgttccagcactagatatgaa

SEQ ID NO: 55050 - protein, 145 aa, Zea mays
  misc_feature: Ceres CLONE 1484536
  misc_feature (1)..(104): Pfam Name: DAGK_cat Pfam Description: Diacylglycerol kinase catalytic domain (presumed)
  misc_feature: SWISSPROT Homolog: EC 2.7.1.91 Sphinganine kinase
  misc_feature (116)..(116): Xaa is any aa, unknown, or other
MQETKHRLHAQEIARSLDLRKYDGIICVSGDGLMVEVVNGLLQREDWETAIKVPLGIVPAGTGNGMARSLLHAAGEPFSISNAVFAIIRGHKRALDVTSVVQGNTRFFSVLMLTWXLVADVDIESEKYRWDGKCSPLSFISYSAC

SEQ ID NO: 55051 - DNA, 666 bp, Zea mays
  misc_feature: Ceres CLONE 1484541
  misc_feature: Encodes the peptide sequence at SEQ ID NO. 55052
  misc_feature (491)..(491): n is a, c, t, g, unknown, or other
cgattgggtaccgggccccccctcgagccactgcagtggtaaagggtgctttttagctaccgaacggcggcgatgcgtcttttctccggcgtcctcgattcttcgtccgcgcttgcctccgccgtcctgggctccgtgtccgaccgcctcggattctcgcgcatagttttcggtcgagcgagcccttcgaacatgccggctctcgcttgttctgccgcttcctcgtcttctgccgctaccggcgcccagaaaccgtggctcttcgtcggtctggggaaccccgggcggatgtacaaaggcactcggcataacgttgggtttgagatgattgatgctattgcggaagctgagggcatatcattcagcagtaagcaatttaaggcagttgtcggaaaaggcctcattggtgatgtccctgtaatgctttgccagccacagacttttatgaaatgcagtggtgagtctgtcggacagctggttccatacttcangataccactcgatcaattagttgtgatctacgatgatcttgatctaccctttgcgaaattgcgtctgctacccaaggggggaattggtggccccaatgggatgaggaaattgttgaccttttgaaccaaaccggggatttgccccccaaaggtcggaattgaaccaccattattt

SEQ ID NO: 55052 - protein, 180 aa, Zea mays
  misc_feature: Ceres CLONE 1484541
  misc_feature (63)..(179): Pfam Name: Pept_tRNA_hydro Pfam Description: Peptidyl-tRNA hydrolase
  misc_feature: SWISSPROT Homolog: EC 3.1.1.29 Aminoacyl-tRNA hydrolase
  misc_feature (140)..(140): Xaa is any aa, unknown, or other
MRLFSGVLDSSSALASAVLGSVSDRLGFSRIVFGRASPSNMPALACSAASSSSAATGAQKPWLFVGLGNPGRMYKGTRHNVGFEMIDAIAEAEGISFSSKQFKAVVGKGLIGDVPVMLCQPQTFMKCSGESVGQLVPYFXIPLDQLVVIYDDLDLPFAKLRLLPKGGIGGPNGMRKLLTF

SEQ ID NO: 55053 - DNA, 673 bp, Zea mays
  misc_feature: Ceres CLONE 1484543
  misc_feature: Encodes the peptide sequence at SEQ ID NO. 55054
cgattgggtccgggccccccctcgagccactgcagtggtaaaggcgatacccgataccgatctaggagaagagaaaggcgtcatgtcgtcgttcggacgcaattcatggtgtatcctcgtgctggcctccgtgctcctcctgtcctgcctcgccgagacggccgtggccaaccgaacaggcgagctcaccgtcttctggggccggaacaaggaggagggcaccctgcgtgaggcctgcgacacaggactctacaacaccgtcatcatctccttctacagcgtcttcggccacggccgctacgccctcgacctctccggccacccgctggacggcgtcggcgccgacatcaagcactgccagtcccagggcatcccggtcttcctctccatcggcggcgggggaaaccactactccatcccttcctccgcgtccgcggaggccgtcgcggacaacctgtggaacgcgttcctcggcggcggaaacagcgacgtgccccgccccttcggtgacgcggcggtcaacggcatcgacttctacatcgacgaccacagcgcaccgggcgaccactacgacgagctcgcgcgccgtctcgactacttcaacagcatgtactaccacgccacgacgaagtacgtacggctgacggcgacgccgcggtgcgcgttcccgccc

SEQ ID NO: 55054 - protein, 197 aa, Zea mays
  misc_feature: Ceres CLONE 1484543
  misc_feature (33)..(196): Pfam Name: Glyco_hydro_18 Pfam Description: Glycosyl hydrolases family 18
  misc_feature: SWISSPROT Homolog: EC 3.2.1.14 Chitinase
MSSFGRNSWCILVLASVLLLSCLAETAVANRTGELTVFWGRNKEEGTLREACDTGLYNTVIISFYSVFGHGRYALDLSGHPLDGVGADIKHCQSQGIPVFLSIGGGGNHYSIPSSASAEAVADNLWNAFLGGGNSDVPRPFGDAAVNGIDFYIDDHSAPGDHYDELARRLDYFNSMYYHATTKYVRLTATPRCAFPP

SEQ ID NO: 55055 - DNA, 645 bp, Zea mays
  misc_feature: Ceres CLONE 1484549
  misc_feature: Encodes the peptide sequence at SEQ ID NO. 55056
  misc_feature (555)..(555): n is a, c, t, g, unknown, or other
cgattgggtccgggccccccctcgagccctgctttggtaaaggggagctcgacgatgactttcgacgacgcacgcagagatccggcgtactgcaaatttagaaaactgaactgtagtatggcatcagcagagctttcccgtgaggaaaatgtgtacctggtgaagctcgcctagcaggcgtagaggtacgaggagatggttgagttcatggacaaggtagccaagactgttgactcggaggagctcactgtggaggagcgaaacctcctgtctgttgcatacaagaatgtcattggagcccgccgcgcctcatggcgcatcctctcctccatcgagcagaaggaggacggccgacgaaatgatgaccgagtaacactcatcaaggattatcgtggcaagattgacactgagatgaccaacatctgtgatggcatcatcaagctgcttgagacccatcttgtgccgtcttccactgcccccgagtcccaggtcttctatctcaagatgaagggtgattactacagatacctcgctgaattcaagactggagctganagaaaggacgctgctgataacacaatggtggcttacaagggtgcccaggacatagctctggctgagcttgctacacctcaccctattggg

SEQ ID NO: 55056 - protein, 150 aa, Zea mays
  misc_feature: Ceres CLONE 1484549
  misc_feature (1)..(150): Pfam Name: 14-3-3 Pfam Description: 14-3-3 protein
  misc_feature (120)..(120): Xaa is any aa, unknown, or other
MVEFMDKVAKTVDSEELTVEERNLLSVAYKNVIGARRASWRILSSIEQKEDGRRNDDRVTLIKDYRGKIDTEMTNICDGIIKLLETHLVPSSTAPESQVFYLKMKGDYYRYLAEFKTGAXRKDAADNTMVAYKGAQDIALAELATPHPIG

SEQ ID NO: 55057 - DNA, 662 bp, Zea mays
  misc_feature: Ceres CLONE 1484553
  misc_feature: Encodes the peptide sequence at SEQ ID NO. 55058
  misc_feature (502)..(502): n is a, c, t, g, unknown, or other
  misc_feature (503)..(503): n is a, c, t, g, unknown, or other
  misc_feature (609)..(609): n is a, c, t, g, unknown, or other
  misc_feature (662)..(662): n is a, c, t, g, unknown, or other
cgattgggtccgggccccccctcgagccactgcagtggtaaaggtgaccgccttccctcttctcctgcgtcccaactgggcaattccccaaacctaactaacctttgccaccgcgggagccaccatgggtggccagatgccggacgccgatgggaaggcccgctcggcggactcctcgtcctcttacgggtacccgccgtcggcgccgccgcagcaccagtacggcacctttggccccccatccggagcctccggggagtttccgcagccggcggtcgggttcccccagccggcgccgccgcctgggatgcagcactacccgcagcctcctccggcgtcgtatgccgtctacccacccccgcagcaaccctactcggccgccgcgccgtactacgcccaaggctaccagatcgctcaaggttatattcctgttgttgaaggaaggcctgttagaatgcgtcctcttccatgttgtggccttggcatggggtggtttctgttnnatattgggttcttctttgctgccattcatgggtatctggagcttttgtgctgatttgtgtccgagtacgtgattacggggagaaactagatatgttgcttgcactnatgctgcttcgcttggctgcattgctgtgctgcttggcgcacaaaggagcggn

SEQ ID NO: 55058 - protein, 143 aa, Zea mays
  misc_feature: Ceres CLONE 1484553
  misc_feature (126)..(126): Xaa is any aa, unknown, or other
  misc_feature (127)..(127): Xaa is any aa, unknown, or other
MGGQMPDADGKARSADSSSSYGYPPSAPPQHQYGTFGPPSGASGEFPQPAVGFPQPAPPPGMQHYPQPPPASYAVYPPPQQPYSAAAPYYAQGYQIAQGYIPVVEGRPVRMRPLPCCGLGMGWFLXXIGFFFAAIHGYLELLC

SEQ ID NO: 55059 - DNA, 686 bp, Zea mays
  misc_feature: Ceres CLONE 1484556
  misc_feature: Encodes the peptide sequence at SEQ ID NO. 55060
  misc_feature (384)..(384): n is a, c, t, g, unknown, or other
  misc_feature (402)..(402): n is a, c, t, g, unknown, or other
  misc_feature (435)..(435): n is a, c, t, g, unknown, or other
  misc_feature (436)..(436): n is a, c, t, g, unknown, or other
  misc_feature (455)..(455): n is a, c, t, g, unknown, or other
  misc_feature (469)..(469): n is a, c, t, g, unknown, or other
  misc_feature (518)..(518): n is a, c, t, g, unknown, or other
cgattgggtaccgggccccccctcgagccactgcagtggtaaaggttcaagtcgcgtgctgctttcttctctcgttcacctcgcgtgcgcgaaccaactagggcgaccgctgccgccctacggcctacgcccagctgctcaggtcttattcgggcctttggcggcgagaaccgactgcgccaggataatggctcaccgtggacacttagatggactgactgcccaggctccagcactgatgcgccatggttccttcgctgcaggcagcctttctagccactcacctttggagtcttcatctacactggagatgctggagaacaagcttgccatgcaaactgcagaagtggaaaagcttatcatggagaatcagcggttagcatncagccatgtggtcttgangcaggacattgttgatacagagaaagagatgcnnaatatccgcacccacctangtgaagttcggacngagactgatttgcattatagaagatttatggaaaaaattagataatggnagcaaacatacatagggttgatgcggggaaaaaagaccttcctccagggcttttggaggcaaaaaacttttttcgggaaaggaaatgctgaactcttgaaaccaaggatggggcctaaaaaattccaaaatcctttggccctgggggaaataaaaaaccctttctgaa

SEQ ID NO: 55060 - protein, 108 aa, Zea mays
  misc_feature: Ceres CLONE 1484556
  misc_feature (66)..(66): Xaa is any aa, unknown, or other
  misc_feature (72)..(72): Xaa is any aa, unknown, or other
  misc_feature (83)..(83): Xaa is any aa, unknown, or other
  misc_feature (90)..(90): Xaa is any aa, unknown, or other
MAHRGHLDGLTAQAPALMRHGSFAAGSLSSHSPLESSSTLEMLENKLAMQTAEVEKLIMENQRLAXSHVVLXQDIVDTEKEMXNIRTHLXEVRTETDLHYRRFMEKIR

SEQ ID NO: 55061 - DNA, 1296 bp, Zea mays
  misc_feature: Ceres CLONE 1484557
  misc_feature: Encodes the peptide sequence at SEQ ID NO. 55062
gtgcgtggctccgcgctctcttccgccgccagtccgccggctcaactccagccgccgcgtgcccctcctctccccacccgatgcgggccctcgcgcgcgccgcgtcgctgctccgccgcgcctcggggtccgcgcctactacggcgtcgctgtaccatccgccgcggaacgtaggcccttgcctcgtgaagaatctgccaggtttctttttcaatgggtattctactcttttggctccaccaaatgaagtgttgattccaccagaactcctttctagcaggactgtgtggacaccagatcgggagcttgggcagtatgaagacctggtagctagggtcacaaacttccataatgaggacaagggcttcatggttttggatggcgatgtttttgatgttccaattaggaaggacattgttcaccgagtagtaaggtggcagcttgctaaaagacagcaggggacacactcaactaaaactatcagtgaagttagtggcactggaagaaagccttacccgcaaaaaggaaccggaaaagcacgacatggaacactgcgcggtgcccagtttcgtggtggtgcaaccatgcatgggcctaaacctcgaagccatgcaatcaagctgcagaagaaagtacggcggctggggcttaagattgccttgtctgctcgaactgctgaggggaagctcttgatctttgaggacttggaagttcctagccacaagacgaaaaacattgtgcaatacattagacagatggatgactcaaagaaggttctgttggtggatggaggcgacattgataagaagctaaagttggccactcaaaaccttcactacgttaacgtacttccttccattggcctcaacgtctacagtatcctccagcatgacacccttgtaatgactcgggccgctatcaacagaatcgtcgagcggatgcatacccccatcaaccgctagcaaggagggttctgagtcgcaccactgtttcttacagccagcaacctgtgctttttcgtcccctgttaaagctcgaaggtttcctgttatcttggtgctaacatggagctgcgacgtcagctgtttattttctgtcagactgaaggcaccgaccgagataggagggaaatgatcgggccttttgtaagcaggtcattggatgtttattttagattatttttttggcgttttacccacactacccttgaaacttagtgagtacttatctaccaaataagattatataaattggattatataataccggattatataggtccaaaaaaaaaaaaaa

SEQ ID NO: 55062 - protein, 293 aa, Zea mays
  misc_feature: Ceres CLONE 1484557
  misc_feature (96)..(286): Pfam Name: Ribosomal_L4 Pfam Description: Ribosomal protein L4/L1 family
MRALARAASLLRRASGSAPTTASLYHPPRNVGPCLVKNLPGFFFNGYSTLLAPPNEVLIPPELLSSRTVWTPDRELGQYEDLVARVTNFHNEDKGFMVLDGDVFDVPIRKDIVHRVVRWQLAKRQQGTHSTKTISEVSGTGRKPYPQKGTGKARHGTLRGAQFRGGATMHGPKPRSHAIKLQKKVRRLGLKIALSARTAEGKLLIFEDLEVPSHKTKNIVQYIRQMDDSKKVLLVDGGDIDKKLKLATQNLHYVNVLPSIGLNVYSILQHDTLVMTRAAINRIVERMHTPINR

SEQ ID NO: 55063 - DNA, 802 bp, Zea mays
  misc_feature: Ceres CLONE 1484565
  misc_feature: Encodes the peptide sequence at SEQ ID NO. 55064
  misc_feature (35)..(35): n is a, c, t, g, unknown, or other
  misc_feature (36)..(36): n is a, c, t, g, unknown, or other
  misc_feature (49)..(49): n is a, c, t, g, unknown, or other
gtatattggattcttgtttttccggaggggtgggnngccttttaaaatntcccgaatgggtaccgggccccccctcgagccactgcattggtaaaggtaaggggggtgcagcacctcatcatctgcagcgagagcgggcgcgcgctggtgtcccaccactcggtcctggtgttcgaggccttctcggctacggcgccgggacgcctggacgcggccacggcctacctcctcgacgagctcacggacgactgccgcgccgactaccgcaacgtcatggccgctgccgtgcgcggagactacgacacgtgcggcctgtacgccgaccagctgatgcggtggtccgcggagctgctcaaggacggcgtccttggtctgaagcacctcgccgcggaggacgccttctgcgagctttttgacctctacatggccgcgcccgatccgtcgtgcaactaccaaatcaaccctgtttatgatacaccaccctgcccgaacatgtggggcccatttgggaccacagtgttccccaatccatccccaatttttttgagcctgcaaggtaatcggtcccggcccgtcaaacgaagcttgcccccctttgaatcatcccctctggcgaacggcccatctgtaacgcctgaaccggaagttacaatccgcccgtgtaggccccaccatccctggccgacttatttcccaaagcttggcacgtaaattccggtcctcaacccgacggcgtccaattaaccctggaggcagttggaaaccacccgcggagagaagaccttatctaaaattaggatcc

SEQ ID NO: 55064 - protein, 145 aa, Zea mays
  misc_feature: Ceres CLONE 1484565
  misc_feature: SWISSPROT Homolog: EC 4.1.1.19 Arginine decarboxylase
MAAAVRGDYDTCGLYADQLMRWSAELLKDGVLGLKHLAAEDAFCELFDLYMAAPDPSCNYQINPVYDTPPCPNMWGPFGTTVFPNPSPIFLSLQGNRSRPVKRSLPPFESSPLANGPSVTPEPEVTIRPCRPHHPWPTYFPKLGT

SEQ ID NO: 55065 - DNA, 654 bp, Zea mays
  misc_feature: Ceres CLONE 1484568
  misc_feature: Encodes the peptide sequence at SEQ ID NO. 55066
cgattgggtacgggccccccctcgagccactgcagtggtaaaggggacagcatccaggtcccaccgttcagtggacgtaagaaagacacccggatcctgcgctctcctcaccctctccacttccgtttccggatcccgtttccagctccgatccaacccagcatctgtaccgcgccgcgcgagcacgtccggcgccggtgcggcaggcgaaatccgagagcactcctcccccgctacgccgcaccgcccatggccgcagctagccgcagatagagagaggcgcaggcgagggcgtgcagatccagatccggtgggcgggaaggacttgatcgcccccaccaccatggccggcgcggtgtcggcgctcttcctgctggacatgaagggccgcgttctcgtctggcgcgactaccgcggcgatgtctccgcgctccaggccgagcgcttcttcaccaagctcctcgacaaggagggcgattcggaagtgcactcgcctgtggtctacgacgacgctggcgtcacttacatgttcatccagcacaacaatgtcttcctcctcaccgccgctcgccagaactgtaacgcggccagcatcctcctcttcctccaccgtgtaatagatgtgtttaagcactacttcgaggagctggagga

SEQ ID NO: 55066 - protein, 103 aa, Zea mays
  misc_feature: Ceres CLONE 1484568
MAGAVSALFLLDMKGRVLVWRDYRGDVSALQAERFFTKLLDKEGDSEVHSPVVYDDAGVTYMFIQHNNVFLLTAARQNCNAASILLFLHRVIDVFKHYFEELE

SEQ ID NO: 55067 - DNA, 693 bp, Zea mays
  misc_feature: Ceres CLONE 1484572
  misc_feature: Encodes the peptide sequence at SEQ ID NO. 55068
  misc_feature (325)..(325): n is a, c, t, g, unknown, or other
  misc_feature (326)..(326): n is a, c, t, g, unknown, or other
  misc_feature (336)..(336): n is a, c, t, g, unknown, or other
  misc_feature (337)..(337): n is a, c, t, g, unknown, or other
  misc_feature (348)..(348): n is a, c, t, g, unknown, or other
  misc_feature (349)..(349): n is a, c, t, g, unknown, or other
  misc_feature (360)..(360): n is a, c, t, g, unknown, or other
  misc_feature (363)..(363): n is a, c, t, g, unknown, or other
  misc_feature (374)..(374): n is a, c, t, g, unknown, or other
  misc_feature (440)..(440): n is a, c, t, g, unknown, or other
cgattgggtaccgggccccccctcgagccactgcagtggtaaaggcgtgtgatcctgatcttgccgagtgcaatcgagatccgtgccagcccgtccatactgcggtggcgtggcggtgacgtgccggcgcggcgcggcgcggcgccgataagaggtagagagaggaaaaaaaagaacaatcaattctccagaccctccccggcaaccgcgtccggccgtccgcttccgtttccttggataaccacgacgcccgccggcaagcgaaagcgaagcgagccaacccagccatggagaaggcgatcgatcggcagcgggtcctcctggnngcactcctcnnctcccccctcnngcgctcctcgnagnctcagcttgcngcgtcggcgtgcgcggccggggacagcgccgcctaccagagtcctcctccttcggaacgaatgtcntcgtcttcgctgcctacggaacgcaaattccagggcaaaggagggaggcttcaggcacccttcccaaaagaccccttcctggtgtttccaagggtgtttgggaaaacctaaaaaccaccccggtaaatcgggaaaattcctttgggaaagggggctcgcccttgtttcccccggggaaaaaaaaggagaaagggccgccttttttggggttcccccaaaaacccccctctttaaaaaatccacacccccgggt

SEQ ID NO: 55068 - protein, 87 aa, Zea mays
  misc_feature: Ceres CLONE 1484572
  misc_feature (13)..(13): Xaa is any aa, unknown, or other
  misc_feature (17)..(17): Xaa is any aa, unknown, or other
  misc_feature (21)..(21): Xaa is any aa, unknown, or other
  misc_feature (25)..(25): Xaa is any aa, unknown, or other
  misc_feature (26)..(26): Xaa is any aa, unknown, or other
MEKAIDRQRVLLXALLXSPLXRSSXXQLAASACAAGDSAAYQSPPPSERMSSSSLPTERKFQGKGGRLQAPFPKDPFLVFPRVFGKT

SEQ ID NO: 55069 - DNA, 663 bp, Zea mays
  misc_feature: Ceres CLONE 1484574
  misc_feature: Pfam Name: NPH3 Pfam Description: NPH3 family
cgattgggtacgggccccccctcgagccactgcagtgccgacgctccctatgtttgctgttgccctctatctgcagggtgtcgtcccaggaggtcccgaccgacctcaccgtccgcatcgccgactccgtcttctctctccacaaggcggtgatggtgcccaagtgcggctacatccgccgggccgtggcggcgagccagacgcagggcccggggggcggcgccgtcgagctggacctctccgcgctgccgggcggcgctgacgccttccagaaggcggcgcgctgctgctacggcgacagcctcgagatcacggcgcgcgacgcggcggcactccgctgcgccgcggagttcctcgacgcgccggacctggcccgccgcgccgacgacttcctcgcgcaggccgcgctgcgcgcgctccccggcgccgccgccgtcctgcggtcctgcgaggcgctgctcccggccgccgacgagctcggcgtcgcgcgccgcgccgcggacgccgtcgcgctcggggtctgcaacgaggcgctgttcccgacgccgcgggcgccgcccgggttggtgggcggccgagctggcggcgctgtcgccggcgtcgttccggagggtggtcgcggctctgcagtgccgccgggccgggcccgaagtggtggccgcc

SEQ ID NO: 55070 - DNA, 683 bp, Zea mays
  misc_feature: Ceres CLONE 1484578
  misc_feature: Encodes the peptide sequence at SEQ ID NO. 55071
  misc_feature (349)..(349): n is a, c, t, g, unknown, or other
  misc_feature (389)..(389): n is a, c, t, g, unknown, or other
  misc_feature (393)..(393): n is a, c, t, g, unknown, or other
  misc_feature (398)..(398): n is a, c, t, g, unknown, or other
  misc_feature (407)..(407): n is a, c, t, g, unknown, or other
  misc_feature (478)..(478): n is a, c, t, g, unknown, or other
ccattgggtccgggccccccctcgagccctgcagtggtaaaggggccgcaagcaaaccgaacgaacccaaccgaagcgagagctgagcaaggcagaggcggcgtgaccggcgatggagcggctgcagcggatctttggcgcctccggcatggggcagccgccgacggactcgccgctgctcgattcctccgagcaggtctacatctcctccctagcgcttctcaagatgctcaagcacgggagggctggggtgcccatggaggtcatgggcctcatgctcggtgagttcgtcgacgactacaccgtccgggtcgtctatttcttcgccatgccccaaagggggactggngtcatttttttttccccccccacgggggccgaggggggtntttnaaatnccccccccnaccctttggccaaaaaagataaaaagttggtatccctcccgggccggggtcccaaccctggccatcaagcntccatatcaatactccactaaaagtttcgaagctttgaccccccaaaacccgttgtttttttgaaaaaccccccccccaaagcgggaaagggcaatgtcgctcttgtttgttttccctcccctcaaatccccacacccagtgtcgcctttgcgcgcagacccccctccgcaaaaataactttcttgttgtcgcccctctccatcg

SEQ ID NO: 55071 - protein, 128 aa, Zea mays
  misc_feature: Ceres CLONE 1484578
  misc_feature (24)..(119): Pfam Name: Mov34 Pfam Description: Mov34/MPN/PAD-1 family
  misc_feature (93)..(93): Xaa is any aa, unknown, or other
  misc_feature (94)..(94): Xaa is any aa, unknown, or other
  misc_feature (96)..(96): Xaa is any aa, unknown, or other
  misc_feature (99)..(99): Xaa is any aa, unknown, or other
MERLQRIFGASGMGQPPTDSPLLDSSEQVYISSLALLKMLKHGRAGVPMEVMGLMLGEFVDDYTVRVVYFFAMPQRGTGVIFFSPPTGAEGGXXNXPPXPLAKKDKKLVSLPGRGPNPGHQASISILH

SEQ ID NO: 55072 - DNA, 670 bp, Zea mays
  misc_feature: Ceres CLONE 1484581
  misc_feature: Encodes the peptide sequence at SEQ ID NO. 55073
cgattgggtccgggcccccctcgagccactgcagtggtaaaggagaggcacacaagctagcaattgaaaaaaaaaacaggcaaggaaaatggctccgaccgccgccaaggacagtggctccgccgatcgctggcgcgaggtgcaggcgttcgaggacagcaagctgggtgtgaagggcctggtcgactccggcgtcaagtccatcccggccatgttccaccacccgccggagtccctcaaggatgtcatttctccaccagctctgccctcctccgacgatgcgccggccatcccagtggtggacctgtccgtggcgcggcgcgaggatctggtggcccaggtgaagcacgcggccgggacggtgggcttcttctgggtggtgaaccacggcgtgccggaggagctgatggccagcatgctcagcggggtgcgccagttcaacgagggctctctggaggccaagcaggcgctctactcacgggaccccgctcgcaacgtgcgcttcgcttccaacttcgacctcttcgagtccgcggcggccgactggcgcgacacgctctactgcaagattgcgccggatccggcgccgcgggagctcgtgccggagcctctccggaacgtgatgatggaatacggcgaggaactgacgaagctggcgcggtccatgttc

SEQ ID NO: 55073 - protein, 194 aa, Zea mays
  misc_feature: Ceres CLONE 1484581
  misc_feature: SWISSPROT Homolog: EC 1.14.11.20 Desacetoxyvindoline 4-hydroxylase
MAPTAAKDSGSADRWREVQAFEDSKLGVKGLVDSGVKSIPAMFHHPPESLKDVISPPALPSSDDAPAIPVVDLSVARREDLVAQVKHAAGTVGFFWVVNHGVPEELMASMLSGVRQFNEGSLEAKQALYSRDPARNVRFASNFDLFESAAADWRDTLYCKIAPDPAPRELVPEPLRNVMMEYGEELTKLARSMF

SEQ ID NO: 55074 - DNA, 655 bp, Zea mays
  misc_feature: Ceres CLONE 1484582
  misc_feature: Encodes the peptide sequence at SEQ ID NO. 55075
  misc_feature (447)..(447): n is a, c, t, g, unknown, or other
actattgggtaccgggccccccctcgagccctgcagtggtaaagggttcagcccgtccgcgggccagagtcgcgcgactggagtaccgcggcggcgaaccaaagcgaaggcggcgagcggaaagccgcctggcgactccagatctctccggcctgctcctcggctcctcgctcctcctgcgccgccgcggaggcagatacaccctctggatcaagccccgctgcatctcagctgtggcttcctgcaggctggggactttggctgcttcctgcaggctggaggagtttctgaatggccaatcccaggcatgcggtggacgtcagctcctccatgtcggagctgaccgtagaagcagcgccttcatcgattgaggcccaggtcgggaggaggctaatggcggcgttgttgctgctgccaaactcgatgatgtatggggagatgtttcanggttctcctcaccacgcggataccttaaacagagaatggatcccacaggcagagtccagtttcagaagatgggaatatcttgatggtgtaacagaaagggcaaaaggactctgcccaagaagggctttcatgtttgggtccaggcaatctggaaacctttggctacaaagggggcctttgttccctgggggttggccaatggccctta

SEQ ID NO: 55075 - protein, 121 aa, Zea mays
  misc_feature: Ceres CLONE 1484582
  misc_feature (52)..(52): Xaa is any aa, unknown, or other
MANPRHAVDVSSSMSELTVEAAPSSIEAQVGRRLMAALLLLPNSMMYGEMFXGSPHHADTLNREWIPQAESSFRRWEYLDGVTERAKGLCPRRAFMFGSRQSGNLWLQRGPLFPGGWPMAL

SEQ ID NO: 55076 - DNA, 707 bp, Zea mays
  misc_feature: Ceres CLONE 1484583
  misc_feature: Translation starting site: 211
  misc_feature (1)..(1): n is a, c, t, g, unknown, or other
  misc_feature (246)..(246): n is a, c, t, g, unknown, or other
  misc_feature (349)..(349): n is a, c, t, g, unknown, or other
  misc_feature (361)..(361): n is a, c, t, g, unknown, or other
  misc_feature (365)..(365): n is a, c, t, g, unknown, or other
  misc_feature (381)..(381): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (403)..(403): n is a, c, t, g, unknown, or other
natctattgggtacgggcccccctcgagcactgcagtggtaaaggagatcccacctgcagctgcccagcgggtggtgcttagcttaggctagcctagctgcgcctgcgcatgctcgtgaccaatggcgtccagcaaggtgccactgttcctcgtcctcaacctcctggtcttcgcggcggccaacgcctgcccttactgcccgggcaacaatggccacggtagcagcgggcaccatggcggcagtnggcatggcggcggtggcaccggcggttccggtgtcgccaccggggcaggtgggggcaacaacggttgattgtacggtccgatcggtggtggtggtggcaccgnttttttatccgntcanacccggggaaagaaangggggaannnnnntnnnaatcnaacccctcctaaagggtaacaaaaaaaaaccccacccctagggagggggggggcgcggccgggtaccaaccccctccctcgcccagtggtatattgaaaccgcgaaatccgcccccatacccccctcgtaaaccaaaccgccaaactatgccggctaccggcaattcccctacacaaaaccccttcaaacccccccgtacccatccccaccctgtccgcacctcctcctccagtctatatcttcctttctacccaacacgaaatatacgccctatcaattaccccccaacaccaaaacgccaac

SEQ ID NO: 55077 - DNA, 663 bp, Zea mays
  misc_feature: Ceres CLONE 1484586
  misc_feature: Encodes the peptide sequence at SEQ ID NO. 55078
  misc_feature (663)..(663): n is a, c, t, g, unknown, or other
ccgattgggtaccgggccccccctcgagccctgcagtggtaaaggaagcgaggtagttgccactgccgtcccctccagaagtgcgatacagttcggattcagatcgcggccggtgcgaacccacgaaggcacgaacggtagaacccgaccgagcgcggcagcgcaaacctccgatccctgctgcgagcaaggatggcggcggcatgggcagtgctggcggcggtgctcgtcgcagcgcaggtggcgtctgctgcgccggtcacggcgccagcgttcctctgggcgcccaagaactacggattccgctctgatgatgctaaggaggtagtcgattatcaaacaatctcaccaaagaacttagctaaatctgttcttgaggaaggtggctggtcaacctttatgtgttcaagggaggatactgagaagcatgttgatgttgccattgtttttattggctcaaagctacaatcatcagacatatcgaaagataagcacgttgatccagctttagcagatacattgaagctctccttcacaaaatcagagttttccatggcattcccctatgtttccacatcagacgatgagaaactagaggagtcattgctatcaagcttcgctgacaactgtgaaagtggttttggaagaaccgtatcgcctacn

SEQ ID NO: 55078 - protein, 157 aa, Zea mays
  misc_feature: Ceres CLONE 1484586
MAAAWAVLAAVLVAAQVASAAPVTAPAFLWAPKNYGFRSDDAKEVVDYQTISPKNLAKSVLEEGGWSTFMCSREDTEKHVDVAIVFIGSKLQSSDISKDKHVDPALADTLKLSFTKSEFSMAFPYVSTSDDEKLEESLLSSFADNCESGFGRTVSPT

SEQ ID NO: 55079 - DNA, 675 bp, Zea mays
  misc_feature: Ceres CLONE 1484589
  misc_feature: Translation starting site: 120
  misc_feature: SWISSPROT Homolog: EC 2.4.1.207 Xyloglucan:xyloglucosyl transferase
  misc_feature (404)..(404): n is a, c, t, g, unknown, or other
cgattgggtaccgggccccccctcgagccactgcagtggtaaaggagaccaagaagtgccctccactttgtaagctcgtttccgaaaagagctctagagccgccacacacacacacaccatggcaccgcgttctctgctggcagtgctcgccgtcgccgccctcgcgctcttgcacgccgcctcggccaagtcgtcgtggcttgacaggaggttcaccacggacggcaccgtccgcacgggatacgacgattcgggccagcaggtggtgatgctccgcctcgaccagcactccggcgctgccggcttcaactccaaggagcagtacctttacggcgagttcagcgtcgagatgaagctcatccggaggaactccgccggcaccgtctcgtgcttctacctctcntccggcgacggcgacgggcgcgacgagatcgacatggagttcatgggcaactcgagcgggcagccggtggtgctgaacacccacgtgtgggccagcgcgacggcaagaaggaccaccagttcgacctctgggtcgacccctcggcgactaccacacctacacattcatctggaaccccacaacaatctggttcaaggtcgaagacttcttcattcgctccttaaagggctacgcccaacttgcgtaaccgagctcccagccaatgaacccg

SEQ ID NO: 55080 - DNA, 463 bp, Zea mays
  misc_feature: Ceres CLONE 1484592
  misc_feature (1)..(1): n is a, c, t, g, unknown, or other
  misc_feature (30)..(30): n is a, c, t, g, unknown, or other
  misc_feature (31)..(31): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (114)..(114): n is a, c, t, g, unknown, or other
nctaaattaaataaaaaaacatatttcacnncctagaccgacccctatccgcatgtaagaattataatataaannnnnttttnnnnnnnccgattgggtacgggccccccctcnaccctgcatggtaaagtatagcacacaagacggcagttcttcactggcaatggaactggccgggttacgagaattgaaagacctgtttcagattcgtcctggatctgatctccagatgaatctgtacatatgcttgccttaaatggtctcaacatttctgtgaaagtacaatcccgtaatataaagcactctcttttctacccctgcagtttccttttagctgatgcactacagatgtgtaccaggttctcctaaaaaaaaattttcaaaaagcaaggcccttgattggggttcaatggctgaaagaaccgggcatttttttttgctattgtggcaaatttattttcgc

SEQ ID NO: 55081 - DNA, 664 bp, Zea mays
  misc_feature: Ceres CLONE 1484596
  misc_feature: Encodes the peptide sequence at SEQ ID NO. 55082
cgattgggtaccgggccccccctcgagccctgcagtggtaaagggggtaatgctactgctgagatgatgaagacggttgtgctctcaggaccagaacttgcgaatctgaagtcctagccggaggtgagacgcccattcggtgatccgccgcttccccgtcagtaccatgtccgctgagagcgagaggcctgtacgccttctcatcaccgtcggcggatggggggcacttctcgcggggatgctgttccgctcccaccatggtcgcgatgaatagctctggtaggagctcgtcctccgtggcgccgacaaaaatccaattgacatcgttcctgcccgccgtggacgacacagagcccgtcgctcctcgatccgatatcttgctcggactctgtcggtcatgcgaccatgccgtgctgcggctgccgtcgttctcctaagttcgcgccacccatggttctttgctctgcatatgaatctctacatggtgccctttcatgcacatgctcgtgctctcgacggtgtgacaattgcgattctgtgcccgtctaattatggctctggaccattagtggtttctgcctgtcaatgaaaacactgagtgtagtataagtagtgaccattcgttatctccaaactaaggattcttctcgctagttctgggatt

SEQ ID NO: 55082 - protein, 59 aa, Zea mays
  misc_feature: Ceres CLONE 1484596
MVAMNSSGRSSSSVAPTKIQLTSFLPAVDDTEPVAPRSDILLGLCRSCDHAVLRLPSFS

SEQ ID NO: 55083 - DNA, 672 bp, Zea mays
  misc_feature: Ceres CLONE 1484611
  misc_feature: Translation starting site: 188
  misc_feature (1)..(1): n is a, c, t, g, unknown, or other
  misc_feature (344)..(344): n is a, c, t, g, unknown, or other
ncgattgggtaccgggccccccctcgagccctgcagtggtaaagggttcttccagcgaagcaagcagcctaaaaaaaccgtatcgtctcgcctgttcagtttccttctcctcttcccgcagcccggtttgccgaccaggttccaccgttccagagtagccaagcgaatcccgtgtctggttcgcgcgatggcggaggagcagtccaacccccagcaccagcaagcggaggagagggaggttatggtggagcagcagcagccgaggagggccccgaagctgaggtacctggacttcgtccaggtggcggctgcccaggccgcggtgtgcctcgctgggctctacngccctcgcaagaccacgccggcccgctccgcctcagcgttgacgccgtcgagtctgccgtcaagggcgtcgttagccccgtctacgacggcttcgggcgcctgccgctcgacgtcctcgccttcgtcgaccgcaaggtggacgacccggtgcacgaggtggaccaaccaccttccgggcgccctgaaagcggcgtcggcccatgtttaccccgtggttccggggcctgcccaaggtgccccccaccttgcggccaaggcccaccggttcggggtgagaggccccaccccgggcggccctccccaatcacggacccgggggcccggaaa

SEQ ID NO: 55084 - DNA, 655 bp, Zea mays
  misc_feature: Ceres CLONE 1484612
  misc_feature: Encodes the peptide sequence at SEQ ID NO. 55085
  misc_feature (1)..(1): n is a, c, t, g, unknown, or other
  misc_feature (439)..(439): n is a, c, t, g, unknown, or other
  misc_feature (440)..(440): n is a, c, t, g, unknown, or other
  misc_feature (459)..(459): n is a, c, t, g, unknown, or other
  misc_feature (480)..(480): n is a, c, t, g, unknown, or other
  misc_feature (489)..(489): n is a, c, t, g, unknown, or other
  misc_feature (500)..(500): n is a, c, t, g, unknown, or other
ncgattgggtaccgggccccccctcgagccactgcagtggtaaaggaagcagatagcagcaagctaagcaagtgccaaccaacgagtagcaggaaacatgtctccgcccgtcaagatcctcggccactacgcgagcccgtactcgcaccgcgtcgaggccgctctgcggctcaagggcgtgccgtacgagctggtccaggaagacctgggcaacaagagcgagctgctgctcgccaagaaccctgtccacaagaaggtgcccgtgctcctccatggcgacagggccgtctgcgagtccctcctcatcgtcgagtacgtcgacgaggccttcgacgggccgtccatcctgccggccgacccccacgaccgtgccgtcgcccgtttctgggcgaacttctaggacaccaagttctcccagccgttctggctggcgtactgnngcgagggcgagcgcaaaangccgtggtgaaggaagccaangagaactgncgctcctggangcgcagctcggcgggaagagcttcttcggcgcgacacgccggttacctcacatagccgcgtgcgcgtggggtcttggatcgcgtgctcgaagagtgactggagtgcctttctggacgccaacaatttcccgctctatgccgggggccagggacta

SEQ ID NO: 55085 - protein, 100 aa, Zea mays
  misc_feature: Ceres CLONE 1484612
  misc_feature (3)..(76): Pfam Name: GST_N Pfam Description: Glutathione S-transferase, N-terminal domain
  misc_feature: SWISSPROT Homolog: EC 2.5.1.18 Glutathione transferase
MSPPVKILGHYASPYSHRVEAALRLKGVPYELVQEDLGNKSELLLAKNPVHKKVPVLLHGDRAVCESLLIVEYVDEAFDGPSILPADPHDRAVARFWANF

SEQ ID NO: 55086 - DNA, 664 bp, Zea mays
  misc_feature: Ceres CLONE 1484616
  misc_feature: Encodes the peptide sequence at SEQ ID NO. 55087
  misc_feature (547)..(547): n is a, c, t, g, unknown, or other
cgattgggtccgggccccccctcgagccactgcagtggtaaaggggatcatggaggaggggcggcaactggaagcggcggcgttcggttttccggcgccggtgcagccgggggccacgcgcgtggggtggatcggcatcggcgtcatgggcggcgccatggccaagcgcctcctcgcggcagggtacgcggtcaccgcgtacgctcgcacgccgtccagggcggagagcctcgtcgcggcgggcgcgagcctcgcggactcgccggccgccgtggccgccgcgtccgacgtggtgttcaccatggtcgggaaccccggcgacgtccgcgcggtggtcctggacccggccgccggggccctcgcgggcctccgccgcggcggcgtgctggtggactgcacgagctcctccccgtccctcgcgcgcgaagtcgccgcggccgcggccgcggcgggctgccacgccgtcgacgcgccggtctccggaagcgaacgtggcgcgcgggacggcacgctggccgtcttcgccggcggcgacgagccgtcgtcncctgggtcggcgcgctcttcgccaggctcgggagggcgaaccgcatgggcgcgccggggcagcgggcagaagcacaagatccgccaccagggtcgcgtgggcgggggcggtgggtgg

SEQ ID NO: 55087 - protein, 205 aa, Zea mays
  misc_feature: Ceres CLONE 1484616
  misc_feature (22)..(176): Pfam Name: NAD_binding_2 Pfam Description: NAD binding domain of 6-phosphogluconate dehydrogenase
  misc_feature: SWISSPROT Homolog: EC 1.1.1.60 2-hydroxy-3-oxopropionate reductase
MEEGRQLEAAAFGFPAPVQPGATRVGWIGIGVMGGAMAKRLLAAGYAVTAYARTPSRAESLVAAGASLADSPAAVAAASDVVFTMVGNPGDVRAVVLDPAAGALAGLRRGGVLVDCTSSSPSLAREVAAAAAAAGCHAVDAPVSGSERGARDGTLAVFAGGDEPSSPGSARSSPGSGGRTAWARRGSGQKHKIRHQGRVGGGGGW

SEQ ID NO: 55088 - DNA, 682 bp, Zea mays
  misc_feature: Ceres CLONE 1484619
  misc_feature: Encodes the peptide sequence at SEQ ID NO. 55089
  misc_feature (476)..(476): n is a, c, t, g, unknown, or other
  misc_feature (482)..(482): n is a, c, t, g, unknown, or other
  misc_feature (572)..(572): n is a, c, t, g, unknown, or other
  misc_feature (659)..(659): n is a, c, t, g, unknown, or other
tcgattgggtaccgggccccccctcgagccactgcagtggtaaaggtcactcgagctcgagcgatcccactcccgatcagcagctgatcgctcactcttgcagctcgatcattctttagctgctctagctctagcctctagccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaagctgcccccgccgcgaaggcaaggtggaggagccagctgcccccggcgagaccgagccagctgccgccgctgagcccgaggcggcccccgtggcggcggaagaagagacgccaaagggagaagagacggcaaaggaagctgaaccggatcctgagcctgctgctgctgaagaggtgaaagangaagcngcagcgcccgctgccgagacagaagcagaaccggcagccgctgaccctgatgctgctgctgctgctgaggagccccgcgcggctgaaccngccgctgaagacccgaagaagccgagcccgcctgctgaggtgcccaaaaggccagcgagtgaggccgtgcgccttacgcgcactgcngccgcggacagcgggtcgggaaa

SEQ ID NO: 55089 - protein, 90 aa, Zea mays
  misc_feature: Ceres CLONE 1484619
MATAEVQTPTVVATEEAPVVETPAPPAVVPEEAAPAAKARWRSQLPPARPSQLPPLSPRRPPWRRKKRRQREKRRQRKLNRILSLLLLKR

SEQ ID NO: 55090 - DNA, 646 bp, Zea mays
  misc_feature: Ceres CLONE 1484620
  misc_feature: Encodes the peptide sequence at SEQ ID NO. 55091
  misc_feature (319)..(319): n is a, c, t, g, unknown, or other
  misc_feature (341)..(341): n is a, c, t, g, unknown, or other
  misc_feature (349)..(349): n is a, c, t, g, unknown, or other
  misc_feature (375)..(375): n is a, c, t, g, unknown, or other
  misc_feature (403)..(403): n is a, c, t, g, unknown, or other
  misc_feature (592)..(592): n is a, c, t, g, unknown, or other
cgattgggtaccgggccccccctcgagccctgcagtggtaaaggagggcctctcgatcgctcatcagtcgccagaggagtagttgatcgaggtgagtgaggttgaaaagcaggcggcgaacaaagcaccatcgtcatggacggcggatactacggcggccgcgatcagcgctacagcggcgggtactacggcggcggtggcatcgcgacgccggggtacgctcccggcgtcccgtacgggatgtcgcaggtgaacatcgagggcaacgggtgcgggcgggcgctgccgccgcagccgacggtgaaggtgtactgccgcngccacccccactacgccatgancgtccgcnacgggaaggtggtgctggccccggcnaaccccagggacgagtaccagcactggntcaaggacatgcggtggagcacgagcatcaaggacgaggaaggttacccggcgttcgcgcctgtgaacaaggcgaccggggagcccatcagcactcgctggggcagtcccaccccggtgcgcctggtgccctacaacccggacttttttgaaccattcggtgctgtgaacggaaacccgcaacgtcggnaacggctttccgctgcgtccggatggtcaaaaacatctaccttcagtttccacg

SEQ ID NO: 55091 - protein, 170 aa, Zea mays
  misc_feature: Ceres CLONE 1484620
  misc_feature (62)..(62): Xaa is any aa, unknown, or other
  misc_feature (69)..(69): Xaa is any aa, unknown, or other
  misc_feature (72)..(72): Xaa is any aa, unknown, or other
  misc_feature (90)..(90): Xaa is any aa, unknown, or other
  misc_feature (153)..(153): Xaa is any aa, unknown, or other
MDGGYYGGRDQRYSGGYYGGGGIATPGYAPGVPYGMSQVNIEGNGCGRALPPQPTVKVYCRXHPHYAMXVRXGKVVLAPANPRDEYQHWXKDMRWSTSIKDEEGYPAFAPVNKATGEPISTRWGSPTPVRLVPYNPDFFEPFGAVNGNPQRRXRLSAASGWSKTSTFSFH

SEQ ID NO: 55092 - DNA, 766 bp, Zea mays
  misc_feature: Ceres CLONE 1484622
  misc_feature: Encodes the peptide sequence at SEQ ID NO. 55093
  misc_feature (31)..(31): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
ttgcccccgccgcctcctccttttcccgcangcacnnnnnnnannnggtgttannnaaaacaaaggggtaccgggccccccctcgagccctgcagtggtaaaggattcccgcaacccccttgtgtcccgacaacgctgggagcccattctcgcaccgcacttcgttaggttagtttagatcacatcattctcaggtttgttttaggcttttagcctacacctgtcgcctcaattaattcgctgtggagggggagattcggaggcattagcagaatcaaaatccatggtgctgtacgccgatctcgacgcgctccgggcgtcggcggccgacgtgcggatcgtcacgtcggacggccagaccatcgccgcacactcctacgttcttgcctcggcgtcgccggtgctggagaggatgatccacagggcgcccccgcgggtgggggcgccgccgactgcactgtccctgtcttcggcgtcccctcccacgccgtcatcgcctttccttcacctactcaactcctccaggggggccccccggaccgaagaaggacttggtggccctcccacgggccccccatctggctgggcgctgggcgccacccctttacccgcgttccaaagtggcttgtaaacggcgcccccccccaagggcccccccgtggttcgggcgccgggctttgaaacccccgggacaccgcccgctctgtggaaaaaattggttctcaaaggccttggggcacaggggctttcctagcacaaagcaccc

SEQ ID NO: 55093 - protein, 115 aa, Zea mays
  misc_feature: Ceres CLONE 1484622
MVLYADLDALRASAADVRIVTSDGQTIAAHSYVLASASPVLERMIHRAPPRVGAPPTALSLSSASPPTPSSPFLHLLNSSRGAPRTEEGLGGPPTGPPSGWALGATPLPAFQSGL

SEQ ID NO: 55094 - DNA, 678 bp, Zea mays
  misc_feature: Ceres CLONE 1484626
  misc_feature: Translation starting site: 170
  misc_feature: SWISSPROT Homolog: EC 2.4.1.207 Xyloglucan:xyloglucosyl transferase
  misc_feature (1)..(1): n is a, c, t, g, unknown, or other
ncgattgggtaccgggccccccctcgagctctttctttggtaaaggaacttcctatgagattttattcgctacgcttgctcgcgtctgtcacgggttacttgctctactacagggcgggtatagagctgcctgcaatccgccgctgagaagggaggatcggaagcgacgatgaggtcgtttgctcctgtctttctgtcggcgggcgtggcctgcctggagctggcgggcaccgcgcagggcggcaacttctaccagaacacagagatgacctgcggcgatgtccgcggcaggtagtggacggcgggcgcgggctggacctgacgctggaccgcacgtctggctccggtttcagtcacagagcgagtacctgttcagcaagatcgacatgcagatcaagctggtgcccagcaactccgctggcacggtcaccaccttctacctgttctcccagggcgacgcgcaccgacgaaatcgaccttccagtccctgggcaacgtgaggcggggagcccttcacgcctggaccacccaacgtgtttcccccccggaaaagggcccgcgggaaacaaaaatttcccccctttggtttcacccctaacccggggcctttcacaacccttattctctttccggggaaaccccgccgcccccgggtttctttttccgggggtgggaagg

SEQ ID NO: 55095 - DNA, 663 bp, Zea mays
  misc_feature: Ceres CLONE 1484628
  misc_feature: Encodes the peptide sequence at SEQ ID NO. 55096
  misc_feature (1)..(1): n is a, c, t, g, unknown, or other
  misc_feature (440)..(440): n is a, c, t, g, unknown, or other
ncgattgggtaccgggccccccctcgagccactgcagtggtaaagggactccgtcttccccgagaatggcatccttttccagccgcggcccaaacctcctcgcaccggagatcctgaagccggacgtgaccgcccccggggtggacatcctggccgcgtggaccggcgagaactcgccctcggagctcgacagcgatacgaggcgagtgaagttcaacatcatatccggcacgtccatgtcgtgccctcacgtgagcggcatcgccgcgatgctccggcaggcgcgcccgggctggagccccgccgcgatcaagtccgcgctgatgaccaccgcgttcaacgtcgacagcgccggggacgtcatcagggacatgtccaccggcggggcgtccacgccgttcgtgcgcggggccggccacgtggaccccaaccgcgccctncacccaggcctggtgtacgacgccggcactgacgactacgtctccttcctctgcgcgctcggctacacggccaggcagatcgcccgtcctgacgcgtgacggctcggtgaccgactgttcgacgcgcccggggctctggtgggcgacctcaactaacccggccttctcgggtggggttcgggttccggcagacgacaaggttcacgcagcgcccggcgtcgta

SEQ ID NO: 55096 - protein, 178 aa, Zea mays
  misc_feature: Ceres CLONE 1484628
  misc_feature: SWISSPROT Homolog: EC 3.4.21.25 Cucumisin
DWVPGPPSSHCSGKGTPSSPRMASFSSRGPNLLAPEILKPDVTAPGVDILAAWTGENSPSELDSDTRRVKFNIISGTSMSCPHVSGIAAMLRQARPGWSPAAIKSALMTTAFNVDSAGDVIRDMSTGGASTPFVRGAGHVDPNRALHPGLVYDAGTDDYVSFLCALGYTARQIARPDA

SEQ ID NO: 55097 - DNA, 676 bp, Zea mays
  misc_feature: Ceres CLONE 1484629
  misc_feature: Encodes the peptide sequence at SEQ ID NO. 55098
  misc_feature (1)..(1): n is a, c, t, g, unknown, or other
ncgattgggtaccgggccccccctcgagccactgcagtggtaaagggtccgccccagtctagtccgattcaaacccgcccgttccccgtgtccgagccacgcaagccgagctcaatccccagaggccagagccagctgctcggcgctccacgcgatggcgcagaaggagaccaatggcagcaacggcgagcacatctccacccgcccgccgccgaccccgtcgcccctccgcttctccaagttcttccaggctaacctgcggatcctggtcactggtggggcgggcttcatcggctcgcacctcgtggacaggctcatggagaacgagaagcacgaggtcattgttgctgataactttttcaccggttcaaaagataacctgaagaagtggatcggacacccaagatttgagctcatccgccatgatgtcactgagccacttcttgtggaggttgaccagatctatcaccttgcttgccctgcttcaccaatcttctacaagcacaatcctgttaagaccatcaagacaaatgttattggtacccctgacatgctgggacttgcaaagagagttggagctaggattttgttgacatcaacatctgaagtttatggggatccacttgagcatcctcaaacccgaggcctactggggcaatgttaaccccatttggag

SEQ ID NO: 55098 - protein, 169 aa, Zea mays
  misc_feature: Ceres CLONE 1484629
  misc_feature (37)..(170): Pfam Name: Epimerase Pfam Description: NAD dependent epimerase/dehydratase family
  misc_feature: SWISSPROT Homolog: EC 4.1.1.35 UDP-glucuronate decarboxylase
MAQKETNGSNGEHISTRPPPTPSPLRFSKFFQANLRILVTGGAGFIGSHLVDRLMENEKHEVIVADNFFTGSKDNLKKWIGHPRFELIRHDVTEPLLVEVDQIYHLACPASPIFYKHNPVKTIKTNVIGTPDMLGLAKRVGARILLTSTSEVYGDPLEHPQTRGLLGQC

SEQ ID NO: 55099 - DNA, 671 bp, Zea mays
  misc_feature: Ceres CLONE 1484630
  misc_feature: Encodes the peptide sequence at SEQ ID NO. 55100
  misc_feature (90)..(90): n is a, c, t, g, unknown, or other
  misc_feature (230)..(230): n is a, c, t, g, unknown, or other
cgattgggtaccgggccccccctcgagccctgcagtggtaaagggttttacagggcggaggttgcagccaggggggagcagtcacacttnctctgtctggctttcacctggaggcttgcctgcagagtgggtgaaacatcttggtagatccttcaggagcctgctgcgtagaacaagggacatgaggctgaagctgcagtttggcaactctgggcgacagggcttcattngacgtcccttgttatttgcaaatagagtttttggacaaagtccccgggacaatgctgggccccgctgatccctaaggaagggacatgggtggagcatacccttcctctcatgtagatatttccccttctctttttggtgcattggattcagaacttaattcttggcagttaggctatatattgaaaggcagatgaatcttgcaaatattatatgtatcaactttctttggttaaaaaaaaaaaaaaaaaaccagagctctgggatttcctgcagcccggggggatccactagttctagagcggcccgccccggcggtggagctccagctttttgtcccttttagtggagggttattttcaagcttgccgtaatcctggccatagctgtttcctgggtaaattggttatccgctccaaattcccccaaaatacgaacccgga

SEQ ID NO: 55100 - protein, 98 aa, Zea mays
  misc_feature: Ceres CLONE 1484630
  misc_feature (30)..(30): Xaa is any aa, unknown, or other
  misc_feature (77)..(77): Xaa is any aa, unknown, or other
DWVPGPPSSPAVVKGFTGRRLQPGGSSHTXSVWLSPGGLPAEWVKHLGRSFRSLLRRTRDMRLKLQFGNSGRQGFIXRPLLFANRVFGQSPRDNAGPR

SEQ ID NO: 55101 - DNA, 713 bp, Zea mays
  misc_feature: Ceres CLONE 1484633
  misc_feature: Encodes the peptide sequence at SEQ ID NO. 55102
  misc_feature (371)..(371): n is a, c, t, g, unknown, or other
cgattgggtaccgggccccccctcgagccctgcagtggtaaaggattaataaaaaatctgacgacgtcctccttctcctgctccctggctgcaacggacttgaccactgaaagctaagcacacccctcggccatggcgctcgcgtccacctccgccaccgcgcccgctgccgtgctcaagaccccgttcctcggcgccaggcgcgcgctcgccaatgccgccgcgcccaagcccacgtcgcgccgcgcgctcctcgccgtcgccgcggccgccgccaagaagtcgtggatccccgccttcaagagcgacgccgagttcatcaccccgcccctggctcgacggatcgcttccctggcgacttcgggattccnatccgctggggctgggcaaaggacccgggctttcctcaagtggtaccggggggggggaaccttatcccccggccggggggcaaatggccccccgtcctgggattctttccgggggacaaggcccttggaacgggcatccccctggttttcgaagggcggggcgccaaaacccgggggccacatcgcgccccttttttcccttttgggttccccttgctggggcccccgccaccttcctccgccccttgggggggggggggggaaaacccaaaaacgggggggggggggaatttttttttaaccccccggaactccccaaattcccctggcaaggggggccca

SEQ ID NO: 55102 - protein, 179 aa, Zea mays
  misc_feature: Ceres CLONE 1484633
  misc_feature (80)..(80): Xaa is any aa, unknown, or other
MALASTSATAPAAVLKTPFLGARRALANAAAPKPTSRRALLAVAAAAAKKSWIPAFKSDAEFITPPLARRIASLATSGFXSAGAGQRTRAFLKWYRGGGTLSPGRGANGPPSWDSFRGTRPLERASPWFSKGGAPKPGGHIAPLFSLLGSPCWGPRHLPPPLGGGGGKTQKRGGGGIFF

SEQ ID NO: 55103 - DNA, 779 bp, Zea mays
  misc_feature: Ceres CLONE 1484634
  misc_feature: Encodes the peptide sequence at SEQ ID NO. 55104
  misc_feature (30)..(30): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
ctctttcttttcccataatcctgtgttatngnnnnnnnntctgccnnnnnnccgattgggtacgggccccccctcgagccactgctttggtaaaggaggccagccgtgcggcagcttctcccctcgcctccccccctcgtctccgcacagagagggctcctcgctgccgtgtgccgggcttcactttcccctctcgtctcctctcccatggctcagcgcgacaagaaggtggaggagccgacggagctgcgcgcgccggagctcacgctgtgcgccaacagctgcggcttcccgggcaacccggccaccaacaacctctgccaggcctgcttcctggccgccacggcttcctcctccgcctccgcctccgtctcgccgccgccgccctcctcctcctcctcgtcgccggcggtgctccacttcgacgagcaggagcagcggcaaaatccgaggtcgcgggcgccggaggcttccccgccccatggaggaaccgcctaggtcgggccggggggtcagctccggggtccggctccgggcgttcgccctcgttccgtccgccgggtgcccagacctgggccccaaggccggttgcgggtccacgggcctttcccgccgtccgccgccggaaaaagtttctctcctgcggaagccgccacccgttcgccttgtgtcgcggccggcaaaatggctggcctcgttgacatcgccgggggtacgtcccggggccgtgcgacccgcgcctctgctgcttaggtgaaaacaaaccccccgccccgggg

SEQ ID NO: 55104 - protein, 96 aa, Zea mays
  misc_feature: Ceres CLONE 1484634
MAQRDKKVEEPTELRAPELTLCANSCGFPGNPATNNLCQACFLAATASSSASASVSPPPPSSSSSSPAVLHFDEQEQRQNPRSRAPEASPPHGGTA

SEQ ID NO: 55105 - DNA, 621 bp, Zea mays
  misc_feature: Ceres CLONE 1484638
  misc_feature: Encodes the peptide sequence at SEQ ID NO. 55106
  misc_feature (307)..(307): n is a, c, t, g, unknown, or other
  misc_feature (325)..(325): n is a, c, t, g, unknown, or other
  misc_feature (341)..(341): n is a, c, t, g, unknown, or other
  misc_feature (368)..(368): n is a, c, t, g, unknown, or other
  misc_feature (393)..(393): n is a, c, t, g, unknown, or other
cgattgggtaccgggccccccctcgagccctgcagtggtaaaggagaaattctcctcctcctcacctcctcccactccctcttctgcagtctgcaccacaccaccgttccagcgagcggaagcggagtcctggtcgacttctccggccagctcgaggcgccctcgccgcttcactcgaccgcccccccctcccccaccgcttctgctatgccgccggcgccagccgccgtcgcgccggagccgcagaagctttcgctgacgccgacgccgccgacgcagcagtgcccgcggccgcgctcgccgctcngcaacggtttggccgccngcgacttcgagctgcngcactggcgcacgcccaagaagcgcgncgcgccgcagtgggcgccaccgccngtgatccagatacccacggcggcgccggcagcgacggcgacgaaccgcacaacagcggcgggcggcggggggcacggggtacccaagccctcggggaattcctgtgcttcccccgaaataacccccggggggggcgggtccgcccggggccctggcggcgggcggcgggttgccccaacttgcggggaaaatatcaacttgaacccggccccccgcctcggaaaaacc

SEQ ID NO: 55106 - protein, 138 aa, Zea mays
  misc_feature: Ceres CLONE 1484638
  misc_feature (34)..(34): Xaa is any aa, unknown, or other
  misc_feature (40)..(40): Xaa is any aa, unknown, or other
  misc_feature (45)..(45): Xaa is any aa, unknown, or other
  misc_feature (54)..(54): Xaa is any aa, unknown, or other
MPPAPAAVAPEPQKLSLTPTPPTQQCPRPRSPLXNGLAAXDFELXHWRTPKKRXAPQWAPPPVIQIPTAAPAATATNRTTAAGGGGHGVPKPSGNSCASPEITPGGGGSARGPGGGRRVAPTCGENINLNPAPRLGKT

SEQ ID NO: 55107 - DNA, 651 bp, Zea mays
  misc_feature: Ceres CLONE 1484639
  misc_feature: Translation starting site: 236
  misc_feature (483)..(483): n is a, c, t, g, unknown, or other
  misc_feature (504)..(504): n is a, c, t, g, unknown, or other
  misc_feature (518)..(518): n is a, c, t, g, unknown, or other
  misc_feature (526)..(526): n is a, c, t, g, unknown, or other
  misc_feature (563)..(563): n is a, c, t, g, unknown, or other
  misc_feature (580)..(580): n is a, c, t, g, unknown, or other
cgattgggtaccgggccccccctcgagccctgcagtggtaaaggaggcggcaccctgttcgtgtacaagcacccagacctgcgtgtgagggtggtgcacggcaacacgctgacggcggccgtgatccttaacgagatccccagcaacgtgagagaggtgttcctgaccggcgccacctccaagctcggcagggccatcgcgctctacctctgcaggaagaagatccagagtcctgatgttcacggtgtcgtcggagaggttcgtgaagatccagagggaggcgccgccggagtaccagcagtacctcgtgcaggtgaccaagtaccaggccgcacagaactgcaagacttggatcgtgggcaagtggctgtcgccgcgtgagcagcggtgggcgccgtccgggacgcacttccaccagttcgtggtgccgcccatcatcggcttccggcgggactgcacctacggcaagctggccgccatgangctgcccaaggacgtgcaggncctcagctcctgcnagtacacnatggaccgcggggtggtgcacgcgtgccacgccgggnggcgtggtgcacttccntggaaggctggggccaccacgaaggtggcgccatcgacgtcgaccggatcgacgtcctctggaaagcggcc

SEQ ID NO: 55108 - DNA, 658 bp, Zea mays
  misc_feature: Ceres CLONE 1484643
  misc_feature (529)..(529): n is a, c, t, g, unknown, or other
cgattgggtaccgggccccccctcgagccctgcagtggtaaaggggtggcccaattctcacgcgctcgccgcctaggagcattcacgttggcggcgggcggcggctcggttcctctcctccaccgcacctccaagaatccacctccacgactgagctgacggctcggtagcgccatggcagttcaccggctccaaccttccccatccggcctacagtgctccaccgcccggtcgccagtgctcctccatgggccacggctgacgggtgcacgcaccggttatttttccagcacttgacattcgagtgaaaaatgtcgcagggacatattctcttgaacataaaggagaaaatgatctcttcgcacatcagacaaggcttctactctttcagaagaaagtcatttttaggagaatcgtgaacaaaatgaccagatgtttaggcctggttggaaggacatttttcgaatgaatcagagtgagctcgaggctgagatttgaaaaggtctctcgagattctactcttgatccnaggaggaaggcctatctgatccaaaatctcatgaccagccgttggatagttgctcagcaataatcaccacaaccaagcgtcgaaggacataatggatgtacacgatgacctggatgtgttctttcgtac

SEQ ID NO: 55109 - DNA, 667 bp, Zea mays
  misc_feature: Ceres CLONE 1484645
  misc_feature: Translation starting site: 185
  misc_feature (380)..(380): n is a, c, t, g, unknown, or other
cgattgggtaccgggccccccctcgagccactgcagtggtaaagggagtgtgatagaatccaaagacgcaagcggctgcaggcagcagcgccgcgcaggcattgtggcctgtgggagaggaaaagagaaagaggaaccggccaagacaagcaagcgagaggccagggccgcggcgttgcgtcagatggggaagtacatgcgcaagtgcaggggcgccgcaggcgcggaggtcgccgcccgtcgagttacgcaggtcgtcggcgtccggacgaggtcccaggtccgcggcggcgaccggcggtgtcgccgaggtcgccccgaaagagaagagggcgccggcgggggagcctgctgccgccttgagcgctggtggggacggnggaaactgctacatccacctgcgtagccgcatgctgttcatggcacggcctcacccgcagccgtcggttgactcgttcccccccccggtggaggctgctgatggccctccaagacaccaaggccgcggccctcgcggccggcctctcccgtttcccccaccagggggccctccgggaaacttgggctttggggggtccaccccgggaccccacaccttgccgcctccctaaaacccttgaaaagggttggggggggaatcccctccctgggggggaatccctccgcc

SEQ ID NO: 55110 - DNA, 672 bp, Zea mays
  misc_feature: Ceres CLONE 1484646
  misc_feature: Encodes the peptide sequence at SEQ ID NO. 55111
  misc_feature (546)..(546): n is a, c, t, g, unknown, or other
cgattgggtccgggccccccctcgagccctgcagtggtaaaggtgtgtcacctggccaaggcctacgccaacgtgaacgactactgctggcaccagctcatcagccactggctcaacacccacgccgtgatggagccgttcgtgatcgccaccaaccggcagctcagcgtgacgcaccccgtgcacaagctcctcctgccgcactaccgtgacaccatgaacatcaactccaacgcgcgccagatgctcgtcaacgccggcggaatcttctagaccaccgtcttcccgcgccagtacgcgttcgagatgtcctccgtcatctacaaggactggaacttcacagagcacgctctccctgacgacctaatcaagagaggcatggcggttgccgacccgtcgagcccgaacaaggtacggctgctggtggaggactacccgtacgcgtccgacggtctggccatctggcacgccatcgagcagtgggtgacggagtacctcgccgtctactaccccaacgacggcgtgctgcgggcggaactgtacctncacgcctggtggaaagatgttccctgagttccggcccccctacctaaaagacccgccctggtgccccaagatgcagaccgtggaccacctgggcaaaggctgcacccccatcgatttgggatcggg

SEQ ID NO: 55111 - protein, 88 aa, Zea mays
  misc_feature: Ceres CLONE 1484646
  misc_feature: SWISSPROT Homolog: EC 1.13.11.12 Lipoxygenase
MSSVIYKDWNFTEHALPDDLIKRGMAVADPSSPNKVRLLVEDYPYASDGLAIWHAIEQWVTEYLAVYYPNDGVLRAELYLHAWWKDVP

SEQ ID NO: 55112 - DNA, 677 bp, Zea mays
  misc_feature: Ceres CLONE 1484649
  misc_feature: Encodes the peptide sequence at SEQ ID NO. 55113
cgattgggtccgggccccccctcgagccctgcagtggtaaaggcctgttcgagctctccctcggcgtgctcatggagaccatcgcgcggaccaagacctcccgctccgaggcttgcgccgccgacactgacgtgtcgcccgaggcgagcgagttgacgcggatctccgaagagatcatgccgtacctcggcacggccaacctgtgggactacctgccgttcctgcggtggttcgacgtgttcggcgtgaggaacaagctcatcgacgcaaagcgccggaggatggacggtgacggcgacggcgagaagaagagcatgatcgccgtgctgctctctttgcagaagtcggagccggagctgtacacggataccatgatcatggcgctgtgcggggacttgtttggcgccgggacggagaccacatcggtcacgacagaatggggcatgtcgcttcttctgagccccccgggagctctgaagaaggcacaggcaaagatcgacgcggtggtggggcaactcccgccgcctgatcaccgccgacgacgtgcccccgcctcggctacctgcactgcgtcatcaaacgagacccttgcgatgtacccggcccgctcccgctgttgttgcccccacaattcgggcgggggaaatggaagggtccggggggttaccaacctgccc

SEQ ID NO: 55113 - protein, 225 aa, Zea mays
  misc_feature: Ceres CLONE 1484649
  misc_feature: SWISSPROT Homolog: EC 1.14.13.89 Isoflavone 2'-hydroxylase
IGSGPPLEPCSGKGLFELSLGVLMETIARTKTSRSEACAADTDVSPEASELTRISEEIMPYLGTANLWDYLPFLRWFDVFGVRNKLIDAKRRRMDGDGDGEKKSMIAVLLSLQKSEPELYTDTMIMALCGDLFGAGTETTSVTTEWGMSLLLSPPGALKKAQAKIDAVVGQLPPPDHRRRRAPASATCTASSNETLAMYPARSRCCCPHNSGGGNGRVRGVTNLP

SEQ ID NO: 55114 - DNA, 684 bp, Zea mays
  misc_feature: Ceres CLONE 1486019
  misc_feature: Encodes the peptide sequence at SEQ ID NO. 55115
tcgattgggtaccgggccccccctcgagcactgcagtggtaaaggaggccgccaaggcgtacgattccgccgcccgcgagttccgaggcgccaaggccaagacgaacttcccgttcccctcccagtgctccgtcgcctccgttgctgccggtagcgctagtagcaacagcaccgtggattcgagcggtggcggtagcggctgtggcatccaggcgcctatgcaggccatgccgcttcctccggctctcgatctcgacctcttccatcgggcggccgccgtgaacgcagtctccaccggcatgcggtttccgttcaagggctatcctgtcgcctgcccgacgccacagcagtactttttctactagcacgcaccggccgcgggggcgggggcatccggataccggatgctcaaggtcgccccaccgcccgtgactgtggccgcggtggcgcagagcgactccgactcgtcgtctgtggttgatcaatccccttcgcctcccggggtgacggaaaacaaggggggcttcaaactggaatctgaatgggccccccgccggcacaaaattagggagggccgaaactttttggcctaactaattaagaggcttcctttttcccctttgttgccttccccaagaaatggtcacttgggggtctgtttgagtccccgcaatgggctggatt

SEQ ID NO: 55115 - protein, 120 aa, Zea mays
  misc_feature: Ceres CLONE 1486019
DWVPGPPSSTAVVKEAAKAYDSAAREFRGAKAKTNFPFPSQCSVASVAAGSASSNSTVDSSGGGSGCGIQAPMQAMPLPPALDLDLFHRAAAVNAVSTGMRFPFKGYPVACPTPQQYFFY

SEQ ID NO: 55116 - DNA, 492 bp, Zea mays
  misc_feature: Ceres CLONE 1486025
  misc_feature: Encodes the peptide sequence at SEQ ID NO. 55117
actgggggttcgacttcgacgtgaaaagagaccgtctgttccgaggttttgcttccatgtcgacgagaggcggcgaggccgcgaggcaggccacggtgaagatcatcgagacggtgcacgtggaggcggaccggtacagcttcaagtccatcgtccagaggctcacggggagagacgcggtggtcggcggcggcggcgactactcggaaggggcgcccgaccgtggatcatatgaagaggcggcggcgcagcgggctgctgggtttacgagcaagcaagcgagcaggcccttcgctgatcgccactcgtgtaaagacgagagctgttgatgtccatctgtaatttgttttcttttttttggaactttgaatcagcgctccatatagatactagggtgtatttggttcacctttctgaaccaaccaattgtagatttatgaaaacctacatattccactagttcaattcagaatcaaaaaaaaaaaaaaaaaa

SEQ ID NO: 55117 - protein, 90 aa, Zea mays
  misc_feature: Ceres CLONE 1486025
  misc_feature (15)..(45): Pfam Name: VQ Pfam Description: VQ motif
MSTRGGEAARQATVKIIETVHVEADRYSFKSIVQRLTGRDAVVGGGGDYSEGAPDRGSYEEAAAQRAAGFTSKQASRPFADRHSCKDESC

SEQ ID NO: 55118 - DNA, 711 bp, Zea mays
  misc_feature: Ceres CLONE 1486029
  misc_feature: Encodes the peptide sequence at SEQ ID NO. 55119
cgattggggtaccgggccccccctcgagcactgcagtggtaaaggaatcgagcccatccatctccatttccgccgccgccgccgccgagagaccccaaccccacccatccaccaccatgtggcgccgcctccacaccctagcccccgccttgcgcagggctaccgccgccgccgccgccgccggggcccctgcggcgtccgcttcctctgcagcccgcgccgccccgctctcctcggcggccgccgctttccgccgcaccagcccgctcctctcaggggacaagccggcgagtgtggaggacgtcatgcccatcgccacggggctcgagcgggaggagctggaagccgatctggcgccggaacagcagttgatacaggcaccgaagaaacatgcgacgcgcggccccgtaaacaggatgcggataccgggccggacgcatttgggacaacgcatgtgcgggggaattagagaagcgacaaaaggaacgccacacgtcccaggccacgagcaccgtttttggtccaacagtatccgtggatggcagtctgcatatgcgcgccacaaatgcacatacgggtgtctggcgggggggggaagcgggagtggtataaaataccgcgcgcacggaccgaataaaataatatataagcgaagagggggggggggaacgcccaccccataatatggtctagggggagagacggggaggg

SEQ ID NO: 55119 - protein, 188 aa, Zea mays
  misc_feature: Ceres CLONE 1486029
MWRRLHTLAPALRRATAAAAAAGAPAASASSAARAAPLSSAAAAFRRTSPLLSGDKPASVEDVMPIATGLEREELEADLAPEQQLIQAPKKHATRGPVNRMRIPGRTHLGQRMCGGIREATKGTPHVPGHEHRFWSNSIRGWQSAYARHKCTYGCLAGGGSGSGIKYRAHGPNKIIYKRRGGGGTPTP

SEQ ID NO: 55120 - DNA, 662 bp, Zea mays
  misc_feature: Ceres CLONE 1486033
  misc_feature: Encodes the peptide sequence at SEQ ID NO. 55121
cgattgggtaccgggccccccctcgagccctgcagggtaaagggtgctcacacagtcactccgtttagctcaaatccttatcggcgactcggcgtcggaggctcggagcccacgaccacgaccgcttccacgccctcgaccccgaacccccaatcccggacgcgaccgctgaaccctagcatactccggccatctgccgccggccccggcgatcccccgccatggcctcccccgagggcacaacgtgggtcttcgactgtccccttatggacgacctcgcggtcgccgccgacttcgcggcagcccccgcgggaggatttttctgggcagcgccgccgtcgctgcagccacaggcgccagtgcagtctgtcgttgccgcgtcggctcccaacccatgtatggaaatcagtagctctgtggactgtggtcaggaaaaagaacagccaacgaataaacgtccaaggtcagaaagtactacagaatcaagcacaaaagcatccagggagaaaattagaagggacaagctgaacgagagattcttggaattgggtgccattttggagccagggaaaactcctaaaatggacaaaacagctatattgagtgatgctattcgtgtagtaggtgaattgcgtaatgaagcaacaagctcaaggattcaa

SEQ ID NO: 55121 - protein, 147 aa, Zea mays
  misc_feature: Ceres CLONE 1486033
  misc_feature (87)..(138): Pfam Name: HLH Pfam Description: Helix-loop-helix DNA-binding domain
MASPEGTTWVFDCPLMDDLAVAADFAAAPAGGFFWAAPPSLQPQAPVQSVVAASAPNPCMEISSSVDCGQEKEQPTNKRPRSESTTESSTKASREKIRRDKLNERFLELGAILEPGKTPKMDKTAILSDAIRVVGELRNEATSSRIQ

SEQ ID NO: 55122 - DNA, 884 bp, Zea mays
  misc_feature: Ceres CLONE 1486037-R
ggtgcgtaataaattatgaatatggtgtaagctgcatacaacatatttttcttcacttatctaatagattaagggggctgttgcaacttcacgtcaggcagacaaatttctgtagaaatttaaagtgagaaaaaattaaattggtgaaatgtcttgcttcactgtggagacttctgctttatcttcatgagagattgaacagcttctgttatttcccaaaatgccctgcatacctctgttcctaattatttttgcacgcatatctttttcagctggggagttctctgagtcaggcagctgaacttttgcagaaacttggctgctccagatggatgtggagccaggactcgtattgaagcctctgcttgatggacggctgaaacttgtgttgggcctttacattattgaaatctcatgcctctttacaagtagaatctgtatctttttaattctcccggttgcccgggatttctcttacttcctttttccttggagcgggaaccattgtaaacttttcaacattttgccagaaagccgggagcctccttcataagtaagaaaaaatccttgggtttctccctccctggtttccccccaaaaatgtggggcctttgaaccactttaaaccttgttttctaaccacagagcctgggaaaatttttgcgcgaacatattaaattcggaagaaactctttctggccccttttttaaaaggggccttggtggcgcccccttcagggctttacggaggtaaccctacggggcatatcccctgattgtaattctttctaaacccaacttttcttccttcccaaagagaaccttcccttttgtcaaacctctatcccttatggccttttcagggttgggagccccccctcttt

SEQ ID NO: 55123 - DNA, 667 bp, Zea mays
  misc_feature: Ceres CLONE 1486044
  misc_feature: Encodes the peptide sequence at SEQ ID NO. 55124
cgattgggtaccgggccccccctcgagccactgcagtggtaaagggatcccctcccaccggtgaggccgcctcctcacgacaacgagccagcgactcctctcttcgtctcctacgagtagccagacaccactccgactttgccggcaacccgtcgacagcgacgaggcgccgcataaggcatacaggcacgggagccatggctaccagctccaaacccgcagcgcccgtgaaccccatggtcgagctcgcccaccaattccccgaggcgtcattctactacgactagacggatgtacctcttatacccgctcggggttggtgcctgtcgcaacgaccccgacgacgagaaggagcttcacttcgagtaccgcagggatgggcagccacacattaagacacttcctacttttgtttctttatggcccaacaataacggccatggacttggatatgttgatgtgcctggacttagactttgatggcagccttctactgcatggacaacagtacgtacagatcaagaggccgagccctgcatatgccagtgttgcagacagcgtcaaagtagctcggcccgcctcaccaggcgaaagcaactattcttgaggtcgaaactaccacaagcctcacagagactagcgaaattgtatgcatgaagctgtacac

SEQ ID NO: 55124 - protein, 62 aa, Zea mays
  misc_feature: Ceres CLONE 1486044
MYLLYPLGVGACRNDPDDEKELHFEYRRDGQPHIKTLPTFVSLWPNNNGHGLGYVDVPGLRL

SEQ ID NO: 55125 - DNA, 697 bp, Zea mays
  misc_feature: Ceres CLONE 1486046
cgattgggtactgggccccccctcgagctctgcagagcctaacggtgttgtgtgatgtcctacttcccggcccctagtctcttagacctatggcggcttgtgagctgccccccttccctgatttacgctctgccatggtggaccgactgccccgatcctggacgtcctctgccatgagattccgcgctgctgtgccagatgtgacaggacatctctctggtttagtctgctagaattcaaacacgacctgatgaccacaactaaccttgtcttacagataatttagcctgttctctgcacgagaagaaattttcggcctcagcttgtactaataagtatgctggatagtcccccagcacgggagttaattgtatcaagagaagtggacaccaatggcagagtagaactacagtagatatctttgtatatggaggctacatgtgaacaataaaggagacgaggaagactgtacatctgtagaatctaaggagaaacaatcagagtacttggtggaacacatatatcttccatgataaaagttacatttcttgtttggtgctcatgcatgggttccatatggttcttccccgtcttattaaaaccatatgtattgggacttaccatgccataaaaaagccgtcgttttccataaacctatttggggcactattatgggcacccaaatgaagacctcttt

SEQ ID NO: 55126 - DNA, 677 bp, Zea mays
  misc_feature: Ceres CLONE 1486056
  misc_feature: Encodes the peptide sequence at SEQ ID NO. 55127
cgattgggtaccgggccccccctcgagccactgcagtggtaaaggacgactaggagccggagataccgcgggcggggtacgtgcaacgatacaactgatctcccagatcatgtatcgcggcgggcgagcattgacagccgagctgcaggggcccggagcgtacaccggagtgagggagacgtcacttgccatgacccggcatctatccgccgcctaaaccgcactcgtcgtcttcactcccagcgttccgagacagtcagcagagcagctaccgcgccgcggcgccgtccgtcccgtcgtgcctacgccacccgacagaaggagacgtatacgccgatgccgctttacagacgtcatcgctctgctcctgccaccagttctactgctactcctgctgcacgggactgaacatcaccggatgaggcgcaacgcatggagatccaggcgcacaactccacgtgctgcttcttcacccactgagtgctcgccctcgaccatcgagagtctgagccacgagaacctggtgcttgcctgctccatgctctccgaccaggcgtgggactccgagcttctgtgcaagtactccatcgcagcgctccaggtgcctgactgcgagaaaagtctgaaatcgtaccggctccgccatgcaacccgtgatagacaacgtatgctatccg

SEQ ID NO: 55127 - protein, 86 aa, Zea mays
  misc_feature: Ceres CLONE 1486056
  misc_feature: SWISSPROT Homolog: EC 2.4.1.215 Cis-zeatin O-beta-D-glucosyltransferase
MRRNAWRSRRTTPRAASSPTECSPSTIESLSHENLVLACSMLSDQAWDSELLCKYSIAALQVPDCEKSLKSYRLRHATRDRQRMLS

SEQ ID NO: 55128 - DNA, 673 bp, Zea mays
  misc_feature: Ceres CLONE 1486066
  misc_feature: Encodes the peptide sequence at SEQ ID NO. 55129
  misc_feature (414)..(414): n is a, c, t, g, unknown, or other
  misc_feature (419)..(419): n is a, c, t, g, unknown, or other
catagctggagctccccgcggtggcggccgctctagaactagtggatcccccgggctgcaggaattcgcacgagaccattacctagaacatcctaatcgaaaaacgaggcgcatccgtccatgggggccaaggcggcacaccggcgtggggtgctggacctggaggcgcagttcgccttcttccggtcgcagcaccggcaccccgtgaacgcggcggcgcacgtgctgctcacctggcccatcctcttcaccaacctcttgatcctccacttcctgccgctgccgctgcccgtctcccccgcgctggccctcgcgctcgcatacgccgccgcctacctcgctgtcgaccgcagagccggcgcagtcgcggggctgctcttcctcgccgcatgggccgccagccgcgccctcgcngcccngctcggcttcgctctctcctggaagctgtcctcgtcaccaagcttctctggttgaactgggaagtccctcggccagggcctcttcaaaaaaaaggcgccaatgtgtagggaccttccggaagggttcctgatagaaaccgttccccattttccctggaaaaaccggaaaaaattgttgggtttaaaaccctatcctggggtttccccaaaaaagcgggaacggagaaattaaaaacccttttcccggggggggg

SEQ ID NO: 55129 - protein, 117 aa, Zea mays
  misc_feature: Ceres CLONE 1486066
  misc_feature (11)..(115): Pfam Name: DUF962 Pfam Description: Protein of unknown function (DUF962)
  misc_feature (100)..(100): Xaa is any aa, unknown, or other
MGAKAAHRRGVLDLEAQFAFFRSQHRHPVNAAAHVLLTWPILFTNLLILHFLPLPLPVSPALALALAYAAAYLAVDRRAGAVAGLLFLAAWAASRALAAXLGFALSWKLSSSPSFSG

SEQ ID NO: 55130 - DNA, 631 bp, Zea mays
  misc_feature: Ceres CLONE 1486073
  misc_feature: Encodes the peptide sequence at SEQ ID NO. 55131
aaagctggagctccccgcggtggcggccgctctagaactagtggatcccccgggctgcaggaattcgcacgagaccattacctagaacatcctaatcgaaaaacaccaggcacgccagcctcactcactccccagaccacctcacacgcacgaagcagcagcagtggactggactagctctaggtgggcaacatgaagcttcaggccaccgccagagttgctggcctcctcttcttcctcgtcctcctcctggcgctgccttccctccgcgtctccatggctggatcagggttctgcgacggcaagtgcgcggtgaggtgctccaaggcgagccggcacgacgactgcctcaagtactgcgggatctgctgcgccacctgcaactgcgtgccgtccgggacagcgggcaacaaggacgagtgcccatgctaccgcgacatgaccaccggacacggcaaccgcaccaggcccaagtgcccctgatgatattcattccttcgctctgtcttgcatgcgtatatgtaatgttgtataggctgtgcaatgcatgcatacatgatacatgccgtgactctggatcggcggatgcctatgcatgcttttcactagctgctgctactactactactct

SEQ ID NO: 55131 - protein, 96 aa, Zea mays; identical to SEQ ID NO: 46259
  misc_feature: Ceres CLONE 1486073
  misc_feature (6)..(96): Pfam Name: GASA Pfam Description: Gibberellin regulated protein

SEQ ID NO: 55132 - DNA, 641 bp, Zea mays
  misc_feature: Ceres CLONE 1486074
  misc_feature: Encodes the peptide sequence at SEQ ID NO. 55133
gatagctggagctccccgcggtggcggccgctctagaactagtggatcccccgggctgcaggaattcgcacgagaccattacctagaacatcctaatcgaaaaaccatccgccgccgcagccatccgcttgttctcttcggttcagttctcgagtttccaggatgaaggtaatagctgcctatctgcttgctgttctgggtggaaacacttccccgactgctgatgatgttaagagcattctggaatcagttggtgctgaagctgatgaagaaaaactagagttcctgctcacagaactcaaagacaaggacataacagaagtgattgcagctggaagggaaaggttatcctctgtgccttcaggtggtggtgcaattgacatgggagctccagcagctgtagctggcggtggcgcagcacctgctgaagaggcaaagaaggaagaaaagggtgaagagaacgaagagtctgatgaagatatgggtttcagctttgtcgattaaacagcactaccagtttacagtttcttcgcgaatggtctcataatattggccagtttccacaaaataagatggcaatagctactacgtacttatgctattctgcatgtgatgtacaagtgtgcatcctcaaaaatctt

SEQ ID NO: 55133 - protein, 113 aa, Zea mays
  misc_feature: Ceres CLONE 1486074
  misc_feature (17)..(111): Pfam Name: Ribosomal_60s Pfam Description: 60s Acidic ribosomal protein
MKVIAAYLLAVLGGNTSPTADDVKSILESVGAEADEEKLEFLLTELKDKDITEVIAAGRERLSSVPSGGGAIDMGAPAAVAGGGAAPAEEAKKEEKGEENEESDEDMGFSFVD

SEQ ID NO: 55134 - DNA, 631 bp, Zea mays
  misc_feature: Ceres CLONE 1486075
  misc_feature: Encodes the peptide sequence at SEQ ID NO. 55135
atagctggagctccccgcggtggcggccgctctagaactagtggatcccccgggctgcaggaattcgcacgagaccattacctagaacatcctaatcgaaaaatttttttttttttcgcacgaatcgtccccgtccagagcgcgagcaaccaacgccgccccgctgtctccgccggtccgcccccgtccctcccctcccccgaatcgcgtcgtcccgtctcctgctgccgcggaaccctcgccatggcggaggcgcccgagaccgccgcccccacccagccgcctcccgcgccggcggcttcgtccccgcctcccaagtcggggatcccgccgcggtacgacctggacgccaagtgggacgcgtgcctcgacctctccatccgccgcgtcgcctactcctccctcggcggcgccttcgcgggcctcctcctcttccgtagccctactactcgctgggcatcagttgcccttggagctggtgtggggataggggctgcatacactgaatgctcatacttattcaatggtgctccaaagtgttcacccaaagtatcaactattccctctgcacactctgatgggggagataagtaaacccttgctgttggattggtccatctcggtggagttt

SEQ ID NO: 55135 - protein, 116 aa, Zea mays
  misc_feature: Ceres CLONE 1486075
  misc_feature (19)..(94): Pfam Name: DUF543 Pfam Description: Domain of unknown function (DUF543)
MAEAPETAAPTQPPPAPAASSPPPKSGIPPRYDLDAKWDACLDLSIRRVAYSSLGGAFAGLLLFRSPTTRWASVALGAGVGIGAAYTECSYLFNGAPKCSPKVSTIPSAHSDGGDK

SEQ ID NO: 55136 - DNA, 680 bp, Zea mays
  misc_feature: Ceres CLONE 1486098
  misc_feature: Encodes the peptide sequence at SEQ ID NO. 55137
atagctggagctccccgcggtggcggccgctctagaactagtggatcccccgggctgcaggaattcgcacgagaccattacctagaacatcctaatcgaaaagcggatatatcggtcactgacgattgacaaatccgtagtcggagctcatgacgggtacaggatggtgttcggtccggtggagatcggcccgcctggctccgtgcatagacctcctactgcagccgcatcgtccgttcctctccctcctcggcaggcaacttgcgcctgtcactttggaccctgcgcatgacgcattgtcttatgagtgtgcggtagacatcgaggacctcatacaactctgtgatgtcgtgtctgatcattcgcttgctcctactggagggcttgtgtattgcatggattacttggtcacgacccccctttgcttgaaaaaaactgaggccttttattgaagatcactgtctgtcatttgatttccctggtcctgcggaattgttcttccttcaatcaatagccacgaagtgttatctatcaactctatctgaaacatgggactctgaggcttactcgctggctcccctttatttgatcccccgcgttgatgtctcatgaatccccccaacacctgtcgtcccagcggctattgtgtttaccttttcatcacccatgccaatgtccca

SEQ ID NO: 55137 - protein, 100 aa, Zea mays
  misc_feature: Ceres CLONE 1486098
MTGTGWCSVRWRSARLAPCIDLLLQPHRPFLSLLGRQLAPVTLDPAHDALSYECAVDIEDLIQLCDVVSDHSLAPTGGLVYCMDYLVTTPLCLKKTEAFY

SEQ ID NO: 55138 - DNA, 634 bp, Zea mays
  misc_feature: Ceres CLONE 1486099
  misc_feature: Encodes the peptide sequence at SEQ ID NO. 55139
catagctggagctccccgcggtggcggccgctctagaactagtggatcccccgggctgcaggaattcgcacgagaccattacctagaacatcctaatcgaaaaatcacactcgatcgcagtttgcagaaagctagaagacacaagaacatggcgtccaagcgactcctcgtgctagtagctctcctgctcgccgccgttttccttgccgtctcaggagcagctaacgacgaccaagcccaaccgaggaaggacgacggcggcgagaacaaagccgacgtgcaggactaccgtggcggcggcggcggctggcgcggtgggggtggctaccccggccgtggctacccgggcgggggcggctaccctggcggcggccgcggcggttactgcaggtgggggtgctgcaaccgcgggtactatggcggctgccggtgctgctcgcgcgccgacgaggtcccggagcccatgtaccgcccggagcccaccgaggtccacaactgaagccgagccacacatcgatctacaaagatgcatggacgacgactcttatcttagctaattaataagcactacatccatgcatgtccacaatagggccctagccctactatactatacgtcgtcagcagaaagtct

SEQ ID NO: 55139 - protein, 116 aa, Zea mays; identical to SEQ ID NO: 40624
  misc_feature: Ceres CLONE 1486099
  misc_feature (1)..(93): Pfam Name: GRP Pfam Description: Glycine rich protein family

SEQ ID NO: 55140 - DNA, 658 bp, Zea mays
  misc_feature: Ceres CLONE 1486104
  misc_feature: Encodes the peptide sequence at SEQ ID NO. 55141
aagctggagctccccgcggtggcggccgctctagaactagtggatcccccgggctgcaggaattcgcacgagaccattacctagaacatcctaatcgaaaaaagagctttgctgcagcacgacggctttgtcctctctcctttaaagcggactgctctcctcaattgtcaggcagtagcatccatttgattgttctatcctcttctctgttctcacccccttgcaagcaacaatcgttcaccgatcgatccagtgcgtcctgcatggaaactgccgccgtcgccgcctccagtgccgggcgccgcatcatggtggccgtggacgagggcgaggagagcctgcacgcgctcaactggtgcctcgccaacgtcgtctccccggcaggaggcgacacgctggtgctcgtccacgcccgccgcccgcgcccggtctacgccgccatggacagcgcagggtacatgatgacctcggacgtgctgccaagcgttgagaggcacgccaacccggtcttcggcggccgggggtcaacaaggccaagcgggtctgcgcccaaccacccgcaacgtcaaggtggaaaacaacgggggaaaaggggggaaccccggggaacttatttttgcgaacgcacccaaaaaaaagggcccccgaaccttgctct

SEQ ID NO: 55141 - protein, 131 aa, Zea mays
  misc_feature: Ceres CLONE 1486104
METAAVAASSAGRRIMVAVDEGEESLHALNWCLANVVSPAGGDTLVLVHARRPRPVYAAMDSAGYMMTSDVLPSVERHANPVFGGRGSTRPSGSAPNHPQRQGGKQRGKRGEPRGTYFCERTQKKGPPNLA

SEQ ID NO: 55142 - DNA, 639 bp, Zea mays
  misc_feature: Ceres CLONE 1486107
  misc_feature: Encodes the peptide sequence at SEQ ID NO. 55143
ctggagctccccgcggtggcggccgctctagaactagtggatcccccgggctgcaggaattcgcacgagaccattacctagaacatcctaatcgaaaaaaaaccctaattcgaacaaccgcgccgccgtcaccgactcaccgtcgtctctcgctcactcgctcgttctctccatccagatcggagcgctcggttcggataggggcgtctcggaggtgaaggcgggcgcgtcagccatggcggacgaggagcacccggagaggagggaggaggcctccgagcttgccccctttgatccaacccagaagaagaagaagaagaagaaggttgtcatccaagagccttctgatgaagtggacaagcttgcagagaagacagaatcactagcagtcgcagaacctgctgaacttaacttcactggaatgaagaagaaaaagaagaagcaggtggatcttgattcatctattgatgaccttggagatagggaggacactcaaggtgatcaagttgtagaggaacaaggggacggtattgtgcttggagctggccctacatatccttgggaaggaactgaccgggattataaatacgaagagctgctggacagggtgttcaacattcttcgtgagaacaacccaga

SEQ ID NO: 55143 - protein, 134 aa, Zea mays
  misc_feature: Ceres CLONE 1486107
MADEEHPERREEASELAPFDPTQKKKKKKKVVIQEPSDEVDKLAEKTESLAVAEPAELNFTGMKKKKKKQVDLDSSIDDLGDREDTQGDQVVEEQGDGIVLGAGPTYPWEGTDRDYKYEELLDRVFNILRENNP

SEQ ID NO: 55144 - DNA, 654 bp, Zea mays
  misc_feature: Ceres CLONE 1486121
  misc_feature: Encodes the peptide sequence at SEQ ID NO. 55145
  misc_feature (284)..(284): n is a, c, t, g, unknown, or other
  misc_feature (337)..(337): n is a, c, t, g, unknown, or other
  misc_feature (398)..(398): n is a, c, t, g, unknown, or other
  misc_feature (402)..(402): n is a, c, t, g, unknown, or other
  misc_feature (410)..(410): n is a, c, t, g, unknown, or other
  misc_feature (412)..(412): n is a, c, t, g, unknown, or other
  misc_feature (418)..(418): n is a, c, t, g, unknown, or other
aaagctggagctccccgcggtggcggccgctctagaactagtggatcccccgggctgcaggaattcgcacgagaccattacctagaacatcctaatcgaaaagatcgattcgtctccgatctcctccttcgaccgccgccaccttcgtctccgagactccgacgatgtcctccgccgccgatgaggatgcgttgtcgtctgacaaggggaagaagagggaggaggacggcactgacgggaggagccaacgtcaggagggtgtcgaggtggccgacgggaaagtngatctaggagacctgtacggcgcggcggcggggtgggtagaggcgcggaccanctgcccgcacatcggcaccatgcttccccctcccgctgaggggggggggggcgtgccttcncccnactctccntnctccanatgtaatcaccctgctgaaaactggttatgcttcggatgcaaagatgtgcttttcaacccgttttattcaccaacatatggtggggccctcatcaagaaaacgggccccggcctggctttgaagcttccagcgacctgtcagtttggggggttccccctgtggatccaaccccaaatggtccaggccattttagaattggccccccggggattgagctttccccctttgtttacag

SEQ ID NO: 55145 - protein, 163 aa, Zea mays
  misc_feature: Ceres CLONE 1486121
  misc_feature (58)..(58): Xaa is any aa, unknown, or other
  misc_feature (80)..(80): Xaa is any aa, unknown, or other
  misc_feature (83)..(83): Xaa is any aa, unknown, or other
  misc_feature (85)..(85): Xaa is any aa, unknown, or other
MSSAADEDALSSDKGKKREEDGTDGRSQRQEGVEVADGKVDLGDLYGAAAGWVEARTXCPHIGTMLPPPAEGGGGVPSPXSPXSXCNHPAENWLCFGCKDVLFNPFYSPTYGGALIKKTGPGLALKLPATCQFGGFPLWIQPQMVQAILELAPRGLSFPPLFT

SEQ ID NO: 55146 - DNA, 637 bp, Zea mays
  misc_feature: Ceres CLONE 1486139
  misc_feature: Encodes the peptide sequence at SEQ ID NO. 55147
  misc_feature (239)..(239): n is a, c, t, g, unknown, or other
  misc_feature (248)..(248): n is a, c, t, g, unknown, or other
caaagctggagctccccgcggtggcggccgctctagaactagtggatcccccgggctgcaggaattcgcacgagaccattacctagaacatcctaatcgaaaactaacccctccttcgtttgcccatcctcgtgacggctcctcgccagtcgcctcgtctctccctgccgcgtcgcctccagttccgcctccgccgcgcctcccgcctccgccgcgcctgacgaacgcagtataggacntgtgcaggntagagaggaggagggtccggcgagatggggatgcgagataagaagcggaaccagaagcgagtgctcgcgcgccgtaccgcggcaccgcgcccaggcgagggcaaggatttcctgccgctggaaggaggccccggtaagaagcatctgaaggtgcagcagcctgaagagcccgaaacacagccacaatcgtctacatgtgggcatatcccccatggtttctacgaggaacgagatgaaagggttccttaagcagtttggggatattaagaaggctttaggatcccctcgtaacccgcaaggacaggaaagtcccaagcactatgggatttcattagtttggagaaccctgctgtggggcaaaggtcgtaacaaatgagatgattacccgt

SEQ ID NO: 55147 - protein, 74 aa, Zea mays
  misc_feature: Ceres CLONE 1486139
MGMRDKKRNQKRVLARRTAAPRPGEGKDFLPLEGGPGKKHLKVQQPEEPETQPQSSTCGHIPHGFYEERDERVP

SEQ ID NO: 55148 - DNA, 621 bp, Zea mays
  misc_feature: Ceres CLONE 1486140
catagctggagctccccgcggtggcggccgctctagaactagtggatcccccgggctgcaggaattcgcacgagaccattacctagaacatcctaatcgaaaacaagggagcaaaggctggactctggtgacagaagggattcaacaagagtgaaaccaacagatcatgatgggagcaatgggggatcgggaaggtctttcaggcatggtcgttcaatgtctctagaagagcacaggcatcggggcaggcatgaatctcatccatcatcgagagtgtccagaagtgcagcacatatcgaggatattaactcgagaggaggtgaagcatcccggaatggagatcctgatgctttggcaacaatgaacgcaactgcagaagctcgtgaagcaaaagaaagcaaaagccatcgtttgaattgtctggaaagcttgctgaggagaccaacagagttgcaggtgtaaatctattatattcagaacccccagaggctcaaaagtcagagattagatgggagctccatgtattttaaaatggtgaaccacctgaatgaaccactgtatggttcatcggataacctgctcccttttttggaagaaaaaggaaaagtcgccaaactgccc

SEQ ID NO: 55149 - DNA, 481 bp, Zea mays
  misc_feature: Ceres CLONE 1486145
  misc_feature (159)..(159): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
atagctggagctccccgcggtggcggccgctctagaactagtggatcccccgggctgcaggaatcgcacgagaccattacctagaacatcctaatcgaaaaagcgttcagagtttggaaaattcagacttgagctagaaccagaggaacaccaaacacngcacgcgcccaccccccccgaaaacgggnnnaaaaactgacccgcaaaaaaaaaggcgggaaaaaaaacccgggggggaaaaaaacccccttaaaaggcccggggggcctaaaggccaaaggggggggggggggccctaaacaaaaaaggggggaaaaaccccccggggggcccccgcaaaagggccccccctttttttttaaaatttttaaaaaacccccggggggggggggtttttcccggggggcaaaaattccccccccgcggaatataggggagcccccccccccccctaaataagggcttttccaaaaaacaaaca

SEQ ID NO: 55150 - DNA, 665 bp, Zea mays
  misc_feature: Ceres CLONE 1486152
  misc_feature: Pfam Name: HGTP_anticodon Pfam Description: Anticodon binding domain
  misc_feature: SWISSPROT Homolog: EC 6.1.1.3 Threonine--tRNA ligase
  misc_feature (629)..(629): n is a, c, t, g, unknown, or other
ctggagctccccgcggtggcggccgctctagaactagtggatcccccgggctgcaggaattcgcacgagaccattacctagaacatcctaatcgaaaactacgagaccagagaagtatctaggtgaaattgaaacttggaacaaagcagaacaacaattgacagaagctttgaatgagtttgggaagccgtggaagattaatgaaggggatggtgctttctacggtccaaaaattgatattggtgtgtttgatgcccttaagaggaaatttcaatgtgcaaccttacagctggattttcagctgcccattcggttcaagctgacttattctgctgaggatgaagcaaaaattgaaaggcctgtgatgatacacagggcaatcctaggttctgttgaaaggatgtttgccattcttttggagcattacaatggcaaatggcccttatggctaagccctcgccaggccattgtttgttcagtatcttctggttcagtggaatatgcgaaacaggttcttgccatgctacatgaagctgatttccatgttgatattgatgtgagtgacaggacaatacaaaagaaggtacgggaagcccaggtagctcaattcaactacattcttgtcgtangcgcacaggaggccgagactggaaatgtctgcgtta

SEQ ID NO: 55151 - DNA, 683 bp, Zea mays
  misc_feature: Ceres CLONE 1486154
  misc_feature: Translation starting site: 149
  misc_feature (683)..(683): n is a, c, t, g, unknown, or other
acagctggagctccccgcggtggcggccgctctagaactagtggatcccccgggctgcaggaattcgcacgagaccattacctagaacatcctaatcgaaaaaagcaccgaagatggcttgacgcccgaatccagaccctcgtctgttatggcggcggcggaggcggcgccaccgccgatactcgagctggacccgtcgcacgatcgagccgtcagcgttgtcgaggacatcgtgcgtctagagcggaggatctttccgaagcacgaatcgctggcgcggtccctgcacgacgagctaaagcggcggaactccgggctgatctacaagacgtccagcgccgacgagggggaggtcatcgggtatgccctgacacctgcgggggggggggggcgccaccatcaccaagctcgccgtgaaggagaactgcaggcggcagggccccggcgaggcgctgctggcgggccccatgaagccgtgcccgcggcggaaggtccagcggttctccctccccgggtaacccccgaaggagggtggccggggggttgtacccggagggccggggttccgggccgacacgaccgggtaggggctacgaggggggcgccgagggggcgtcggcccgggatggtgctgggatgtgggggggggacccgttccagggaggagaggggccggggccttn

SEQ ID NO: 55152 - DNA, 641 bp, Zea mays
  misc_feature: Ceres CLONE 1486160
  misc_feature: Encodes the peptide sequence at SEQ ID NO. 55153
aaactggagctccccgcggtggcggccgctctagaactagtggatcccccgggctgcaggaattcgcacgagaccattacctagaacatcctaatcgaaaattttcggcttctgaatttcggcaaacgttccggagctctgctggcgttgggattattttgcctaccaaacttttccgggtggaggtgaactattgtcgcatcctaaagcaagctgagcatgacagcgcgaagactggaatccagttcagcttttcctcgcccatgtaggaacttgccatggcagccgaagtagctgcactttcctctgtagacttgcattcttcccgttcttttcatgctgaagcaattgaagaggtttacgtgctcccttttcttgtgacgcttgttcattgacacgaggagctgctccttttttttggtgtcttcaggagatgaatttattatttgctgtttttgacctcacgagggatttgtcctcgcacaactcaaataccgatgctgtggctacacaatggtggatagaataatattttggcccataatgttgtataattcataccacatcagctttcgtgtcaaaaaaaaaaaaaaaaaagcttatcgataccgtcgacctcgagggggggcccggtacccaac

SEQ ID NO: 55153 - protein, 88 aa, Zea mays
  misc_feature: Ceres CLONE 1486160
TGAPRGGGRSRTSGSPGLQEFARDHYLEHPNRKFSASEFRQTFRSSAGVGIILPTKLFRVEVNYCRILKQAEHDSAKTGIQFSFSSPM

SEQ ID NO: 55154 - DNA, 640 bp, Zea mays
  misc_feature: Ceres CLONE 1486170
  misc_feature: Encodes the peptide sequence at SEQ ID NO. 55155
atagctggagctccccgcggtggcggccgctctagaactagtggatcccccgggctgcaggaattcgcacgagaccattacctagaacatcctaatcgaaaaaagacattcatgttattacacccggcaagacgaccaaacttcctacgaaggcagaaccgcattctcgcgtcggcttgcttttaactgaatccagcccaccgcttctcgcacgtcgccatggacgcggtcgattctgtggtggatcccctccgcgacttcgccaaggacagcgtccgcctcgtcaagcgctgccacaagcctgaccgcaaggagttcaccaaggtggcagcgcggacggcgatagggttcgtcgtcatgggcttcgtcggcttcttcgtcaagctcatcttcattcccatcaacaacattatcgtcggttccggctaggctcagggcgcgactagcatgggagtagtgcgatacttttgagagcaagggatagcgaggatcttggtctttggaatagtattgttaatgacattttttttccggttgtgtttctggagtaaatcgttgaacgacaaggcttcaggatgtctggatgtggattctgagtagaccttgaatccttgatgaagcagccagtcttggaaagaaa

SEQ ID NO: 55155 - protein, 69 aa, Zea mays
  misc_feature: Ceres CLONE 1486170
  misc_feature (10)..(66): Pfam Name: SecE Pfam Description: SecE/Sec61-gamma subunits of protein translocation complex
MDAVDSVVDPLRDFAKDSVRLVKRCHKPDRKEFTKVAARTAIGFVVMGFVGFFVKLIFIPINNIIVGSG

SEQ ID NO: 55156 - DNA, 636 bp, Zea mays
  misc_feature: Ceres CLONE 1486174
  misc_feature: Encodes the peptide sequence at SEQ ID NO. 55157
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
atagctggagctccccgcggtggcggccgctctagaactagtggatcccccgggctgcaggaattcgcacgagaccattacctagaacatcctaatcgaaaagcgcaattggggccagctgttgggacgacgttgaggacgagggcgatgacgtggtcggcctcctccactctgtggagacaaccaaggcggtcgcggtggcggtcgctagcatgcaaccccactgagtcgagctcatacggcagctcgacgcctcctgtgagacacgccgccacgagccgccttctccacccacatctgcacgcgcaacacaaatctcgtcgtcggcagcttccacaccgccactatggcagccagtaggagggccagcgacagccgcgtcgccgttattcctctgaccctcttgctgatcgagagaggtggctgagagaggtggaccggccgaccggatgagcttgtggctagctggaggaagaggtgaggagatgtatgatctgatggaggggnnnnnnnnggggggggggcccttgccaaccggacagcaagtggcagagtgacgacctttgctgcctgttgtgtcattggcgaagagtggctttagtagctttcctttatttgtttttgaccaggtctata

SEQ ID NO: 55157 - protein, 70 aa, Zea mays
  misc_feature: Ceres CLONE 1486174
MTWSASSTLWRQPRRSRWRSLACNPTESSSYGSSTPPVRHAATSRLLHPHLHAQHKSRRRQLPHRHYGSQ

SEQ ID NO: 55158 - DNA, 654 bp, Zea mays
  misc_feature: Ceres CLONE 1486179
  misc_feature: Encodes the peptide sequence at SEQ ID NO. 55159
  misc_feature (654)..(654): n is a, c, t, g, unknown, or other
aaagctggagctccccgcggtggcggccgctctagaactagtggatcccccgggctgcaggaattcgcacgagaccattacctagaacatcctaatcgaaaaaatttggatgtctgcttccaaccctgtctagctccttcggtccagcttcgactggctggcaggtaggcacacgcgaagcgataaggtcggctaagccgcgatgtcgccgcggccgccgtccctcgtggtgctcccgctcctcctccccctcctcctcgccgctgtatcccacgctacggctaatgcggccggtgccagcgcccctcccccagtgccgacgccgtggccggagcagttccacgcagtggtcttcaccaatctcaccgagagcggcggccggctgcagctgatcgacctgtactacgactggcccaggggccgcaacctcaacctcatccgggaccagctctccagcgacccgctctacgacgtcgagtggaccaacggcacctcctacttcttcgactccgggtcctgccgcaccatgcgtttccccgtggggatcctgcccgctgactggctcgccgccggcgccgtctatctcggccgcgagcacgtcgacggcttcgactgccacctgtggacccaggtcgacttcgtctggtactacan

SEQ ID NO: 55159 - protein, 150 aa, Zea mays
  misc_feature: Ceres CLONE 1486179
MSPRPPSLVVLPLLLPLLLAAVSHATANAAGASAPPPVPTPWPEQFHAVVFTNLTESGGRLQLIDLYYDWPRGRNLNLIRDQLSSDPLYDVEWTNGTSYFFDSGSCRTMRFPVGILPADWLAAGAVYLGREHVDGFDCHLWTQVDFVWYY

SEQ ID NO: 55160 - DNA, 1091 bp, Zea mays
  misc_feature: Ceres CLONE 1486181
  misc_feature: Encodes the peptide sequence at SEQ ID NO. 55161
ggggtgcgaccgaatccaacagaagagccgaagaggaaaggggcggttgctttatattccttctcggctgcaatctgcgtccatctatccagccgtctcggggcgtcgtgtgcgcgtggatctctccgtagaagggatgaagatcacggcgctccttgtgctgaagccgtcgacctccggagccggtagctcctcgtccggcggccagtcgggcccggaggcggtcgtgctcgcgaacgcgacggacgtcagccacttcggctacttccagcgcagcgccgcccgcgagttcatcgtcttcgttgcccgcaccgtcgctcagcgcacccagccaggccagcggcagtccgtccagcacgaagaatataaggttcactcccacaacagaaatgggctttgtgcggtggcatttatggatgatcactatcctgtacgaagtgcattttctcttctgaatcaggttcttgatgagtaccagaaggcttttggggactcctggaaatctgctactgcagatggaactcaacagtgggctttcctgacagacgccttggcaagatttcaggaccctgcggaagctgacaaactaatgaaaattcagagggacttggatgaaacaaaaattattcttcataaaactattgatagtgtcctggccagaggagagagattggatagcttggttgagaaaagttctgatctaagtgctgcttctcagatgttctacaagcaggcaaagaagacaaaccaatgttgcacaatactttaaactttggtgcttcaatcatgtttgcaagaaacaaaaacgatcgatattgtgctaatttactgtaagttaaatcgcccatgaagcgtggacacgcggttgcaaggctcgagctcagtgctgttggtctcagtttgcaaggctatagttttctccaagacctgccgattggactgttttcttgtgagaattcctgctctccaaacagcacatggagtatcattctttagtggttatgaaactgcgtagtgcctgctaacaccatttattgtactatataaggcttgcctcaaactgcagaaattaccaaaaaaaaaaaaaaaaa

SEQ ID NO: 55161 - protein, 210 aa, Zea mays
  misc_feature: Ceres CLONE 1486181
  misc_feature (114)..(200): Pfam Name: Synaptobrevin Pfam Description: Synaptobrevin
MKITALLVLKPSTSGAGSSSSGGQSGPEAVVLANATDVSHFGYFQRSAAREFIVFVARTVAQRTQPGQRQSVQHEEYKVHSHNRNGLCAVAFMDDHYPVRSAFSLLNQVLDEYQKAFGDSWKSATADGTQQWAFLTDALARFQDPAEADKLMKIQRDLDETKIILHKTIDSVLARGERLDSLVEKSSDLSAASQMFYKQAKKTNQCCTIL

SEQ ID NO: 55162 - DNA, 645 bp, Zea mays
  misc_feature: Ceres CLONE 1486190
  misc_feature: Encodes the peptide sequence at SEQ ID NO. 55163
ctggagctccccgcggtggcggccgctctagaactagtggatcccccgggctgcaggaattcgcacgagaccattacctagaacatcctaatcgaaaactgttgggccgaactgggcagcgtggaaaggctacgaagagcggagaggcgctccattgaagcggacggcgacgagctctgcatgctgcgctgcgcccttctcaccgccgccagcccgccagaacgtctcctccccgtctctagagtggctctttctttctccgtcaaatggctctcgcgtgcgcctctcacgcgtgccgctttctcctcgccggccaggcgagatctttccacgcccagccctaccatgccaaggtcggcgtggtggagttcctgaacggcgtcgggaaaggggtggaggcgcacgccgcgaagctggaggaggctgtgggcggcgacctccagaggctccttgaggcccgcacgctgcggctcaagaagctcggcatcccctgcaagcatagaaaattgattttgagttttgcacacaagtaccgtcttggtctctggaagccccaagcagaacccaggaaagtttaaagttggttcgttcttgaaagatagtctactgttggactgaggcatgtttgggacattgaatatttgg

SEQ ID NO: 55163 - protein, 103 aa, Zea mays
  misc_feature: Ceres CLONE 1486190
MALACASHACRFLLAGQARSFHAQPYHAKVGVVEFLNGVGKGVEAHAAKLEEAVGGDLQRLLEARTLRLKKLGIPCKHRKLILSFAHKYRLGLWKPQAEPRKV

SEQ ID NO: 55164 - DNA, 642 bp, Zea mays
  misc_feature: Ceres CLONE 1486198
  misc_feature: Encodes the peptide sequence at SEQ ID NO. 55165
  misc_feature (528)..(528): n is a, c, t, g, unknown, or other
  misc_feature (530)..(530): n is a, c, t, g, unknown, or other
caaagctggagctccccgcggtggcggccgctctagaactagtggatcccccgggctgcaggaattcgcacgagaccattacctagaacatcctaatcgaaaaaatgatctcctatgcacaaacatccacaaaacaaaagaagggaaaaaccacaagctagccatggttagcagcaagattagtattgtcggagccatcacatctccaattgtggttgtggtggcacttacactattgatcacacttttggcaccgacagtagatgcacaaccatactcaacaatgccacctagcatgatcggagatttattgccacggatgagagtacctccgtccgggcctagccatcctccacccatggtggcgatgcaaccatcatggagaatgacatatgctggacctatgaagcctctttccatggcggcgatgtcacctgatgttgttggggatttgctaccacgaggaagagtaccaccctccgggcctagccatccaccaccgttggtggcgatgtcacctgatgttgntnggggatttgctaccacgaggacctagccatccgccaccaggggtggcgatgtcaccctgatgttgttgggggatttgctaccacgaggacctaccctcccgccccaaaggga

SEQ ID NO: 55165 - protein, 130 aa, Zea mays
  misc_feature: Ceres CLONE 1486198
  misc_feature (122)..(122): Xaa is any aa, unknown, or other
  misc_feature (123)..(123): Xaa is any aa, unknown, or other
MVSSKISIVGAITSPIVVVVALTLLITLLAPTVDAQPYSTMPPSMIGDLLPRMRVPPSGPSHPPPMVAMQPSWRMTYAGPMKPLSMAAMSPDVVGDLLPRGRVPPSGPSHPPPLVAMSPDVXXGFATTRT

SEQ ID NO: 55166 - DNA, 658 bp, Zea mays
  misc_feature: Ceres CLONE 1486202
  misc_feature: Encodes the peptide sequence at SEQ ID NO. 55167
  misc_feature (658)..(658): n is a, c, t, g, unknown, or other
ggagctccccgcggtggcggccgctctagtactagtggatcccccgggctgcaggaattcgcacgagaccattacctagaacatcctaatcgaaaaaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgacaaagtgttccgccaatgtgggcaagactatcggggacaaagttggaacaaaccacccaacatccccaggggaagccctggtggcttgatgagattagcgaaacagggcgaattccttctcctcccggaacgaaaccacctgacgccggatgaacctttggggctccagcctggggatggatggtggggaaaagtgtatttcccgtcctattctttcgctcaggggcatttttctcataaattgaccccccttcggaggtccctgggacccagaagtaggaatcgggcn

SEQ ID NO: 55167 - protein, 161 aa, Zea mays
  misc_feature: Ceres CLONE 1486202
  misc_feature: SWISSPROT Homolog: EC 2.7.9.1 Pyruvate, phosphate dikinase
MLGFRGCRLGISYPELTEMQARAIFEAAIAMTNQGVQVFPEIMVPLVGTPQELGHQVTLIRQVADKVFRQCGQDYRGQSWNKPPNIPRGSPGGLMRLAKQGEFLLLPERNHLTPDEPLGLQPGDGWWGKVYFPSYSFAQGHFSHKLTPLRRSLGPRSRNRA

SEQ ID NO: 55168 - DNA, 628 bp, Zea mays
  misc_feature: Ceres CLONE 1486203
  misc_feature: Encodes the peptide sequence at SEQ ID NO. 55169
aaagctggagctccccgcggtggcggccgctctagaactagtggatcccccgggctgcaggaattcgcacgagaccattacctagaacatcctaatcgaaaaattccttcaatcactcaaatccactgtgactccgtgagctccctgcctgctgccctgcacactccccgcccagccgcaccagctcagctcagctcagcagtcatggctcgcccctgccgcagcagcagcagcgccgctgcccgcctcctcctgctgctcgccgccgtcgcagcggcgctccaggccgcggccgccgcgccgccggtggccagcggcttcatccgcaaatcctgccgcgcgacgcagtacccgtcggtgtgcgagcagagcctcgcggcatacggaggctccccgccgccgcggagcccgcgggagctggcgcacgccgcgctggcggtgagcgcggaccgcgctcgggcagcgtccgcgtacgtgggccgcctgtgcggctcccggtccggatccggcgacggcagcccccgccgcggcgccggcgccggcgcgaagaaggggtcggcggccgcgggtcccgtgcgcgactgtctggagaactagcggacagcgtgggccacctccgcgacgcggc

SEQ ID NO: 55169 - protein, 130 aa, Zea mays
  misc_feature: Ceres CLONE 1486203
MARPCRSSSSAAARLLLLLAAVAAALQAAAAAPPVASGFIRKSCRATQYPSVCEQSLAAYGGSPPPRSPRELAHAALAVSADRARAASAYVGRLCGSRSGSGDGSPRRGAGAGAKKGSAAAGPVRDCLEN

SEQ ID NO: 55170 - DNA, 653 bp, Zea mays
  misc_feature: Ceres CLONE 1486209
  misc_feature: Translation starting site: 180
  misc_feature: SWISSPROT Homolog: EC 2.3.1.119 Icosanoyl-CoA synthase
  misc_feature (550)..(550): n is a, c, t, g, unknown, or other
aaagctggagctccccgcggtggcggccgctctagaactagtggatcccccgggctgcaggaattcgcacgagaccattacctagaacatcctaatcgaaaaactctcactctcacgcacacactccacagtgccactcgtctcgctcgctcgcgccagctggtccggcagcagacagcatgggttcgtcggcggcgcttcagccgaagcagctgtaccagctcgtggtgaacaacttcgtcgccgtgctcgctgcgccgctggccgtggcggccgtcgtcaatgcggcgcgcgtcgggccggacgagctgctcggcaggctgcaggcgctccgggcggtgcacgtatttctggccgtgttcgtcgcggccgccacggcgatactgtacgtcctgctgcggccccgggccgtgtacctggtggactacgcctgcttccgcacgcggcccaactgccgcgtccccttcgccaccttcctggagcacgcgaagctggtgacgttcgtggagggggcctccatcgacgagcgcagcgtccggttcatgacgcnggctgctggagcggtccggcctcggcgagaagacctgcctgcccccggcccaccactacatcccgccgtaccggaacatggaggcctcgcgcgcggaggtgga

SEQ ID NO: 55171 - DNA, 665 bp, Zea mays
  misc_feature: Ceres CLONE 1486211
  misc_feature: Encodes the peptide sequence at SEQ ID NO. 55172
  misc_feature (647)..(647): n is a, c, t, g, unknown, or other
aagctggagctccccgcggtggcggccgctctagaactagtggatcccccgggctgcaggaattcgcacgagaccattacctagaacatcctaatcgaaaaacgcaatctcgcagcaaaccgccgggcccctcgcgcgcacacacctcagctccctcgtaccggggctccatgggcaacttcgcatcgtgcacgctggcgaggacggccggggccgggagggccagcggctcgaccgtcgtgctcccggacgggcgggtgcggcaggtggccctcccggccacggcggccgagctgatgctcgacgcgccgggccatttcctggcggacgcgcgggcgctgcggcccgggcggcggatcgaggcgctcgcggcggacgagggcctcgtgcgcggggcgctgtacgccgtgctccccatgaagcgcctgggcgcccccgtggcgcccgccgacgtggcgcgcctggcggccgcggtggtggccagcggggagaagcgcggggccacgaagggggaggacgcggccggtgtcgtcccccgccgccacggccaaggtcgccgccgtcttcgtcgcgccgcccgagacgctcgaggccgcggcccttgagctccaggagacggacgcgtccaagccgagggccccgaggcntggaggagatggccgtcc

SEQ ID NO: 55172 - protein, 144 aa, Zea mays
  misc_feature: Ceres CLONE 1486211
MGNFASCTLARTAGAGRASGSTVVLPDGRVRQVALPATAAELMLDAPGHFLADARALRPGRRIEALAADEGLVRGALYAVLPMKRLGAPVAPADVARLAAAVVASGEKRGATKGEDAAGVVPRRHGQGRRRLRRAARDARGRGP

SEQ ID NO: 55173 - DNA, 771 bp, Zea mays
  misc_feature: Ceres CLONE 1486212
  misc_feature: Encodes the peptide sequence at SEQ ID NO. 55174
  misc_feature (256)..(256): n is a, c, t, g, unknown, or other
  misc_feature (410)..(410): n is a, c, t, g, unknown, or other
  misc_feature (418)..(418): n is a, c, t, g, unknown, or other
aaaactggagctccccgcggtggcggccgctctagaactagtggatcccccgggctgcaggaattcgcacgagaccattacctagaacatcctaatcgaaaaatcacaagctgtcacaaactcagcacacaatcacactgacacacacaccaccaccatggtaccgctagtgagaagcggagcgggaggacacgcggcgcggactgcgatggctcgtgcgctcggcgcttgcgtgctgctcgccgtcctgctcggngccctggcgccggcggcggccgcgcgcgcccaccacgacgaggggggcgggggcccgcatactgttttcctaaccggtgaagaaccccgcggagggaaaggtggggggtttttttttcccccccccccccagaggggaaagaaaagggggcacncccccccnatctctcccccccctttttccttcttcttaaataaaaaacaactcaactctccccccaaactgtgggggggggggggggaaactcccccacactaccgcctttgggcgccgggtggggtgcggcggggggcccagccccggggggaggggggtagtcgcgcgcccaacaaaggcgggcgccgtgcggtcggcggggcgcggcggaatgcgcgggccgggggcgcgggcgcgccggcgggggcgaggatgaggcggcggtgagggcgggccagtgccgcgccgcgccgcggccgggcgcgggccggggggacgtagcggcgcgggtggcaggccgcggggggagggggggcgcg

SEQ ID NO: 55174 - protein, 156 aa, Zea mays
  misc_feature: Ceres CLONE 1486212
  misc_feature (68)..(68): Xaa is any aa, unknown, or other
MARALGACVLLAVLLGALAPAAAARAHHDEGGGGPHTVFLTGEEPRGGKGGGFFFPPPPQRGKKRGHXPPISPPPFSFFLNKKQLNSPPKLWGGGGETPPHYRLWAPGGVRRGAQPRGEGGSRAPNKGGRRAVGGARRNARAGGAGAPAGARMRRR

SEQ ID NO: 55175 - DNA, 551 bp, Zea mays
  misc_feature: Ceres CLONE 1486219
  misc_feature (222)..(222): n is a, c, t, g, unknown, or other
  misc_feature (244)..(244): n is a, c, t, g, unknown, or other
  misc_feature (275)..(275): n is a, c, t, g, unknown, or other
  misc_feature (276)..(276): n is a, c, t, g, unknown, or other
aagctggagctccccgcggtggcggccgctctagaactagtggatcccccgggctgcaggaattcgcacgagaccattacctagaacatcctaatcgaaaaaggacagtaggggctcccttctccagttctccttgcttgcgtcttcccggtcccgtctgcgtgcgtgcgatcgacgcagaggcgcgggcgctcgcaccaagccgatccgatggccttcatngcgctcccgctcaaatgcatcnttctggcatggggagttgctcctaacattannggagacgttttgtcgaagctcaaaatgaagaagacattccgatatggtatctttcaaaatccaaaaaaaagcaaaagccgggtagtttgtggaaaaaaaaggggcccccaccgaaaacgctgggaagatttttggggccccccccccccaaaaaaaaaaccgccaaaaaccccccggagaaaaattttaatttttttcccccccgggggaaaaattttttgaaaaaaaaaaaaaaaaatttttttttttttttttgggggggggcccccccccca

SEQ ID NO: 55176 - DNA, 612 bp, Zea mays
  misc_feature: Ceres CLONE 1486224
  misc_feature (255)..(255): n is a, c, t, g, unknown, or other
  misc_feature (256)..(256): n is a, c, t, g, unknown, or other
  misc_feature (260)..(260): n is a, c, t, g, unknown, or other
  misc_feature (267)..(267): n is a, c, t, g, unknown, or other
  misc_feature (270)..(270): n is a, c, t, g, unknown, or other
aaagctggagctccccgcggtggcggccgctctagaactagtggatcccccgggctgcaggaattcgcacgagaccattacctagaacatcctaatcgaaaaagccgcccgtcctctcggtctccgaccacgactgtgcgccttcctaagtaaccctagctcggcgccctccctccgcgacatccaagcccggcaatctcatcgtcgcgcttgcaccgttacgcagtgcgacctctgcgtcttcgatccaggaanngtanagaggangangaaagtttgtggcaagatttgaccaggcccatgggtccattcgagatgggggagcgtcgccaccggcgtcaggacgcctggtgcggaaaaactggttccatgggcctatctcttggaagaaatggcaaaaaacccaggcccaggaaagaatccttaaaggtgagaaggggaagaccttaaaccagaacacccccaatgatcttccttggtggacccgggggaaattgccccaagcccatataccccaaacactggggaaaaatgggtacttgggtggaaactactccggataataagaagacctgcgtggtttcacaaaaaacaccctctaaaaagaggaat

SEQ ID NO: 55177 - DNA, 674 bp, Zea mays
  misc_feature: Ceres CLONE 1486227
  misc_feature: Encodes the peptide sequence at SEQ ID NO. 55178
  misc_feature (390)..(390): n is a, c, t, g, unknown, or other
aaagctggagctccccgcggtggcggccgctctagaactagtggatcccccgggctgcaggaattcgcacgagaccattacctagaacatcctaatcgaaaaaccgattagtccccacctcagaccctctccgcgcgcgcccagtccggcggccgccctgcccaacgctagggtttaggtggcggctgcagggtcacgccggcgccctccgccctccaccggccgccgacagaaggggtgacgtaggtcacctcgcttttccttggcgagccgtctgtctgttggtgtcggcccgacaaacgccgaggagggagacagcgagatgccgcaccgagcgcgctccgaatggaacgggggctgctgggtgttcatggggcgtcaacctcgcgnctcttcaacacccatcagcccacgtctacgacttcgtcgtgcttccacccctactggtgaacgaagtgagagaacgccgcctgaagggaacttgaagctctgcgggcgaaaggatctctagagacaactaactaaattctcctaaagtcggcatcggagatgatgtctttgattttatcggcgtcatacaacccttgctccttcaggagtgctcaagctcttctttagtaatgtacctgtgagataacgaattatatatgtgtcctgttatgatatgtgtcgcc

SEQ ID NO: 55178 - protein, 62 aa, Zea mays
  misc_feature: Ceres CLONE 1486227
  misc_feature (23)..(23): Xaa is any aa, unknown, or other
MPHRARSEWNGGCWVFMGRQPRXSSTPISPRLRLRRASTPTGERSERTPPEGNLKLCGRKDL

SEQ ID NO: 55179 - DNA, 666 bp, Zea mays
  misc_feature: Ceres CLONE 1486232
  misc_feature: Encodes the peptide sequence at SEQ ID NO. 55180
ctggagctccccgcggtggcggccgctctagaactagtggatcccccgggctgcaggaattcgcacgagaccattacctagaacatcctaatcgaaaaacagctcaaaagcagccaaaacgctagctagctgcagcgatgatgtctcgctcctgctgcctcgccgtgtcggtgcttctcgcggtcgccgcgacagccagcggcgccatcgcgccggcgttgctgcacgaggggcgcctcgaggaggagggcctgctggtcgcggagggcgcgagggtggcgtccacctgggcgggcaacaaggtctcgcgggcgcagccgatggaggcgtggccgagcggcggcgtggccacgcagggcgacgaccagagctcgtcgggcggccgaacaccgccccaggaagtaggggagcagcaagcagggcgagaagcagggcgggagctgcctcaccaaggaggagtgccacaagaagaaggtgctctgcggcaaggcctgcacgctctcggcgcacagcaagtgcgccgccaagtgcaccaagtcctgtgtccctacctgctaggacccgccgacgaggaagctagtttctgtgatgcaattgcctagatgattggaataaggacgggtacttcttgcatgcatgcctctggtctagggtgccatttggttt

SEQ ID NO: 55180 - protein, 154 aa, Zea mays
  misc_feature: Ceres CLONE 1486232
MMSRSCCLAVSVLLAVAATASGAIAPALLHEGRLEEEGLLVAEGARVASTWAGNKVSRAQPMEAWPSGGVATQGDDQSSSGGRTPPQEVGEQQAGREAGRELPHQGGVPQEEGALRQGLHALGAQQVRRQVHQVLCPYLLGPADEEASFCDAIA

SEQ ID NO: 55181 - DNA, 645 bp, Zea mays
  misc_feature: Ceres CLONE 1486240
  misc_feature: Encodes the peptide sequence at SEQ ID NO. 55182
aaagctggagctccccgcggtggcggccgctctagaactagtggatcccccgggctgcaggaattcgcacgagaccattacctagaacatcctaatcgaaaaacattccctatttccctcgctcgcggccttgtacagcatactctgtccttgcggcgctgctggctccgccgggtgttgggtcaacgttctcccgtccccccgagcgcagtctcgcgtggttctcccgtccccccccccgtgccgtggttctccagtcctccctcatccgctctctttctttctctctcgtggcgagtggtaacgacgtcaggtgctcaggtcttgttcaggcccttcgccggcgacgagcacacagcaaatggatacaggagttcaagttatgttcatcatcagtcttgtgctctggtgtactacaagctttgccttggatgatgctgctgctacaaggattccaaatgtgggcacattacctctgtcaatgaaagaaaatccgcaattatgccaactttgtgaggagtttgcattagaggccctcttctatttaaatgaaaatgagacccagactgaaatcattgatacactacaccaagcttgttcaaagtttggctcttttaagctggagtgcacgaggttggtggatta

SEQ ID NO: 55182 - protein, 94 aa, Zea mays
  misc_feature: Ceres CLONE 1486240
  misc_feature (45)..(83): Pfam Name: SapB_1 Pfam Description: Saposin-like type B, region 1
MDTGVQVMFIISLVLWCTTSFALDDAAATRIPNVGTLPLSMKENPQLCQLCEEFALEALFYLNENETQTEIIDTLHQACSKFGSFKLECTRLVD

SEQ ID NO: 55183 - DNA, 659 bp, Zea mays
  misc_feature: Ceres CLONE 1486247
  misc_feature: Encodes the peptide sequence at SEQ ID NO. 55184
tccccgcggtggcggccgctctagaactagtggatcccccgggctgcaggaattcgcacgagaccattacctagaacatcctaatcgaaaagatcgaagcggagagcaagggagcggtcgagcgggtgacatcatcgtcatccagggtttctcaatcggcagcgatggcgaccagggcggcggcgaggttcctgcagcgcaggtttctgtcttccggcggcaaggtcctcagcgaggaggagaaggccgccgagaacgtgtacatcaagaaagtggaacaagagaagctggagaagctcgcacgcaagggccccagctcaggagagcaaccctcgtcaaccacaggctctgcagcaagtgatgtgaaggccgatgctgggccaacggagtcagcatctgcaagtgtgtcgacggacaagaacaagaactatgctgttctggcacgcgcagttgctgcccctgggtggcttgggttggtatctattgttaaagcctaacaagtcggaggaggttgtggactgaagagggaggctgtcaatgcggatggccggcctttattctcaccatggtttttcctttctgcgcattagaacctgccaccttcctgaaaaaaaattggtgaaattttaccccttcctcacaaaaaataaatacaaccg

SEQ ID NO: 55184 - protein, 110 aa, Zea mays
  misc_feature: Ceres CLONE 1486247
MATRAAARFLQRRFLSSGGKVLSEEEKAAENVYIKKVEQEKLEKLARKGPSSGEQPSSTTGSAASDVKADAGPTESASASVSTDKNKNYAVLARAVAAPGWLGLVSIVKA

SEQ ID NO: 55185 - DNA, 670 bp, Zea mays
  misc_feature: Ceres CLONE 1486249
  misc_feature: Encodes the peptide sequence at SEQ ID NO. 55186
aaagctggagctccccgcggtggcggccgctctagaactagtggatcccccgggctgcaggaattcgcacgagaccattacctagaacatcctaatcgaaaaaactttgttcctccctccctccctccctccctctcatatcctctgccgacgccccttccgctccaatccattcatttggccccgccccttttgtttcgctcaacagcttcgcggtgtctcggtcggagcaggaccgtgagttctatcggtattgggctagactgcgattcctttgcggcgaggttacgctgcttgattgcggagtcaagtgggccgcgtgctccgcgcagttagatccacgctagtaacagttaccgcccgcacgcaatccttgtttttcaagcaagaaatggagctctccctcgttgggttgcagaatgctgggaagacgtcgctggtcaatgccgttgctacaggtggctacagtgaggacatgattccaacggtaggcttcaatatgcggaaagtcaccaagggaaatgtcacgattaagctttgggatcttggtgggcagcggagattccgcactatgtgggagcgctattgccgtggagtttctgctattctgtatgttgtggacgctgctgaccgagatagtgtcctaatcgcgaaaagtgagttgcatgat

SEQ ID NO: 55186 - protein, 93 aa, Zea mays
  misc_feature: Ceres CLONE 1486249
  misc_feature (3)..(93): Pfam Name: Arf Pfam Description: ADP-ribosylation factor family
MELSLVGLQNAGKTSLVNAVATGGYSEDMIPTVGFNMRKVTKGNVTIKLWDLGGQRRFRTMWERYCRGVSAILYVVDAADRDSVLIAKSELHD

SEQ ID NO: 55187 - DNA, 712 bp, Zea mays
  misc_feature: Ceres CLONE 1486312
  misc_feature: Encodes the peptide sequence at SEQ ID NO. 55188
caaagctggagctccccgcggtggcggccgctctagaactagtggatcccccgggctgcaggaattcgcacgagaccattacctagaacatcctaatcgaaaaaagtaaataatgtgccctgccgttccccccacctccacccacctcaaccgcagggctgcgacgccgccgtcctgatcgcgtccaagaacaacgacgccgagaaggacgcgccggacaacgagtcgctcgccggcgacggcttcgacaccatcaaccgggtcaaggcggccgtcgagaagaggtgccccggcgtggtgtcctgcgccgacatcatcgcgctcgccgccagagacgtcgtctacctggcggatggcccctactggcgcgtccagctcggccgtctggacgggctcgattccagggccagcgacgtcaaggggaagctgcccgacccggacatgcacgtcaaggacctcacgccggggtttccagcgggaccggcttcacggagggtggacatgggtcggcgcctcttccgggggggcacaccggtcggggttccggggactggcagccggcttcccccaaccggcgtcttccgggttaccggcgggcgcgcgggaaaggaaccccttccgttcaaacccccggctaaacccgcgaccccaacttcaaggcagggggttggcccccataaaggcggtcgtggccccagaccactctgccgcg

SEQ ID NO: 55188 - protein, 90 aa, Zea mays
  misc_feature: Ceres CLONE 1486312
MHVKDLTPGFPAGPASRRVDMGRRLFRGGTPVGVPGTGSRLPPTGVFRVTGGRAGKEPLPFKPPAKPATPTSRQGVGPHKGGRGPRPLCR

SEQ ID NO: 55189 - DNA, 663 bp, Zea mays
  misc_feature: Ceres CLONE 1486315
  misc_feature: Encodes the peptide sequence at SEQ ID NO. 55190
  misc_feature (591)..(591): n is a, c, t, g, unknown, or other
aaagctggagctccccgcggtggcggccgctctagaactagtggatcccccgggctgcaggaattcgcacgagaccattacctagaacatcctaatcgaaaactcgatttctcgcggagcggccctccacctttatcgccgccgccgccgttgctgtgttccgtctcttcgccgatggcttcggccaagagaatgatgtcaggacctcctgcttctggatatgaccggtcacctctattttacggaggaggtggtggcgccccacctccaattccgcttggaactggtagctatggtgctccatatccacaccttgggatgcgatatggctatggtccaccagtaggacctcctggttcatacggtcttttctcttcatatggtccacctgggccaatgagtggtatgggatatggcccaggacctgagctaggccgatatagctatgggtttagaggttctccaatgccggtttctagtccatggtctggtggagcattagctgaaaacaatgacaacattgcttcacgaaagcgccgtggaggccctgatggactttctgagggtgactggacctgtcccaatgcgacnacattaacttttccttcagaagcacttgcacatgaagaaatgtggagccccgaggccaactcggggaggtaa

SEQ ID NO: 55190 - protein, 162 aa, Zea mays
  misc_feature: Ceres CLONE 1486315
MASAKRMMSGPPASGYDRSPLFYGGGGGAPPPIPLGTGSYGAPYPHLGMRYGYGPPVGPPGSYGLFSSYGPPGPMSGMGYGPGPELGRYSYGFRGSPMPVSSPWSGGALAENNDNIASRKRRGGPDGLSEGDWTCPNATTLTFPSEALAHEEMWSPEANSGR

SEQ ID NO: 55191 - DNA, 668 bp, Zea mays
  misc_feature: Ceres CLONE 1486319
  misc_feature: Encodes the peptide sequence at SEQ ID NO. 55192
aagctggagctccccgcggtggcggccgctctagaactagtggatcccccgggctgcaggaattcgcacgagaccattacctagaacatcctaatcgaaaacattccgatagatttcttctctccccgatggcacttgggggccttgtaaccgttctccacgcatgccttgatatgaagtcgaccatcctagggaaataccactacatcctctacattatatgtcctggcaatagcaacccacgatgcttttgactgtcgacgaggatctgaagcccctgtcaagtacctgtccgcgtcgggcaagcggtcgacgtggttggtcacgcaggaaggtcgaagacaatcaccggcttccagacacactccacgccggtcttgctcgcagcacgggagagagctgaactggaaactgacaaatacattcacactgaccccggtactaggagggctttgtgatcctgaagaagaacccagagtaccactaagagtgaagacccagatagcatattggtgtttccgaggcccgtccagataggcagcctccaagccgaaccgtttgcacggccttggatatctatcttctttattgctcagcggcagcgccatcctggcctctccttcctgggtccgtgtccatgtgtgattcataacttaccggagctgtgg

SEQ ID NO: 55192 - protein, 83 aa, Zea mays
  misc_feature: Ceres CLONE 1486319
AGAPRGGGRSRTSGSPGLQEFARDHYLEHPNRKHSDRFLLSPMALGGLVTVLHACLDMKSTILGKYHYILYIICPGNSNPRCF

SEQ ID NO: 55193 - DNA, 646 bp, Zea mays
  misc_feature: Ceres CLONE 1486328
  misc_feature: Encodes the peptide sequence at SEQ ID NO. 55194
tccccgcggtggcggccgctctagaactagtggatcccccgggctgcaggaattcgcacgagaccattacctagaacatcctaatcgaaaaatcgcgccctcgtcgccatcgtcaccacaccaccactccctcactgccctctcactcccgatccctgcaccactaccgcctcctccgcttcacccctctcgtcgcctcttgcggcgaccggcggcggatcgtccgcggcgcaagcgcaaccatggggctcttcaccgtgacgaagaaggccaccacccccttcgaaggccagaagcccggtacctccggcctccgcaagaaggttactgtattccagcagcctcattatctgcagaactttgtccagtcaacattcaatgcccttcctgcagaccaagtaaaaggtgcaaccattgttgtctctggtgatggccgctatttctcaaaagatgctgttcagatcataacaaaaatggctgctgccaatggagtaagacgtgtttgggttggacaaaacagtctcatgtctactcctgctgtatctgctgtcatccgtgaaagaattggtgcagatgtaagtttgattcttaatgaaggacagtctttagcagtatgaatatttacttgttattcctttatactgtc

SEQ ID NO: 55194 - protein, 124 aa, Zea mays
  misc_feature: Ceres CLONE 1486328
  misc_feature (16)..(122): Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
MGLFTVTKKATTPFEGQKPGTSGLRKKVTVFQQPHYLQNFVQSTFNALPADQVKGATIVVSGDGRYFSKDAVQIITKMAAANGVRRVWVGQNSLMSTPAVSAVIRERIGADVSLILNEGQSLAV

SEQ ID NO: 55195 - DNA, 655 bp, Zea mays
  misc_feature: Ceres CLONE 1486357
  misc_feature: Encodes the peptide sequence at SEQ ID NO. 55196
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
ctccccgcggtggcggccgctctagaactagtggatcccccgggctgcaggaattcgcacgagaccattacctagaacatcctaatcgaaaagtccagagcgcgagcaaccaacgccgccccgctgtctccgccggtccgcccccgtccctcccctcccccgaatcgcgtcgtcccgtctcctgctgccgcggaaccctcgccatggcggaggcgcccgagaccgccgcccccacccagccgcctcccgcgccggcggcttcgtccccgcctcccaagtcggggatcccgccgcggtacgacctggacgccaagtgggacgcgtgcctcgacctctccatccgccgcgtcgcctactcctccctcggcggcgccttcgcgggcctcctcctcttccgtagccctactactcgctgggcatcagttgcccttggagctgggtgtgggataggggctgcatacactgaatgctcatacttattcaatggtgctccaaagtgttcacccaagtatcaactattccctctgcacactctgatggggggagatagtaaacccctgctgttgggattggccctctcggtggagtttttgtttgtgtgaagtaaccggttgtttcatgctggaatattgccgcggggnnnnnnnnnnnnnnn

SEQ ID NO: 55196 - protein, 132 aa, Zea mays
  misc_feature: Ceres CLONE 1486357
  misc_feature (19)..(94): Pfam Name: DUF543 Pfam Description: Domain of unknown function (DUF543)
MAEAPETAAPTQPPPAPAASSPPPKSGIPPRYDLDAKWDACLDLSIRRVAYSSLGGAFAGLLLFRSPTTRWASVALGAGCGIGAAYTECSYLFNGAPKCSPKYQLFPLHTLMGGDSKPLLLGLALSVEFLFV

SEQ ID NO: 55197 - DNA, 663 bp, Zea mays
  misc_feature: Ceres CLONE 1486385
  misc_feature: Encodes the peptide sequence at SEQ ID NO. 55198
aagctggagctccccgcggtggcggccgctctagaactagtggatcccccgggctgcaggaattcgcacgagaccattacctagaacatcctaatcgaaaaaaagtgacccacctcaccaaccatcactcacccagtcaccctccataactcttctcctcctctctcccagtctcactcccctcacttcgtgcatggtcttcagagtagtagagagagcaggaggaggagcacgagagaggagcagcgaagaagaagaagaagagcagcaggcagcttccgatgtgctgctacgtgggcaaggccaccaagatcttcctgtgcctcgtggcggcgctcctggtcgcgggcctcgtcctcggcttcggcctggcccgccacacgtggggagccgaaaggacccggcagcaaccggactgccgctggcccgactgccagcagcagcaccagggcggcgaccccccgctcgtcccggatgccgtcaccacgcagcccaacccgctcacgcagccggccgtcgccgcgttccccggtgccaccgccaccccgtcgccgtccgccgccgtcgccgcgccgcccacgggcgtgccgtactttggaccacctggcccgttcgtcgtgggcctcggcccagctgctcatgcgtgagggggggctgtctttt

SEQ ID NO: 55198 - protein, 121 aa, Zea mays; identical to SEQ ID NO: 45258
  misc_feature: Ceres CLONE 1486385

SEQ ID NO: 55199 - DNA, 651 bp, Zea mays
  misc_feature: Ceres CLONE 1486387
  misc_feature: Encodes the peptide sequence at SEQ ID NO. 55200
  misc_feature (511)..(511): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (640)..(640): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (646)..(646): n is a, c, t, g, unknown, or other
  misc_feature (647)..(647): n is a, c, t, g, unknown, or other
aaactggagctccccgcggtggcggccgctctagaactagtggatcccccgggctgcaggaattcgcacgagaccattacctagaacatcctgatcgaaaaacctttccctcccgcgccgccgcagccgcctccagggccgcggaaaccctagccacctcgtcagtgccgcgcgccgggtgtctcgccgccgcccgtcactgccgctgacaccgccggagcgatcggatctcgagaccgtcaggagacacgatggaggattgggattctgaagatttccagcccgttgctcctgttgtgaaagtcgagccacttaaaaatcagtgggctgatgaagatgtcgatgccgacgacgtaaaagattcatgggaggaagaagaggaagaggagaaacctaagccagcggctgtgcaaaagaacgcgacgaaacctagcgctaaggctcctgctaaaaagggaaaacagcaagcatcaacaagtgccgaggaaccagacgagcctttgagtcccancttcagaagaaaaaatctgcccacaacaaggcctttgttggggaaaaaaaaattttatttttttttttgggaacatattccaagagacaattttttttttttttttagaggnnnnnnnnnnnnnnnngnannngnnaaca

SEQ ID NO: 55200 - protein, 133 aa, Zea mays
  misc_feature: Ceres CLONE 1486387
  misc_feature (87)..(87): Xaa is any aa, unknown, or other
  misc_feature (125)..(125): Xaa is any aa, unknown, or other
  misc_feature (126)..(126): Xaa is any aa, unknown, or other
  misc_feature (127)..(127): Xaa is any aa, unknown, or other
  misc_feature (128)..(128): Xaa is any aa, unknown, or other
  misc_feature (129)..(129): Xaa is any aa, unknown, or other
  misc_feature (130)..(130): Xaa is any aa, unknown, or other
  misc_feature (131)..(131): Xaa is any aa, unknown, or other
  misc_feature (132)..(132): Xaa is any aa, unknown, or other
MEDWDSEDFQPVAPVVKVEPLKNQWADEDVDADDVKDSWEEEEEEEKPKPAAVQKNATKPSAKAPAKKGKQQASTSAEEPDEPLSPXFRRKNLPTTRPLLGKKKFYFFFWEHIPRDNFFFFFRGXXXXXXXXN

SEQ ID NO: 55201 - DNA, 664 bp, Zea mays
  misc_feature: Ceres CLONE 1486391
  misc_feature: Encodes the peptide sequence at SEQ ID NO. 55202
aaagctggagctccccgcggtggcggccgctctagaactagtggatcccccgggctgcaggaattcgcacgagaccattacctagaacatcctaatcgaaaaggaggcgtacgacatcgctgcgatcaagttccgcgggctcaacgccgtcaccaactttgacatgagccgctacgacgtggagagcatcctcagcagcgacctccccgtcgggggcggagctagcggtcgcgcccccgccaagttcccgttggactcgctgcagccggggagcgctgccgccatgatgctcgccggggctgctgccgcttcgcaggccaccatgccgccgtccgagaaggactactggtctctgctcgccctgcactaccagcagcagcaggagcaggagcggcagttcccggcttctgcttacgaggcttacggctccggcggcgtgaacgtggacttcacgatgggcaccagtagcggcaacaacaacaacaacaccggcagcggcgtcatgtggggcgccaccactggtgcagtagtagtgggacagcaagacagcagcggcaagcagggcaacggctatgccagcaacattccttatgctgctgctgctatggtttctggatctgctggctacgagggctccaccggcgacaatggaacctgggttact

SEQ ID NO: 55202 - protein, 167 aa, Zea mays
  misc_feature: Ceres CLONE 1486391
MSRYDVESILSSDLPVGGGASGRAPAKFPLDSLQPGSAAAMMLAGAAAASQATMPPSEKDYWSLLALHYQQQQEQERQFPASAYEAYGSGGVNVDFTMGTSSGNNNNNTGSGVMWGATTGAVVVGQQDSSGKQGNGYASNIPYAAAAMVSGSAGYEGSTGDNGTWVT

SEQ ID NO: 55203 - DNA, 664 bp, Zea mays
  misc_feature: Ceres CLONE 1486397
  misc_feature: Encodes the peptide sequence at SEQ ID NO. 55204
aaagctggagctccccgcggtggcggccgctctagaactagtggatcccccgggctgcaggaattcgcacgagaccattacctagaacatcctaatcgaaaattccgcttccaaaggtttccatctctctctcccgccatatgactagtgttcctgttggctgttgctgtgtcggtccgccatgtacgcgtccctggattgctccggtaactcctttgggaaaaccgttaacgatcatctgaggtcaactttgagttttgataacaagcaacctccatttgcgagtcaaaactttgactacggtcaaacaatagcttgcatttcatacccgtacaatcgttctagatcaggagatgtttgggcagcctatgagtcacgcaccagcactgccactgtgcagttccgttcccaaattgctggtgggggttcatccacaagaattcccttgcctttggaattagcagagaatgaacccatatatgtgaatcccaaacaatatcacgggatacttcgcagaagacagttacgtgccaagctagaggctcagaacaagctagtcagagcccgaaagccttaccttcatgagtctaggcatcttcatgcaatgaagagggcacgaggttccggtggacgattcctcaacactaagcagctccagcagtct

SEQ ID NO: 55204 - protein, 161 aa, Zea mays
  misc_feature: Ceres CLONE 1486397
  misc_feature (96)..(152): Pfam Name: CBFB_NFYA Pfam Description: CCAAT-binding transcription factor (CBF-B/NF-YA) subunit B
MYASLDCSGNSFGKTVNDHLRSTLSFDNKQPPFASQNFDYGQTIACISYPYNRSRSGDVWAAYESRTSTATVQFRSQIAGGGSSTRIPLPLELAENEPIYVNPKQYHGILRRRQLRAKLEAQNKLVRARKPYLHESRHLHAMKRARGSGGRFLNTKQLQQS

SEQ ID NO: 55205 - DNA, 676 bp, Zea mays
  misc_feature: Ceres CLONE 1486404
  misc_feature: Encodes the peptide sequence at SEQ ID NO. 55206
  misc_feature (634)..(634): n is a, c, t, g, unknown, or other
  misc_feature (635)..(635): n is a, c, t, g, unknown, or other
aaagctggagctccccgcggtggcggccgctctagaactagtggatcccccgggctgcaggaattcgcacgagaccattacctagaacatcctaatcgaaaaacttttcgaagtagcagcccggaactccggatccaccgctaccgccgccgcgtctaaaccctccaccgccgcggtgcgtcagaggcagaggcagagaggcagaggcagaggcagccatggggagccgcctcgggcgccgcgtgatccactttgccaacctcccgctgaaggtcatgctgccccccgcgccgctctcctccgtgcaggagttcgccgtgcggaccgtcccctccgcttccaaggtggacatccggcgctgcctcgagtccatgtacggtttttccgtcgccgaggtccgcacgcttaacatggagggcaagaagctccgccggggcccctttctctccgccaagcccgactacaagaaggcctacgtcacgctccgcgccccgctcgcggtctcgcgcgacctgttccccatcggggccatcctcgcggagcgggagcggaaagccagcgcagccgctgcgaggaggaaggggtgggggcccccccaaggaggggaagggggagagcaaggggaacactgatnngggaagaccaagagggagggcttctccagggctggctgcgg

SEQ ID NO: 55206 - protein, 137 aa, Zea mays
  misc_feature: Ceres CLONE 1486404
  misc_feature (7)..(99): Pfam Name: Ribosomal_L23 Pfam Description: Ribosomal protein L23
MGSRLGRRVIHFANLPLKVMLPPAPLSSVQEFAVRTVPSASKVDIRRCLESMYGFSVAEVRTLNMEGKKLRRGPFLSAKPDYKKAYVTLRAPLAVSRDLFPIGAILAERERKASAAAARRKGWGPPQGGEGGEQGEH

SEQ ID NO: 55207 - DNA, 634 bp, Zea mays
  misc_feature: Ceres CLONE 1486445
  misc_feature: Encodes the peptide sequence at SEQ ID NO. 55208
  misc_feature (370)..(370): n is a, c, t, g, unknown, or other
  misc_feature (634)..(634): n is a, c, t, g, unknown, or other
tcccccgggctgcaggaattcgcacgagaccattacctagaacatcctaatcgaaaaagaaagtgagctggaaaccctcatagacatgcagcttgtggagctccgcaaggtgttcaggataccccataagcctttcgatgaaacgcagggccctacctccaagaagctcctaactctcttcagatcagggaagcttgggccggtcatcctcgacgaccttcctgatggatctgagaaataacctgtttacttgattctttttattttgcactgggcagctgatgttctatgatggaaggcattggtacgagctgatgttcttgcagggaggatatgtttatctgtctccctcgttggctgtttgggtttnacagaaccccgcatgcttttgggattgaaggtggcaggccttcaatggtacattgtcctgccgatacttttgctggacctcaggtagtgtgatcaatctcataccacgaaagttctgagggaaacatggactgtacccctgaaacttctggcgggtaaggatccattcccttttgggccgtaaaagggaaacaacgtttaactaaggtttttccgaggcccaaagagttgggcgttgcgaggtatgtgaagggtgggggactcn

SEQ ID NO: 55208 - protein, 51 aa, Zea mays
  misc_feature: Ceres CLONE 1486445
MQLVELRKVFRIPHKPFDETQGPTSKKLLTLFRSGKLGPVILDDLPDGSEK

SEQ ID NO: 55209 - DNA, 578 bp, Zea mays
  misc_feature: Ceres CLONE 1486450
  misc_feature: Encodes the peptide sequence at SEQ ID NO. 55210
  misc_feature (578)..(578): n is a, c, t, g, unknown, or other
atagctggagctccaccgcggtggcggcccgctctagaactagtaggatcccccgaggctgcaggaattcgcacgagaccattacctagaacatcctaatcaaaaaacacaaagaagctccataattaattattgccctttcagttcgccatcggcagccgagcaccatgagctccacaggcggcggcgacgatggcgccaagaagtcttggccggaagtggtcgggctcagcctggaagaagccaagagggtgatcctgtgcgacaagcccgacgccgacatcgtcgtgctgcccgtcggcacgccggtgaccatggatttccgccccaccgcgtccgcatcttcgtcgaaccgtcgcggagcacccacatcggctgaggtctaatctacaaatgatgactcgacatgcatgcgtactgtccgtcgcgaataatggatgtggtgtgcttcgttcccataattgctagtaaaaacatggcatcgtccgtatgcatgaattaatggatcagaatggtctcctttcccgattggaaatatgaaaattggaaatttgaaaaaaaaaaaaaaaaagcttttn

SEQ ID NO: 55210 - protein, 72 aa, Zea mays
  misc_feature: Ceres CLONE 1486450
  misc_feature (12)..(73): Pfam Name: potato_inhibit Pfam Description: Potato inhibitor I family
MSSTGGGDDGAKKSWPEVVGLSLEEAKRVILCDKPDADIVVLPVGTPVTMDFRPTASASSSNRRGAPTSAEV

SEQ ID NO: 55211 - DNA, 707 bp, Zea mays
  misc_feature: Ceres CLONE 1486455
  misc_feature: Encodes the peptide sequence at SEQ ID NO. 55212
aaagctggagctccccgcggtggcggccgctctagaactagtggatcccccgggctgcaggaattcgcacgagaccattacctagaacatcctaatcgaaaaaagtctcttggccaggtctccctctccccggctctccgccttcctcttccagtccccgcgcgcgagatcgccgccccgtgtgggccctagatcccgatggcctcgcgccgccgcaccctgctcaaggtcatcatcctcggcgatagtggggttgggaagacttccttgatgaaccaatatgtgaacaagaagttcagcaatcagtacaaggctacgatcggcgcggatttcctcaccaaggaggtgcaggtcgaggacaggctcttcactctgcaaatatgggacacctgctggccaggaaaaggtttcagagtctcggccctagcattctaccgggggagccagttgggtgtggccccagtccatgggggttgattcctattgagagcatgtggcctacgtggaaggacgggtcgagaacgagctcctagttcggggctgggacgcggaggagccggggagatggtgtgcattctgcggcccgccgggggtaacgaagagttgtaagtatcagggggggggccacgtgggtgggctgcggagcgcgtggagcgagaggcgagcggggcattgggcggccgctccgcctaaggggactcaatccg

SEQ ID NO: 55212 - protein, 92 aa, Zea mays
  misc_feature: Ceres CLONE 1486455
  misc_feature (10)..(91): Pfam Name: Ras Pfam Description: Ras family
MASRRRTLLKVIILGDSGVGKTSLMNQYVNKKFSNQYKATIGADFLTKEVQVEDRLFTLQIWDTCWPGKGFRVSALAFYRGSQLGVAPVHGG

SEQ ID NO: 55213 - DNA, 671 bp, Zea mays
  misc_feature: Ceres CLONE 1486459
  misc_feature: Encodes the peptide sequence at SEQ ID NO. 55214
  misc_feature (1)..(1): n is a, c, t, g, unknown, or other
nataactggagctccccgcggtggcggccgctctagaactagtggatcccccgggctgcaggaattcgcacgagaccattacctagaacatcctaatcgaaaaaattgtgctcggctcgatccaatgcaccgactcgccactccagccgaatcatccgtccactcggcctcgtaaatgccttcgctcatcgacggcccggcgtcgctgcggtcgctgctccggccggtcaccgacgagcgccggaccagtaagcacggcggcagcaccggcggcgccgtcgtggggctcttcaagatgttcaggctggtgcccatgctcaccaccagcaccggctgcaagatggccgcgctgctcgggcggcacagcggcagggccctcctcgcggaccacgcgccggcggtgacgctcttcgggcaccgccgcggccggctgagcctggccatccacgaggacacgcgggcgccgccggcgttcctcatcgagctgcccatgctggcggccgcgctgcaccgggagatggccacgggcaccgtgaggctggcgctggagagcgacacccgcagcgcgcgccggcggctgctggaggagtacgtgtgggccgtctactgcaacggccgcaaggccggctacgccatccgccgcaaggacccgtccgacgacgagcggcacg

SEQ ID NO: 55214 - protein, 165 aa, Zea mays
  misc_feature: Ceres CLONE 1486459
  misc_feature (75)..(165): Pfam Name: DUF617 Pfam Description: Protein of unknown function, DUF617
MPSLIDGPASLRSLLRPVTDERRTSKHGGSTGGAVVGLFKMFRLVPMLTTSTGCKMAALLGRHSGRALLADHAPAVTLFGHRRGRLSLAIHEDTRAPPAFLIELPMLAAALHREMATGTVRLALESDTRSARRRLLEEYVWAVYCNGRKAGYAIRRKDPSDDERH

SEQ ID NO: 55215 - DNA, 533 bp, Zea mays
  misc_feature: Ceres CLONE 1486469
  misc_feature: Encodes the peptide sequence at SEQ ID NO. 55216
  misc_feature (486)..(486): n is a, c, t, g, unknown, or other
ataagctggagctccaccgcggtggcggccgctctagaactagtggatcccccgggctgcaggaattcgcacgagaccattacctagaacatcctaatcgaaaaaatctccagcccttcaccctcttctcggcccgacctcgacggtgttccaccatctcctaccctcttcttttcccgcccgcgccatccctttctccgctgtagccactgcaagccccgcgcgacgcacacggcagtggtccaccgtcgaccaaatcgatccacaagcatccgccgttactccctccggcgaagggtcctattaactttgccaggcaaaaaaagccctcccaacccaaaaaaaaaacgtggcaaagccccccccccccccaaaatttttcccccaaaaaatattttttcccaaaaaaaaaaacacccccggaaaacctcccccatttttttttttgggggggggcccccccagggggggtaaaaaaaaaaaaanccccccccccccccggcgcccttctttttttaaaaaaaaaaaacaaa

SEQ ID NO: 55216 - protein, 67 aa, Zea mays
  misc_feature: Ceres CLONE 1486469
KLELHRGGGRSRTSGSPGLQEFARDHYLEHPNRKNLQPFTLFSARPRRCSTISYPLLFPPAPSLSPL

SEQ ID NO: 55217 - DNA, 709 bp, Zea mays
  misc_feature: Ceres CLONE 1486478
  misc_feature (1)..(1): n is a, c, t, g, unknown, or other
naaagctggagctcaccgcggtggcggccgctctagaactagtggatcccccgggctgcaggaattcgcacgagaccattacctagaacatcctaatcgaaaaatcccgtctcgtttcgtctcggtgtcgcacctctcacgacggcaccaccccagcgcggcgcgagtggagacgccgctgctccgtgcttcgccgcgcctacctaacccaagacctgccagacctgagtggctgagtgttcgtgttcggtcaaaacccaccgcgcgagcgcctccagagtccaaacccgctacaaatctcgcgctgcgcattctccccgtacgatacggcggcacggcccacgagccgggcggtggcggcagctagctagctgcagactaacaccagccaccggagggaaatgaacggcgccatccgcccaccaacccaacggggaggcggaaggagtaccccttccaggttggtgaacatcggcgaaacggcccaggagggaaaagaacacccgggttggcccccctccccccgaaaaagtgtaacccccacttaccaagggaacagtgcgggggcggagttcccacacacggaaccaggccccctcacagaccaagtaacgccaaggggggaggcggggggagaaaccagccgcgcaaacaaaggtcttcctgcggggttagctgctgccatagaagtgcgggggacgcgacggga

SEQ ID NO: 55218 - DNA, 618 bp, Zea mays
  misc_feature: Ceres CLONE 1486482
  misc_feature: Encodes the peptide sequence at SEQ ID NO. 55219
gaaagctggagctccccgcggtggcggccgctctagaactagtggatcccccgggctgcaggaattcgcacgagaccattacctagaacatcctaatcgaaaaaactggataagcccatcacccatcgcccatcggcagcagaaggccactgcccggacggagcttccgaaagggaaccgggcagcggcaatggagggacagccgctccatctcctcatcgcccagttccaccacccttgcctacgcggtctcatccccaactaccctacccactacctgcccacctcccgcctccgactccgcgtacagcgtcgcaagccgaagcagctcgccgcagtgccttcgaggcgtccatcgggcagccaagccgacgcgcctggcctggtgccggtgccctaacccggtgggcgggcgtggggctccagctgaccgggggctcgcccctttttccctccccaaccgggccaagcccttgggtcccgccccctccggggggccctcgcggtgttaaggcccccccggggggggggggggggagaccccgatggggggaggctgccccccccaaaaagggaaaaaccaaaaaccctcccgcgcccctctcgggggcccccctc

SEQ ID NO: 55219 - protein, 69 aa, Zea mays
  misc_feature: Ceres CLONE 1486482
MEGQPLHLLIAQFHHPCLRGLIPNYPTHYLPTSRLRLRVQRRKPKQLAAVPSRRPSGSQADAPGLVPVP

SEQ ID NO: 55220 - DNA, 665 bp, Zea mays
  misc_feature: Ceres CLONE 1486495
aaagctggagctccccgcggtggcggccgctctagaactagtggatcccccgggctgcaggaattcgcacgagaccattacctagaacatcctaatcgaaaaatcttatctgctacctgggttggttcatgttggtgcccagccacagctagatctacccagacagacaaaccttgtattggagtgccaaatgacctagagaagttgaagccttggcaagacagtttctgcaaaatccttacaaggtaatcataggatcgcctgaactcaaagctaatcattccatacaacaaattgcggaaggtatttcagatcatgagaaaagtatccaagactcagtaagctattgtctgatctaattgatgggaatcgtatcttgatatttctccaaacaaaaaaggactatgttcttgcagagtttaagagcgacaagagtcccatgacggctgccacatatgtggcagcacgtggtcttggtatgatgatttatttgaaaatatgattaggtagtagtttcaagtgctcaaggatgataagtcagaggggtgaactgaagttggggattggtggtgtatggcaaggtaccatcatgtcaaaaagagatcattttcccgtggtttacctcatttgagcgggagcatttggcagttttaccaaagtaccat

SEQ ID NO: 55221 - DNA, 656 bp, Zea mays
  misc_feature: Ceres CLONE 1486497
  misc_feature: Encodes the peptide sequence at SEQ ID NO. 55222
atagctggagctccccgcggtggcggccgctctagaactagtggatcccccgggctgcaggaattcgcacgagaccattacctagaacatcctaatcgaaaaagaaattcagaatcgatccgatctccgcttgcgctgagctccatcagattcaattctctgcaagcgcaagaccgcgaacacgaggaggcaggggagcaacatccacaaccacgagccatggcggggaggactaacatgcccactaacaactccgacctcatcgcaatcatcgccgacgaggacaccgtcactggcttcttgatggccggcgttggcaatgttgatctgcgcatgaaaaccaattacctcctcgtctacaacgagacgacagttaaacaaatcgaggacgcgttcaaagaatttactgcaagggaggacactgctattgtgctcatcagtcattatattgccaacatgataagatctctggtggatagctacaacaagccagtccctgctattctggagatcccatccaaggaccatccatatgatccagcgcacgactcggtgctgtctcgagtgaagtttctcttctctgcggaatcggtggcgtctgatatgcgttgaatgcatcccttgcgtagtatgaccctttgatgtatccgttttgg

SEQ ID NO: 55222 - protein, 130 aa, Zea mays
  misc_feature: Ceres CLONE 1486497
  misc_feature (15)..(115): Pfam Name: ATP-synt_F Pfam Description: ATP synthase (F/14-kDa) subunit
  misc_feature: SWISSPROT Homolog: EC 3.6.3.14 H(+)-transporting two-sector ATPase
MAGRTNMPTNNSDLIAIIADEDTVTGFLMAGVGNVDLRMKTNYLLVYNETTVKQIEDAFKEFTAREDTAIVLISHYIANMIRSLVDSYNKPVPAILEIPSKDHPYDPAHDSVLSRVKFLFSAESVASDMR

SEQ ID NO: 55223 - DNA, 675 bp, Zea mays
  misc_feature: Ceres CLONE 1486498
  misc_feature: Encodes the peptide sequence at SEQ ID NO. 55224
atagctggagctccccgcggtggcggccgctctagaactagtggatcccccgggctgcaggaattcgcacgagaccattacctagaacatcctaatcgaaaaagaacacaattacacaagcgatagctcgcggtgagcatcgatcactgtgtactcgaacagcaagaatggccaaggttctgcaggccgctgttgctctcctgctggtggaagcgctgctgctgctagcccattgcgacggcagggagctgaaagcgagcggcgtggcggcgtcgggcggcggtgccgccgccaacggtggtggtagtagcgggggcgacgagaaggccacgggcttgccgctgatcccgccgctcccgcccgtgctcggccccgtggtgccgctcccacccgtcgttcctgggatccctcctccggctcgtgagtccgacaagtttccgtgagtacgtgaccgtgtgcgagctaggtctgtaggccaagcatggtgccgctcggggtggctcctgctcctgagccgaacaagttgcgcgttcgcgtctttgtcatgtacctttatagctaccttgcattttctgttgggtggagatgtatctacgcgtcacagatcgagttcgtgcttttgagataaaaaccagaatttgcagctcgtagtactaaaaaaaaaaaaaaaaaacc

SEQ ID NO: 55224 - protein, 91 aa, Zea mays
  misc_feature: Ceres CLONE 1486498
MAKVLQAAVALLLVEALLLLAHCDGRELKASGVAASGGGAAANGGGSSGGDEKATGLPLIPPLPPVLGPVVPLPPVVPGIPPPARESDKFP

SEQ ID NO: 55225 - DNA, 704 bp, Zea mays
  misc_feature: Ceres CLONE 1486501
  misc_feature: Encodes the peptide sequence at SEQ ID NO. 55226
atagctggagctcaccgcggtggcggccgctctagaactagtggatcccccgggctgcaggaattcgcacgagaccattacctagaaaatcctaatcgaaaagtgtgtctggaaaccctagccgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctccaagaaggacctgaaagtacgtgaccaaggaagtacttggaagaggcacaacgcggcgggattggcctacacgtgggtggctggccactagggcccgcaacggcttatgagcgtccgcttcgttgaacatgtgctgagaacaaggggccaaggaaaaacattttattggtccgtcgccttatttgtgtagtgtttgtaacccggtttgccttgttaataccctggaccccgagcgtctccccgaatggcgccagggttaatggggtgggtggggaatcttcgtgatcg

SEQ ID NO: 55226 - protein, 110 aa, Zea mays
  misc_feature: Ceres CLONE 1486501
  misc_feature (16)..(111): Pfam Name: Ribosomal_L22e Pfam Description: Ribosomal L22e protein family
MARGVVSAKGGAVAGKKKGSVSFTIDCTKPVEDKIMEVASLEKFLQERIKVAGGKAGNLGDSVTISREKTKVTVTSDGPFSKKDLKVRDQGSTWKRHNAAGLAYTWVAGH

SEQ ID NO: 55227 - DNA, 682 bp, Zea mays
  misc_feature: Ceres CLONE 1486503
  misc_feature (682)..(682): n is a, c, t, g, unknown, or other
catagctggagctccccgcggtggcggccgctctagaactagtggatcccccgggctgcaggaattcgcacgagaccattacctagaacatcctaatcgaaaagagatctttgtgtgaccgcgcagccaagggggaaagaaagaaagaaaaggaaaaccaaccagaagaaaagctcgggtgtttcttatggtgggaggagaatgaggggagcgtgggggatggagtatgtccgatcacaacgacgaaccagtggggcagtgcatgatggacaagatctccgacgagttccccggcgagcgggactcctcgtagacatcctcggactcggacgacgagaagaaggagacgtgcggatggcgtcaaagccatgatctaccggctcttcagacgcgagatgtccgcactctccgttgctcggtgcgtggcaagactgctgatcttgttctatggaggaacaagaccatctcaggaagggggcttgctggcgatacggtcatatggctgctgtacggaatcatcgagtaccatgggatcaccttggtgggccactggatcatcctgtccatggtaaccctcttcctctattcaaatgtctgaatcttcgctcacaagtctcccccgaacatccctgagctgaatagtccagatgacatgactgccaacgttgcactatcactgctn

SEQ ID NO: 55228 - DNA, 667 bp, Zea mays
  misc_feature: Ceres CLONE 1486504
  misc_feature: Encodes the peptide sequence at SEQ ID NO. 55229
aaagctggagctccccgcggtggcggccgctctagaactagtggatcccccgggctgcaggaattcgcacgagaccattacctagaacatcctaatcgaaaaaaggacctgctctgtttgtcggtgagtttttccgacttctacctctccgtccctgccgagctgcggaagccgcatcaactggtacggcgaaaatccgatctagtctctcgacaagtttccgcaggcctgagaagccggatactgcgggaaggatgtcttgtctagatgtgctggaacgccaagaaactagctctcgacctgacctaaaggacccgacacatggcctccaggtgaagctcagctgcggccggcaagtgacaggaactctaagaaggatatgaccaactactctacttaatgcctgatgaaacatccgagaatgacacagagcgagatgatccattgaagctatcagggaaaacgagaccacttggcctcattgtgtgctgaggcacaccacccatgctggtctcgccgactgatgggactgatgagatcgccgaccctttcctctcagacggagcatagcttgcacccctcggaacaatatgtccctgtgggaaaagaacccgtctctcgtgtatgtgtcgtagctgtcgctacggttactaatgtgctgctgctg

SEQ ID NO: 55229 - protein, 30 aa, Zea mays
  misc_feature: Ceres CLONE 1486504
MPDETSENDTERDDPLKLSGKTRPLGLIVC

SEQ ID NO: 55230 - DNA, 628 bp, Zea mays
  misc_feature: Ceres CLONE 1486509
  misc_feature: Encodes the peptide sequence at SEQ ID NO. 55231
catagctggagctccccgcggtggcggccgctctagaactagtggatcccccgggctgcaggaattcgcacgagaccattacctagaacatcctaatcgtaaagtgccatcgccattcacctccagccaggctccggaaccttatcgccaaatcctcgtcccctacccgaggcgagcatcatggcggccgcgctcttctccagctcgctctcgccccgcttcctcgccctatcctccccgaagccggccgcgcccgcggccacagccttcctccccttcaggctgccgccgcgcgctgtctcggcgccgggtaggcgggtcttcgagcccgtggccgtcgcggtgtcgtcggagtacaagacggagggcgcggagcaggagggggaggatggatccgaggagttctccgaggacctgcaactgttcgtcggcaacctaccgttcagcgtcgacagcgcgccagctcggaaagggttcctcccaaacaaagggccgggggcccccccccaaaaaaaaaaaatgttcgccgaggagggtttttttttttttttttatacaaaaaaaaaaaccaatgaggtctcgggggcccacccgccgcgccaccagaggataccatagatgttttgtt

SEQ ID NO: 55231 - protein, 145 aa, Zea mays
  misc_feature: Ceres CLONE 1486509
MAAALFSSSLSPRFLALSSPKPAAPAATAFLPFRLPPRAVSAPGRRVFEPVAVAVSSEYKTEGAEQEGEDGSEEFSEDLQLFVGNLPFSVDSAPARKGFLPNKGPGAPPQKKKMFAEEGFFFFFYTKKKTNEVSGAHPPRHQRIP

SEQ ID NO: 55232 - DNA, 665 bp, Zea mays
  misc_feature: Ceres CLONE 1486515
  misc_feature: Encodes the peptide sequence at SEQ ID NO. 55233
aagctggagctccccgcggtggcggccgctctagaactagtggatcccccgggctgcaggaattcgcacgagaccattacctagaacatcctaatcgaaaaactaactcagcactcggcagtcccagctcatccccatccctgcccgtctccccggccggccactcgaccagaagcacgcgagcgagcggagaccgatcgaggccgacagccatgggcaagcaagcgatggcgctggcgctgctgtgcgccgtcctgctggcggcgacggcggacgccgcggcggcggcgtcgtgcaacccgtcggcgctgagcgcgtgcgcgcccgcgttgttcggcagggcggtcacgctggggtgctgcgcgtcgctgcgcgcgcagcagccctgcctctgccagtacaagcgcgaccccgcgaaccgcgcctacgtcaacggccccgccgcgcagcgcttcacccgcgcctgcggcctcacccagatgaagtactgatggaccgagagcctgcatgcgctccgccggccgctggagatgttgtagtatgcgcggctacgtgtatgtactactactacgagtccacggcgggtccatggacatacatacgtgccgtctaaataaaaacgcggtcgcggcgagctcgtacgtcgtgctccggcaaatcgtggt

SEQ ID NO: 55233 - protein, 92 aa, Zea mays
  misc_feature: Ceres CLONE 1486515
MGKQAMALALLCAVLLAATADAAAAASCNPSALSACAPALFGRAVTLGCCASLRAQQPCLCQYKRDPANRAYVNGPAAQRFTRACGLTQMKY

SEQ ID NO: 55234 - DNA, 676 bp, Zea mays
  misc_feature: Ceres CLONE 1486516
  misc_feature: Encodes the peptide sequence at SEQ ID NO. 55235
caaagctggagctcaccgcggtggcggccgctctagactagtggatcccccgggctgcaggaattcgcacgagaccattacctagaacatcctaatcgaaaaaagcacgcgcgcgccctgtgctccccctttatggcgtgcaagacgaagagcctgctgttggcgctcagcgtggcggcgctgctcgcggcgcggccggagtcccacggcctgggggactgcacgagcgggagcgacgaggcgacgacgacgccggagatgcagaccttcttcaagccccaggccgccgcggcgctcccggaggccctcgacgcctccatgcccgccaagccggaggccacggcgctcccagccaccaccaccgcccccgccgcgacaacgggggggacggggccgtcagccacgcggcgcagccccctgtccgtgacgggccgcgtggcctgcggcatggcggccatggccgtggcccggatcgcggccgtgcgggggcgacgtgggggggcccggtcgcccggcggggggtcggatgcccaccctccggatggccgccccccccggtgaagccccggtccggcggggggcccgcgtcgagggggccggcggggcgggcggggtttagcggtcctggggtgttaggcgccgtgtgccttacggctttagacgggcggtcgggggg

SEQ ID NO: 55235 - protein, 142 aa, Zea mays
  misc_feature: Ceres CLONE 1486516
MACKTKSLLLALSVAALLAARPESHGLGDCTSGSDEATTTPEMQTFFKPQAAAALPEALDASMPAKPEATALPATTTAPAATTGGTGPSATRRSPLSVTGRVACGMAAMAVARIAAVRGRRGGARSPGGGSDAHPPDGRPPR

SEQ ID NO: 55236 - DNA, 775 bp, Zea mays
  misc_feature: Ceres CLONE 1486517
  misc_feature: Encodes the peptide sequence at SEQ ID NO. 55237
  misc_feature (20)..(20): n is a, c, t, g, unknown, or other
  misc_feature (29)..(29): n is a, c, t, g, unknown, or other
  misc_feature (40)..(40): n is a, c, t, g, unknown, or other
  misc_feature (44)..(44): n is a, c, t, g, unknown, or other
gggttgggggggtgggcgcngggggaaanaaaaatcttgnttcncgggggattttgctcaaactgggactccccgcggtggcggccgctctagaactagtggatcccccgggctgcaggaattcgcacgagaccattacctagaacatcctaatcgaaaaaaagttcagtcacagccacaggtatgctgacactcctgccccttcgcttgccattctcgctacctgtagccgccacactcccgaacgccgccttgctcctcccggcaagcaccagggtctccctccgccagatcacgcagggagccagcatgaacgctgccgccgcctcctccgctccggacgctgctgcggccgccactggcgaggagggcgcgaaggaggccgtggacgtgctggtccagtacgtggtcctgcggcgcgatctggcagacacgtggcccctggggagcgtcgtggcgcaggggtgccacgggcgcccccccccccccgtgtggggcgctcccgggaccaccgcggacaccgcacgcctactggcgcgccccgacatccgtctatccggaactggcacaaaggtataaactgggaggggggaaagggagaggccacgcgctgcaattaaacccgggctgtaagaacgctgtgtagcaatctgggtggtctcgggcgacaaagcccctgggaattgaaggcctagcacgggaggaaacatcccccgaaccggtgcatgagacggacggggtagccttggaccctaaatggtcggaaaaggcgttc

SEQ ID NO: 55237 - protein, 89 aa, Zea mays
  misc_feature: Ceres CLONE 1486517
MNAAAASSAPDAAAAATGEEGAKEAVDVLVQYVVLRRDLADTWPLGSVVAQGCHGRPPPPVWGAPGTTADTARLLARPDIRLSGTGTKV

SEQ ID NO: 55238 - DNA, 616 bp, Zea mays
  misc_feature: Ceres CLONE 1486518
  misc_feature: Translation starting site: 159
tcccccgggctgcaggaattcgcacgagaccattacctagaacatcctaatcgaaaagccgccgttcgctgctcggcgctctcctctcccgacgacagctacacctcacaaccgtgagctcgcgaaggaacgctgttcgcaattccggcgccggcaccatgagtaagctgcagagtgattctctgagggacgcgattgcctcaattaccaatgattcccgtgagaagcagcgcaaatttgttgaaaccattgagctacaaattggactgaagaactatgaccctcaaaaggacaagcgcttcagcggttctcttaagctgcctcacattcctcgccctaagatgaaggtttgcatgcttggtgatgctcagcaccctgagggaggcagagagaatgggtatagaccatatggatgggggaagccctcaggaagatgagcgtaaccagtagcttgtgaagaagctgggaaggaagttccatgcttttcctttgctttgggggtaatcattaaacaaattgcctcggtcttggtggggcccgggccttaaaaaggggggggaaaaatcccctgcccttcggacacccccgcaagaaatctccggggaggctcaaaaag

SEQ ID NO: 55239 - DNA, 726 bp, Zea mays
  misc_feature: Ceres CLONE 1486520
  misc_feature: Encodes the peptide sequence at SEQ ID NO. 55240
  misc_feature (176)..(176): n is a, c, t, g, unknown, or other
  misc_feature (178)..(178): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (396)..(396): n is a, c, t, g, unknown, or other
tccccgcggtggcggccgctctagaactagtggatcccccgggctgcaggaattcgcacgagaccattacctagaacatcctaatcgaaaagtagttgcagcaccagcagcagaagagcagagccagagctccagcaatggccgagaagggcgtgaaggtgttggggatgtgggcnanccctatggtggtgagggtggagtgggcccctgcccttaagggcgttgagtacgaggcgtcgacggggacctcaccctggggatacccggggggctggggccttaccgggggaaacggggacgcgccggtcatctatttgggggggtaaatgggggatgggatgtgggaaaaannnttttttttcccccccccccggggggggaagaaaggggggttcnccccccccctctggccctacccgggggggggtaataggtaggggtgatggtagcgttacttcgacaccgacggggtccactggggggtaaacttcggggacaacgggagggggtatatatctgggggccgtctggggtgggtctgcttggcgtgcgggtcatcttatggtgggtacctcttggggggggcataccaggggatcggggcgtgggggggagaacggggggggctatctctcttttggtctgcggcggcgggggggggaaattgggggggggataacacactcatgggggcatatggggcacaggcggggggcacacagggtg

SEQ ID NO: 55240 - protein, 62 aa, Zea mays
  misc_feature: Ceres CLONE 1486520
  misc_feature: SWISSPROT Homolog: EC 2.5.1.18 Glutathione transferase
  misc_feature (14)..(14): Xaa is any aa, unknown, or other
MAEKGVKVLGMWAXPMVVRVEWAPALKGVEYEASTGTSPWGYPGGWGLTGGNGDAPVIYLGG

SEQ ID NO: 55241 - DNA, 660 bp, Zea mays
  misc_feature: Ceres CLONE 1486521
  misc_feature: Encodes the peptide sequence at SEQ ID NO. 55242
tcccccgggctgcaggaattcgcacgagaccattacctagaacatcctaatcgaaagtccccgtctcaccgcactgccttgccccctactctgcctcgcttagcttagccgccgctgctacgcactctcgccgtccttgttcccgcgtcgctctgctcgcgatggcgtcccacgttgcagagctgctcgtggccgtaggcggacgtgctgttcggcaaaggggcagggaaggagaagggactagaaaggccggctgcgcggggagcccgaaacggaaacggggggcggggggcacaaaagtcagggcgaaaaacgggcattacatggagggggagaccaaaaatgtgggtgggagggggggcacctaaaagatggggggataacaccccaccgaaatggacaaaaagggggggtggcggagaaaaaaagggggaagaacagtggaagaaaaaggagggaaacgggtgagtaaggatagaaaaagggggggagggggggggagaaaaaaaaagggggggggagggagggggaaacacaaaaaggggtggggggtggggggaaaaaggggggcgggagaaaaaaacgggggggagaaaagaaaagggggagaaaaagaagaaaaatgaagggggggaaaagaaaagggcgcgaattaaaaag

SEQ ID NO: 55242 - protein, 68 aa, Zea mays
  misc_feature: Ceres CLONE 1486521
MASHVAELLVAVGGRAVRQRGREGEGTRKAGCAGSPKRKRGAGGTKVRAKNGHYMEGETKNVGGRGGT

SEQ ID NO: 55243 - DNA, 628 bp, Zea mays
  misc_feature: Ceres CLONE 1486527
  misc_feature: Encodes the peptide sequence at SEQ ID NO. 55244
cgctcttaactagtggattcccccggctgcaagaattcgcacgagaccattacctaaaacatcctaatcgaaaaaacaacttgggcgcggccggattcgtataggttagcagcacacagtagcaagctcgcgatctgtgcgcccaccatcaccaccaccgcccggaggagaggaccgaccgaccgaccgaagatgcggatgagctgcaacggctgccgcgtcctgcgcaagggctgcagcgacgcctgcaccatccgcccctgcctgcagtggatcgacaggcccgaggcgcaggcaaacgccaccggcttcctcccccagttctactgccgagcggggctgcctcaacctggtgggcgccgcgcccgaaaacaccccccgggcgggcggcgttcggtgcctgctcttacaaggggtgaaaccccatcgtccaccccgtctaccgatccttaggcctgctttgggtcgggccgggggcgggagatgggtttaactccctccaaaacccttgcttcaaagggggaaaccagccacacccgggtgggaggacgggctccccaagtcccccaaaccccccccgggccccccggggggctgagtctcccggaagggcaattgtccccccccc

SEQ ID NO: 55244 - protein, 86 aa, Zea mays
  misc_feature: Ceres CLONE 1486527
MRMSCNGCRVLRKGCSDACTIRPCLQWIDRPEAQANATGFLPQFYCRAGLPQPGGRRARKHPPGGRRSVPALTRGETPSSTPSTDP

SEQ ID NO: 55245 - DNA, 667 bp, Zea mays
  misc_feature: Ceres CLONE 1486532
  misc_feature: Encodes the peptide sequence at SEQ ID NO. 55246
atagctggagctccccgcggtggcggccgctctagaactagtggatcccccgggctgcaggaattcgcacgagaccattacctagaacatcctaatcgaaaaaaaaaaccctataggctatagcggcagggagaaagtgagcacccacctcaacccgcccgccgccatggcgctccgccgcatcacaccgcggaggagacccgttctccccgtcccccgtgccttctcctcgagtccgccgtttcctccacccccgcctccggcgaacgaccccgaccccgacgccgcccaacccccatcctcttctccgccccctaattccggcgcgccgcggaacccggagtcctcgttcttccaggacatcaaagatcgcctccgttcgtctcccacgtctccgtctccgcgccggatcctgacgaccctgccccgccccgaccctgcgcgcggcgctccttcttcgggaccgcccattggagacatccgccggatgctccagaacttccgcttaaccggctcaaccagggacgcgccctccacctccgctcccggatccaacccctccttcatggacctgctccagaaccacttggaccagggtgccaccgccccgcaaggggagctcggcttcaatgccatcggagagagccccaaagccccccctcccccc

SEQ ID NO: 55246 - protein, 34 aa, Zea mays
  misc_feature: Ceres CLONE 1486532
MDLLQNHLDQGATAPQGELGFNAIGESPKAPPPP

SEQ ID NO: 55247 - DNA, 702 bp, Zea mays
  misc_feature: Ceres CLONE 1486535
  misc_feature: Encodes the peptide sequence at SEQ ID NO. 55248
  misc_feature (702)..(702): n is a, c, t, g, unknown, or other
aaagctggagctccccgcggtggcggccgctctagaactagtggatcccccgggctgcaggaattcgcacgagaccattacctagaacatcctaatcgaaaaaaccaccacactacaactcgacaccgagaaaagcgcagcaaagcaacgcaaagcccacgccgctacagtgctacagcgagcgagcctcttgcctgccgctacgagccaacgactcgaacgcatacactccaatggcagcgacggtgatggcctccatgagccccctcgcctccgccaccccaggcgcgcgtcgcgctttccctgtacggctgctgctccaggcatctgcactcgcgccgcgccgtcgcgccttggccgtgaccttaagggcccccagccacgacggcggggggggagggaaaggaggatgtggcccctggccccccccccggcaccaaagtcaatggcgggggcgagggcgagccccgggcttgagggacgcctcgggcgttcagcgggcgcgggttcccgagcggcatcaaccgtccgcctcctcatgggggggacctggcggggcggggctcgggccgcctaaggcggccccccggggggggggcttcccctcgccggagcgcggtatggaggttccgggcctcccggggggcctcccgcgccgccgggtgggcgtggcttcgcctgggggggtcccctggcgtcccn

SEQ ID NO: 55248 - protein, 43 aa, Zea mays
  misc_feature: Ceres CLONE 1486535
MAGARASPGLEGRLGRSAGAGSRAASTVRLLMGGTWRGGARAA

SEQ ID NO: 55249 - DNA, 649 bp, Zea mays
  misc_feature: Ceres CLONE 1486536
  misc_feature: Encodes the peptide sequence at SEQ ID NO. 55250
aaagctggagctccccgcggtggcggccgctctagaactagtggatcccccgggctgcaggaattcgcacgagaccattacctagaacatcctaatcgaaaaacacaggaaaagaaagggcatatcgaggaggtttttagggtggtggtggtgttgtgaggagctgctgccgctgctctccagtctccaccgatggcgatcaacaacatgacggtggcggcgacgacgcggtcgctggacgccgacatgaccgtggacgagttcaaggagtggctgcggcggttcaacacggaccacgacgggcgcatcaaccgcgacgagctgcggcgcgctctgcgtgccatccgctcccggctcacggggtggaggagcatgcacggcatcagtaatgccgacactgaccgcgacagctacatcgactacagcgaggacgatggcctcatcaagttcgcgcacaacaacctcggcctcaagatcgtcgcctactgatctcacatggagcgcggcgcgcggcactctgggggtgtgacccactatctcgccatgagctagctatagcgacaatgcaactcaacatcactctctccagctcaaataagagctgcttgatctatcatcgcttgactgggtaaattgctttccccgtacc

SEQ ID NO: 55250 - protein, 98 aa, Zea mays
  misc_feature: Ceres CLONE 1486536
  misc_feature (23)..(51): Pfam Name: efhand Pfam Description: EF hand
MAINNMTVAATTRSLDADMTVDEFKEWLRRFNTDHDGRINRDELRRALRAIRSRLTGWRSMHGISNADTDRDSYIDYSEDDGLIKFAHNNLGLKIVAY

SEQ ID NO: 55251 - DNA, 704 bp, Zea mays
  misc_feature: Ceres CLONE 1486538
  misc_feature: Encodes the peptide sequence at SEQ ID NO. 55252
  misc_feature (31)..(31): n is a, c, t, g, unknown, or other
  misc_feature (32)..(32): n is a, c, t, g, unknown, or other
  misc_feature (57)..(57): n is a, c, t, g, unknown, or other
tttgttttaaaagtatccggggggtttctcnnccttttggggttttggtgggcgggncgcaaaggtggaactcccaggaggaggaggtaagatcgtcaactagaggatcccccgggctgcaggtttcctcacgagagcattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgagaacggcgggtgcaagtgcggcggcaactgccagtgcgacccctgcaactgcggcaagtgagctaggtgctccaccctgcaggccggccggaggaagctagctaattataaagcttaataaagtatagcggcgtcgctgtgtgtgtttcgagtcagtcagtcagttgcgtgccatggcatgctctgaatctgagatgatgatgatggctgatggcggcgtcgtgtcctcccctggcctcctggggggcttctggcgagcagcgtgttgagttgtgtgggtgccat

SEQ ID NO: 55252 - protein, 82 aa, Zea mays; identical to SEQ ID NO: 43085
  misc_feature: Ceres CLONE 1486538
  misc_feature (1)..(80): Pfam Name: Metallothio_2 Pfam Description: Metallothionein

SEQ ID NO: 55253 - DNA, 701 bp, Zea mays
  misc_feature: Ceres CLONE 1486541
  misc_feature: Encodes the peptide sequence at SEQ ID NO. 55254
  misc_feature (364)..(364): n is a, c, t, g, unknown, or other
  misc_feature (471)..(471): n is a, c, t, g, unknown, or other
  misc_feature (554)..(554): n is a, c, t, g, unknown, or other
  misc_feature (628)..(628): n is a, c, t, g, unknown, or other
  misc_feature (698)..(698): n is a, c, t, g, unknown, or other
caaagctggagctccccgcggtggcggccgctctagaactagtggatcccccgggctgcaggaattcgcacgagaccattacctagaacatcctaatcgaaaaatggagagaggctaccggcacagcctagccatgcacggcctgaacctgctcatagccgggccggcactgtggtgcctggggtctgtgcaaaacatctgccagttctacgagcgtgcgagcgggcacgtccagctcctgcagaagagcgtgcagatcccgctgctgctggggagcaccctcttcctcatcgccggcatcgtcaaccggcacgaccgccgcagccgccactccggcttcgtgctactggggaggaactgggcntggttctgcctgttcgggagcctcctcttccttgccgagcggctgctgaacctactcaaggtgttcaagacgcagcagatgggcggccggggcctggagaaactgcncggtggctcgcaaggaccgctgggccttagagcgggtagggcaaggtgccccctcatcctgaaacacggaaaccggcggccgnaaggggccctgcaaatacccccgccgccccgcccgggtcttaaaagggaaccctctcctcttataagcccccanactgggaaccacaaaatggcctgtgcagaagcctcaaccattttagcgttggaaacgtacccccacgcgnttt

SEQ ID NO: 55254 - protein, 232 aa, Zea mays
  misc_feature: Ceres CLONE 1486541
  misc_feature (157)..(157): Xaa is any aa, unknown, or other
  misc_feature (185)..(185): Xaa is any aa, unknown, or other
  misc_feature (209)..(209): Xaa is any aa, unknown, or other
KAGAPRGGGRSRTSGSPGLQEFARDHYLEHPNRKMERGYRHSLAMHGLNLLIAGPALWCLGSVQNICQFYERASGHVQLLQKSVQIPLLLGSTLFLIAGIVNRHDRRSRHSGFVLLGRNWAWFCLFGSLLFLAERLLNLLKVFKTQQMGGRGLEKLXGGSQGPLGLRAGRARCPLILKHGNRRPXGALQIPPPPRPGLKREPSPLISPXTGNHKMACAEASTILALETYPHA

SEQ ID NO: 55255 - DNA, 652 bp, Zea mays
  misc_feature: Ceres CLONE 1486548
  misc_feature: Encodes the peptide sequence at SEQ ID NO. 55256
gaaagctggagctccccgcggtggcggccgctctagaactagtggatcccccgggctgcaggaattcgcacgagaccattacctagaacatcctaatcgaaaactgttcgccagagccaagcccctagtagccacctcgctccagaagctttcctcccctagatctccctcccgtgcccggtcgcgctgccgacccggccatggcgaccaaggggaagctcggggagctagtgtgggagcaccgggtgcaggcggccgcagcggtggctttcgtggccgcggccgccgtctcgatctccgccgtcgggcccaggctcggcgccgtggtgtcattcttctggccgctgctcgtctccacgggcctcttcctggtggcggtcgccgtgctgctccggatctcgccgccgcccgcgggcgacgacgacgagtccggcaaggagctcatcgacttcgtcgccgggtgccgcccggagcacctcgtcccggatgcggcgccgccggcggccgtagcccccgtggaggctccgcccgagctgcagatctaacgggctgccggaggaggaggctgacagcagcctagctgtgctgtgtgctgctgcgttgcatggcgtgctccgtccccgggtgaacttcctccagtggcacgggtgag

SEQ ID NO: 55256 - protein, 114 aa, Zea mays; identical to SEQ ID NO: 42026
  misc_feature: Ceres CLONE 1486548

SEQ ID NO: 55257 - DNA, 658 bp, Zea mays
  misc_feature: Ceres CLONE 1486553
caaagctggagctccccgcggtggcggccgctctagaactagtggatcccccgggctgcaggaattcgcacgagaccattacctagaacatcctaatcgaaaaacgctccaaccctagcatcttctgcctgcctcggcacccgggcctttgccttgtgaacaaaagtcgtcgcgttcctcttggctgatgaaatcctcttctcgtctagatctgagcctccgcctgtctttcggatcagatgcttggtccgatcgaacaacggtgagtcttgctctgttatttgattgttctaaacgcatggttttgtttttgtgatgatgtgcaggttccgatctgtttcgtttgattgatgagttgacgcatcggctcgaaacgaggctgcatggtttttgtgcctggaggtttctgattaacctatttaaggaaactggatgccacaatttgttgctagaagtgctccatcccgtcaattgatatctgccgagctgcgacgttccgggggatctggatcttagcggactggacatttgggaggcgtcaaacgggcttctaaagcgtgggggggagacaatggagggggaaaaaggatacctgaaaaaacaagtgaagaggtgacattcttgaaggcgctttgccatgttgggggtcccctcgcca

SEQ ID NO: 55258 - DNA, 666 bp, Zea mays
  misc_feature: Ceres CLONE 1486554
  misc_feature: Encodes the peptide sequence at SEQ ID NO. 55259
atagctggagctccccgcggtggcggccgctctagaactagtggatcccccgggctgcaggaattcgcacgagaccattacctagaacatcctaatcgaaaagtccccgtctcaccgcactgccttgccccctactctgcctcgcttagcttagccgccgctgctacgcactctcgccgtccttgttcccgcgtcgactctgctcgcgatggcgtcccgcgttgcagtgctgctcatggccgtggcggccgtgctgttcgccgcggcgtcggcgcaggagatggacctgggcgtgccgcccgcgccggcgcccgacacgagcgcggcagcgggggccgcggcgtccgtcctagccgtggcttgctctgccgtcttcttcatcctcgtcgccggtggcctcgtgcagtaggagctgccgtccacatggaggctaactgctggttcggggtcagggagaaccctgttcgatcgttttcgccttagttagtagtagaagtagcagtcatgggctgtgttgattgtgtccctgtctccccctggtgggcgttgtgatcttgtgctatagcttattctctttggacatactgcattgttcgacatatacattgtgctgaggcgtgtgttgtatgaataaaaacgatggagcccaggccggcaataaaaaaa

SEQ ID NO: 55259 - protein, 66 aa, Zea mays
  misc_feature: Ceres CLONE 1486554
MASRVAVLLMAVAAVLFAAASAQEMDLGVPPAPAPDTSAAAGAAASVLAVACSAVFFILVAGGLVQ

SEQ ID NO: 55260 - DNA, 661 bp, Zea mays
  misc_feature: Ceres CLONE 1486566
  misc_feature: Encodes the peptide sequence at SEQ ID NO. 55261
aaagctggagctccccgcggtggcggccgctctagaactagtggatcccccgggctgcaggaattcgcacgagaccattacctagaacatcctaatcgaaaaattttccgcgcttctctccttcgctcttttcttttttctccaaaccatcgtcggctgcggcactcctgaagggaggaagccccaagcccttgccgccgcagctgccgcagccagcaacgaaccgtacataggcagggacgaagcgatggagggagccaatggagtcggtgagtcggagtccgagcggaagccgctgtcagaggtggtcggcgactgcgtccagcgctggttccaggacgcgtacaaggaggcgcgcaaaggagacatcgccaaccaggtgcttgtagcgcagatgttcttctcgggttatgggacccccaagaacgagtacaagggaaaacaatggatggatagagcatcaaggttcaggtcttccgctttgaaggttggcatgaaacgtccaggatacaatgcaagtgactcagactctgatgacgatgcaaatgatgacgccaaccaataacactcagttacaaattgagttattagttaggagattcacagggtaagggagtttggcatacactccttttcacggtgtctgatacatactcccctg

SEQ ID NO: 55261 - protein, 105 aa, Zea mays
  misc_feature: Ceres CLONE 1486566
MEGANGVGESESERKPLSEVVGDCVQRWFQDAYKEARKGDIANQVLVAQMFFSGYGTPKNEYKGKQWMDRASRFRSSALKVGMKRPGYNASDSDSDDDANDDANQ

SEQ ID NO: 55262 - DNA, 693 bp, Zea mays
  misc_feature: Ceres CLONE 1486568
  misc_feature: Encodes the peptide sequence at SEQ ID NO. 55263
atagctggagctccccgcggtggcggccgctctagaactagtggatcccccgggctgcaggaattcgcacgagaccattacctagaacatcctaatcgaaaaatctggaaatcagaatacaaataaatcaaccgagcgaagtatagagtaaagacaagccagcggcctttcgcattcaacaaacgaagcgatgtcatatgatccgacacaacggtgcactggcagagggactggacagggcctccctccgcactcctggctgtgctcttctgcgccaggcagggctacgggacgctgcaacggtcgaccggggcacagtgtgcacgtagtgctgctcctgatcctccggcgccacgagcacgggctcctccgactgggtgacgaacgccgacatcggctgcctctgcagcagctacgtagtaatccattccaagaaacgccatagttccggtgccccaaggccatcccttccgtgctgcaacctcacaaactgcatgtggccggacatggagaactcgactgcgctatacggacaccaaacctacttcttggaccacacagaatacatccgctacattacccaggttcttcctcctctgaacgtgttagttctatactatgagtaggtatacgatatgaagcccagctctgctagccagcgggacattctatatatgtctttgcaactaagaa

SEQ ID NO: 55263 - protein, 39 aa, Zea mays
  misc_feature: Ceres CLONE 1486568
MENSTALYGHQTYFLDHTEYIRYITQVLPPLNVLVLYYE

SEQ ID NO: 55264 - DNA, 626 bp, Zea mays
  misc_feature: Ceres CLONE 1486585
atagctggagctccccgcggtggcggccgctctagaactagtggatcccttgggctgcaggaattcgcacgagaccattacctaaaacatcctaatcgaaaaataccccgccagccgtcatcccctctgaccaaaccctagccggtcatggggtggggtggccccgcctcccgggccgtccttgccgccgtccgccgcccaaccgcatgcgcccacggccgcacgcctccacgccccgcgacctttcgcgggcccgcgccgcagcgtcccgtccgacttcgccacctcctcactcccatccgcgcggcctctggatgctatgatagggtcaccggtgacggtggccgcggtgatggctcgtctcattcgcgacccaggagccaacgcgccggcgtactgaggactctcccagggtacttcaagctgctgtgtagatcccatccatttagaaacgataaaaggtgtctttttttattgggggggggtttcggtggctgtccacctcaattggcggctccggcggccacccgtcctggaaagaagtagccggcgccacttacaaccgacaaagctgtggcttcacaaaggggctcccaaatgctaggtcgtgatttctgcacccctta

SEQ ID NO: 55265 - DNA, 730 bp, Zea mays
  misc_feature: Ceres CLONE 1486586
  misc_feature: Encodes the peptide sequence at SEQ ID NO. 55266
  misc_feature (719)..(719): n is a, c, t, g, unknown, or other
ctcagctggagctccccgcggtggcggccgctctagaactagtggatcccccgggctgcaggaattcgcacgagaccattacctagaacatcctaatcgaaaaacggatcgaaaacgaattaccctcggtgccctccctctcggcggcggcggcgcaagtccccttcatctccggcgcggcaaatggcaggtggcagggttgcacatgctaccctcaagggccccagcgtggtgaaggagatcttcattggactgaccctgggtctgatcgctggaggtatgtggaagatgcaccactggaacgagcagaggaaaactagatccttctaccacatgcttgacaagggccagatcagcgtcttcttctaggagtagttgcgagagggggggcgcggaatttttttttttcaattattccccccccccccactctggaagcgcaccacaaatcgaatgcctgggcagaattggccttgcaaaaaaacacaaaccatttgaaaaacaccacctccccgttgaaattgtccttttccttgtcatccacaattttgaaccatttcccgttccgggaaccaaacccccccaaccccctcaaccagaattgtataaagtaaaccttttccctctttaggaagaaaaaaaaaaaacgactacccataacaacccccaccccccacggccggcaaccaaaccacacattattatatagtaatagtgangcctcgcccga

SEQ ID NO: 55266 - protein, 61 aa, Zea mays
  misc_feature: Ceres CLONE 1486586
  misc_feature (2)..(62): Pfam Name: COX5C Pfam Description: Cytochrome c oxidase subunit Vc (COX5C)
  misc_feature: SWISSPROT Homolog: EC 1.9.3.1 Cytochrome-c oxidase
MAGGRVAHATLKGPSVVKEIFIGLTLGLIAGGMWKMHHWNEQRKTRSFYHMLDKGQISVFF

SEQ ID NO: 55267 - DNA, 702 bp, Zea mays
  misc_feature: Ceres CLONE 1486608
  misc_feature: Encodes the peptide sequence at SEQ ID NO. 55268
aaagctggagctccccgcggtggcggccgctctagaactagtggatcccccgggctgcaggaattcgcacgagaccattacctagaacatcctaatcgaaaaaatcgcgccgccgctcgagcccctctcgcccttcgcgccgccgccgctgcaggcaaccgtcgccgccgtcgccgccgtcgccggagctaaacccctcgcctgacgccatggggcgcatgcacagccgcggaaagggtatctcgtcgtcggcgctgccgtacaagaggactcccccgagctgggtcaagaccgccgtcgctgatgtcgacgagttgatcacgaaggctgcgaagaagggtcagatgccctcgcagatcggtgttctgctccgtgaccagcacggtatcccccttgtgaagagcgttaccggaagcaagatcctccgcatcctcaaggctcatggcctggcgccggaaatcccagaggatctgtactttttgattaagaaggctgtggccattaggaagcatcttgagaggaacaggaaggacaaggactccaaattcaggctcattcttgttgagagcaggatccaccgtcttgcccgttactacaagcgcaccaagaagctcccgcccacctggaagtacgagtctaccactgccagcactctggtggcttaggagggctcttcatctggtgtgctcttaccggcttcag

SEQ ID NO: 55268 - protein, 151 aa, Zea mays; identical to SEQ ID NO: 49684
  misc_feature: Ceres CLONE 1486608
  misc_feature (1)..(60): Pfam Name: Ribosomal_S13_N Pfam Description: Ribosomal S13/S15 N-terminal domain
  misc_feature (65)..(151): Pfam Name: Ribosomal_S15 Pfam Description: Ribosomal protein S15

SEQ ID NO: 55269 - DNA, 682 bp, Zea mays
  misc_feature: Ceres CLONE 1486609
  misc_feature: Encodes the peptide sequence at SEQ ID NO. 55270
aaagctggagctccccgcggtggcggccgctctagaactagtggatcccccgggctgcaggaattcgcacgagaccattacctagaacatcctaatcgaaaaagaacttgcgaattcggtattgagaatttgcgataccgatctgggagaagagaagggcgtcatgtcgtcgttcggacgcaattcatggtgtatcctcgtgctggcctccgtgctcctcctgtcctgcctcgccgacacggccgtggccaagcgaacaggcgagctcaccgtcttctggggccggaacaaggaggagggcacactgcgtgaggcctgcgacaccgggctctacaacaccgtcatcatctccttctacagcgtgttcggccacggccgctacgccctcgacctctccggccacccgctggacggcgtcggcgccgacatcaagcactgccagtccctgggcatcccggttttcctctccatcggcggcgggggaaaccactactccatcccttcctccgcgtccgcggaggccgtcgcggacaacctgtggaacgcgttcctcggcggcggcaacagcgacgtgccccgccccttcggtgacgcggcggtcaacggcatcgacttctacatcgacgaccacagcgcaccgggcgaccactacgacgagctcgcgcgccgtctcgactacttc

SEQ ID NO: 55270 - protein, 173 aa, Zea mays
  misc_feature: Ceres CLONE 1486609
  misc_feature (33)..(173): Pfam Name: Glyco_hydro_18 Pfam Description: Glycosyl hydrolases family 18
  misc_feature: SWISSPROT Homolog: EC 3.2.1.14 Chitinase
MSSFGRNSWCILVLASVLLLSCLADTAVAKRTGELTVFWGRNKEEGTLREACDTGLYNTVIISFYSVFGHGRYALDLSGHPLDGVGADIKHCQSLGIPVFLSIGGGGNHYSIPSSASAEAVADNLWNAFLGGGNSDVPRPFGDAAVNGIDFYIDDHSAPGDHYDELARRLDYF

SEQ ID NO: 55271 - DNA, 673 bp, Zea mays
  misc_feature: Ceres CLONE 1486618
  misc_feature: Encodes the peptide sequence at SEQ ID NO. 55272
aaagctggagctccccgcggtggcggccgctctagaactagtggatcccccgggctgcaggaattcgcacgagaccattacctagaacatcctaatcgaaaattctatgttctcggggaacttcaaattcacagctctgctgccggcaactcccagtcccagcccaaagaagcctgtgcgatgaactgccgtggtacgtccacatttcacgcgaagatttagaaaacagcaggatcggtggatacctgctgttctctcagcagtataaataacaggcttcttccagcagttgtttactctggggtccccacgattcaaacccttttgatggatatacttcgttccagataggaagtttgttttgttaatctctagtctcgagtatttgctctaggagaccacccaccagaacggagccttcttgtcgccggaccaggcatcgattcgcacactgtatgaggcgatgctgaaagaaaaaaaaaggaaggcagcaccgatgttcggtcattaatatgcagtttctttcggctgcatgtgtctcttatgtagagtaaaactaatttattctcgcatatagaatgatactataccggacatcaattgatgatgtgaaccgtatgcaagatcatcgccatctactgtagtatgtgacagtgtaagttgtttttttttt

SEQ ID NO: 55272 - protein, 73 aa, Zea mays
  misc_feature: Ceres CLONE 1486618
KAGAPRGGGRSRTSGSPGLQEFARDHYLEHPNRKFYVLGELQIHSSAAGNSQSQPKEACAMNCRGTSTFHAKI

SEQ ID NO: 55273 - DNA, 696 bp, Zea mays
  misc_feature: Ceres CLONE 1486619
aaagctggagctccccgcggtggcggccgctctagaactagtggatcccccgggctgcaggaattcgcacgagaccattacctagaacatcctaatcgaaaagttaacatcccttgaggcctaccctaggcagcacaccaaatggggcaaccgccctgccgccggggagcattcaatcgtcggcggcacaccgtcccccattcttcccgttccccaacgtgaagtggcaccatggtcgccactcgccacgcgctcgccgcaggagcaggagcagcgactgcgggccagccagcctccggttgggtagctgttctgcgcaacagcccgagggcgcggatggagggaccaaacaggagcggaggggaaggcaggcggtacaactgatgagcgggtacctgttctacgatagcggtcgcttcagacacgaaagatgttcttgcgagggacatgctgatcatcgccttcgagtaagatgctccaaccatgaggagcataggcacaactagcagggagagcaggccgacctcccaacagcacgcgaaggcaacaatgatagcaactaagaacgtggagaagtttgacatgaagtgacccatctggagaaagcaataataagccaatttttttttttacttctctttggttagctagtgactcttgcaagtgacatattatgaggaggaagaggaaaatcaa

SEQ ID NO: 55274 - DNA, 678 bp, Zea mays
  misc_feature: Ceres CLONE 1486626
  misc_feature: Encodes the peptide sequence at SEQ ID NO. 55275
caaagctggagctccccgcggtggcggccgctctagaactagtggatcccccgggctgcaggaattcgcacgagaccattacctagaacatcctaatccaaaaaagccacaccaggcacgccagcctcactcactccccagaccacctcacacgcacgaagcagcagcagtggactggactagctctaggtgggcaacatgaagcttcaggccaccgccagagttgctggcctcctcttcttcctcgtcctcctcctggcgctgccttccctccgcgtctccatggctggatcagggttctgcgacggcaagtgcgcggtgaggtgctccaaggcgagccggcacgacgactgcctcaagtactgcgggatctgctgcgccacctgcaactgcgtgccgtccgggacagcgggcaacaaggacgagtgcccatgctaccgcgacatgaccaccggacacggcaaccgcaccaggcccaagtgcccctgatgatattcattccttcgctctgtcttgcatgcgtatatgtaatgttgtataggctgtgcaatgcatgcatacatgatacatgccgtgactctggatcggcggatgcctatgcatgcttttcactagctgctgctactactactactcttcctgtcttcctactgtgtgcaccaaagtgagagggacgac

SEQ ID NO: 55275 - protein, 96 aa, Zea mays; identical to SEQ ID NO: 46259
  misc_feature: Ceres CLONE 1486626
  misc_feature (6)..(96): Pfam Name: GASA Pfam Description: Gibberellin regulated protein

SEQ ID NO: 55276 - DNA, 677 bp, Zea mays
  misc_feature: Ceres CLONE 1486694
  misc_feature (659)..(659): n is a, c, t, g, unknown, or other
  misc_feature (677)..(677): n is a, c, t, g, unknown, or other
atagctggagctccccgcggtggcggccgctctagaactagtggatcccccgggctgcaggaattcgcacgagaccattacctagaacatcctaatcgaaaaactcggccatcgcatggatgcatgtcttctctggccggatctgttaccctcgcccatccctagggatcgcgcggcgtggtccttgtccgtgctcggccagatcagactgccaaccatggcgttggtccttcaacatatacgtgtcagatcgcccgagctctatcttcctcaggatcaccctgcgcgcgttcctgccccatgacaaaatcacccgaagctccctgcctgctcgagctaacacaggctgcaagcttgccaaactgcacaggatctgcactctttctccagccgtacatactccactccagatcccttgccatccgcatggttgcctctccttggtgcccttcatgcacgaactccatctctgctggcacacctgatattcagacatcacccttgaccgacgccctccccatattctacacgtactctagctggacaacgtgcgaagcgaagggtgtggatcaaagcaacccacgagacgatgttgaccgatgatcctgtaactagatggactaagctggtgtccgaataacacttgatcgtcagatggncatcagctaacactttan

SEQ ID NO: 55277 - DNA, 703 bp, Zea mays
  misc_feature: Ceres CLONE 1486700
caaagctggagctccccgcggtggcggccgctctagaactagtggatcccccgggctgcaggaattcgcacgagaccattacctagaacatcctaatcgaaaagtttgtttctgcccctccgccggtcagaggtatcgtttcatgccccaccgtcccttcctcccccctgggccgagacctccacgtctcacattctggtgcgtaccctccacaggagtaccacaagtctcctctcctcctcccccaccgtctctggggacgtgctcctggacgacgtcgaggcgatctctggcgttcccaacaccgctcacagcctcgataccggcggctatccacgtatacctcctcttgcgtcctaacctcatgagcggatggacggttatcctatgcgactgccctcctccaccttcaactacactgggttagattcggctccctcctcatagggtctacctccaagcgagtcaggaagaagaccttcaactttgtcagctgcctatccatcaagtgtaaccacctgccacgcgtctacattaatcgcctactcgaagaattgattgactaaaccgccaaccgccatcctaattagctcgactagacctttgtcagcataaagccatatgattgagccgtcgaaggctgatcctctaccgactgaggcggacaaatatctagagaattaccgcacgcatgctgagatcc

SEQ ID NO: 55278 - DNA, 704 bp, Zea mays
  misc_feature: Ceres CLONE 1486703
  misc_feature: Encodes the peptide sequence at SEQ ID NO. 55279
  misc_feature (704)..(704): n is a, c, t, g, unknown, or other
aaagctggagctccccgcggtggcggccgctctagaactagtggatcccccgggctgcaggaattcgcacgagaccattacctagaacatcctaatcgaaaaaaccaggggttttgctagggttctcatcctgccgccacagcgatggccgctgccgccgccggcgaggacgacgcggcgtgggagcgcgccatctccgccgccaccaagtccacctcggcgcccaagaccctcaccctcgatggcgccgtcaagtcctccacgggcggcctcccctccgccgcgctcctcgagcgcttcgccgcctccctcgaggagctctccgtcgcgggggcgcgcctctcctcgctcgcgggcctgccccgcctcccggcgctccggcgcctctccctccccgacaaccgcctctcgggggccgccgccctcgccgccgtcgccgaggcatgcggcgccacgctgcgccacctcgaactagggaacaaccggttcgcggaggtccaggagctcgcgccactcgcccggggtccggggcgagtcgctcgacctgtttcagtgccccgtcacccaaggccaagggggaccggggatgaggtctttcgcgctgaattccagccccccagtaccctcgtggggggctgacgctggagggcaaacgagcgtttgggaaaccggatgacaaccaccaaccaggaaggagggccgan

SEQ ID NO: 55279 - protein, 164 aa, Zea mays
  misc_feature: Ceres CLONE 1486703
MAAAAAGEDDAAWERAISAATKSTSAPKTLTLDGAVKSSTGGLPSAALLERFAASLEELSVAGARLSSLAGLPRLPALRRLSLPDNRLSGAAALAAVAEACGATLRHLELGNNRFAEVQELAPLARGPGRVARPVSVPRHPRPRGTGDEVFRAEFQPPSTLVGG

SEQ ID NO: 55280 - DNA, 702 bp, Zea mays
  misc_feature: Ceres CLONE 1486734
  misc_feature: Translation starting site: 330
aaagctggagctccccgcggtggcggccgctctagaactagtggatcccccgggctgcaggaattcgcacgagaccattacctagaacatcctaatcgaaaactttttttctgtttctttttctccccctccagccgcccgtcctctcggtctccgaccacgactgtgcgccttcctaagtaaccctagctcggcgccctccctccgcgacatccaagcccggcaatctcatcgtcgcgcttgcaccgttacgcagtgcgacctctgcgtcttcgaatccaggaaggtagagaggaggaggaggtttgtggcaggatttgaccagcccaatggttccatccgagatggggagcgtcgccaccgccgtcagcacgcctgctgcggacaagctgctccatgggcctatctctggcaagaagtgcaagaaaccaggcccgaggaaagatcataaggctgagagggagaagcttaaacgagaccacctaatgatctctttgttgagctggggtatatgctagaagcagatagacagaacaatgggaaagcatgcatactgactgacactactcggaaactaagaaaccctgcttgttcagtaaaatctcttccaaaggaaattagcgaccttcaaaacgaatttccatttgtaacaatggaaaaggattaaattccggataaaaaccgctggccccccaaaaaatt

SEQ ID NO: 55281 - DNA, 682 bp, Zea mays
  misc_feature: Ceres CLONE 1486745
  misc_feature: Encodes the peptide sequence at SEQ ID NO. 55282
  misc_feature (519)..(519): n is a, c, t, g, unknown, or other
aaagctggagctccccgcggtggcggccgctctagaactagtggatcccccgggctgcaggaattcgcacgagaccattacctagaacatcctaatcgaaaacaaggaaacagtcacgtctcccagatctaactccccccgactcacgaatcccagagagcctccatggcgacgcaccgccactgcctcccactcctcctcgtggccgccgccctcgccctcgccgccgtccctgctcgcgcggcgctgggcggcgggcgcggcccgctgctgggcgggtggaacccgatccctgacgtgagcgactcgcacatccaggagctaggcgggtgggcgctggggcaggcgaagcaccagaagctggccgccgacgggctgcggttccgccgcgtggtgcgcggcgagcagcaggtcgtgtccgggatgaactaccgcctctacgtcgacgccgccgaccccgccgggcgcaccgtgccctacgtcgccgtcgtgtacgagcaggtctgggaccgcacccgncagctcgcctccttcaacccggtgccccgcgccccctgaaaacatacggacacgggtgggccgaagcgaccacgacgatgttctccgtcaattacgtgtcgagctaatcttattatgggttcaattattataataatgcttcctcctggttctatgggactaa

SEQ ID NO: 55282 - protein, 130 aa, Zea mays
  misc_feature: Ceres CLONE 1486745
MATHRHCLPLLLVAAALALAAVPARAALGGGRGPLLGGWNPIPDVSDSHIQELGGWALGQAKHQKLAADGLRFRRVVRGEQQVVSGMNYRLYVDAADPAGRTVPYVAVVYEQVWDRTRQLASFNPVPRAP

SEQ ID NO: 55283 - DNA, 690 bp, Zea mays
  misc_feature: Ceres CLONE 1486759
  misc_feature: Encodes the peptide sequence at SEQ ID NO. 55284
aaagctggagctccccgcggtggcggccgctctagaactagtggatcccccgggctgcaggaattcgcacgagaccattacctagaacatcctaatcgaaaaattcaacaccccacgacagtcggagacgcctccggattcagctcggcttctagccgccacttgctctacgcaccgcgagcgcgtgcgtgagtgcgcgccccccgagcgacgatggccgccgcactgccaccgtggacggcggccgccctggcgacgctggagctcctgtagatgctatcgtcggccgcggcacccgcccctggcctgtacaccgggagagactgacagagcgctcacgctatattctacaggggcagcgacgcctccggcaccatgttgggcacaagcgggaacggtaacctgttcagccgagggtactgggtgaactacacgacgctcagcacggcactgttcaatcagggccacacgagcggcacctgcttcgagatacggtgccagaacacactggagtgggcgaggtgcctcccaggcaagccgttgatacttgtcacagccagcaacatatgtcctccaaactagcctctctcctacaactacagcggctggtgaaacacgacccgccaattaatgaagcatgctctgaccatgatcctcaacattgcgcactatgatgccgactattccatg

SEQ ID NO: 55284 - protein, 68 aa, Zea mays
  misc_feature: Ceres CLONE 1486759
MLGTSGNGNLFSRGYWVNYTTLSTALFNQGHTSGTCFEIRCQNTLEWARCLPGKPLILVTASNICPPN

SEQ ID NO: 55285 - DNA, 682 bp, Zea mays
  misc_feature: Ceres CLONE 1486761
  misc_feature: Encodes the peptide sequence at SEQ ID NO. 55286
aaagctggagctccccgcggtggcggccgctctagaactagtggatcccccgggctgcaggaattcgcacgagaccattacctagaacatcctgatcgaaaaaccacaaccagtcctcacataatcatcttcattcactcactctcttcgatcactgtactgaagataccatggccaagtcgaccgcgatgtttgtagccgccctggccctggtggtggtgatggcgacgacgagcacaggcggtggcagggcggcagcggcgtgcgatcccaagccgctggtggtgtgcgatccggcgttcatggacggagcgaaacccgcggcagcatgctgctccaccctgcgtgcgcaggaggcatgcttgtgcgtgtacgccaaagaccccaagtttgcaaaatacatcaacaaccccaacaccgccaaaacctttacctcgtgcggcatagccatccccaaatgctaagcaagcgctctgcgtcgtcgcttcgcttgctcttgctcttgtgtgtaacatatccagcttatgaataaattatgtggatcagttaattagtgggatgaagatgcatgtttattaaaaaaaaaaaaaaaaaagcttatcgataccgtcgacctcgagggggggcccggtacccaattcgccctatagtgagtcgtattacgcgcgctcactggccgtcg

SEQ ID NO: 55286 - protein, 97 aa, Zea mays
  misc_feature: Ceres CLONE 1486761
  misc_feature (40)..(97): Pfam Name: Tryp_alpha_amyl Pfam Description: Protease inhibitor/seed storage/LTP family
MAKSTAMFVAALALVVVMATTSTGGGRAAAACDPKPLVVCDPAFMDGAKPAAACCSTLRAQEACLCVYAKDPKFAKYINNPNTAKTFTSCGIAIPKC

SEQ ID NO: 55287 - DNA, 683 bp, Zea mays
  misc_feature: Ceres CLONE 1486773
  misc_feature: Translation starting site: 437
  misc_feature: SWISSPROT Homolog: EC 1.4.1.2 Glutamate dehydrogenase
  misc_feature (375)..(375): n is a, c, t, g, unknown, or other
aaagctggagctccccgcggtggcggccgctctagaactagtggatcccccgggctgcaggaattcgcacgagaccattacctagaacatcctaatcgaaaaaatcactgtggtcatctcgctaacgctttcctcttggacagttccacttctctgctggccatgccacaacgctactgcggcggcggctgcttcgccggcctgccggccaccccctcctgtaacgcgctcatcaattcaagtaagataggcagcgagcggcgcgctcttaccatcaagatcgatctgggcactacttactcctacgtcggagtctggcataatgggggcgtcaaggtcatcaacaatgaccaaggcaaccgaaccaccccatgntacattgccttcaccggctccaggctcctcgtgggggatgctgcctacaaccagcccgaaaatgaaccacagcaacacaatcttcgattcccaacgactcattggtataagatatagcgatgcttctgtacatagtgacattaagcactgccccttcaaggtcattcatggacctgatgacaagcctatgatatgtgtacaataccggggtgcagagcagcactttgcagcagaagaaatctcctcagatggtcctcgacaatatgagggagattggtgaagcatatcttggcacactgtcaaggatg

SEQ ID NO: 55288 - DNA, 543 bp, Zea mays
  misc_feature: Ceres CLONE 1486778
  misc_feature: Encodes the peptide sequence at SEQ ID NO. 55289
  misc_feature (312)..(312): n is a, c, t, g, unknown, or other
  misc_feature (524)..(524): n is a, c, t, g, unknown, or other
  misc_feature (525)..(525): n is a, c, t, g, unknown, or other
  misc_feature (531)..(531): n is a, c, t, g, unknown, or other
aaagctggagctccccgcggtggcggccgctctagaactagtggatcccccgggctgcaggaattcgcacgagaccattacctagaacatcctaatcgaaaaagtagcatccaattgattgttctatcctcttctctgttctcacccccttgcaagcaacaatcgttcaccgatcgatccagtgcgtcctgtatggaaactgccgccgtcgccgccgccggtgccgggcgccgcatcatggtggccgtggacgagggcgaggagagcctgcacgcgctcaactggtgcctcgccaacgtcgtctccccggcnagaggcgacacgctggggtgctcgtccacgccccgccgcccgggggcccggtttaacccccccccttgggcaaacgccccccagggggcaactaataaaccctaaaatggttgggaaaggcttaaaagggcccccacaaccgcggtttctggggggggggggggtgtaaaaaaaagaaaacaaaaaaaaatttttttttttttttgggggcnnaaaggncacccccccccc

SEQ ID NO: 55289 - protein, 74 aa, Zea mays
  misc_feature: Ceres CLONE 1486778
METAAVAAAGAGRRIMVAVDEGEESLHALNWCLANVVSPARGDTLGCSSTPRRPGARFNPPPWANAPQGATNKP

SEQ ID NO: 55290 - DNA, 677 bp, Zea mays
  misc_feature: Ceres CLONE 1486792
  misc_feature: Encodes the peptide sequence at SEQ ID NO. 55291
  misc_feature (454)..(454): n is a, c, t, g, unknown, or other
aaagctggagctccccgcggtggcggccgctctagaactagtggatcccccgggctgcaggaattcgcacgagaccattacctagaacatcctaatcgaaaaagactcaggacacagcattcattcttctagcgagggagagagaggggaacatagaggaggggtgaggaggacagggagccaagcgcacgacctgaaggttctgagcgaaaccgcagacctgcgtgccgccccgtcgcctccacggtgtcgacgtcgaacgctctgcgatccgagatgtataagctggggagaggaaacctcgacgaggtgcagcaggacctgaccattaccggcgcctgcgagaaggttgtccttctcggactgaaggcgagtgattggcacttggaaagagcttttgacttcttctataacctacctcatgtatctgaggacaagactccgcatcttgaanatcttatccacatatatccatagcctgatgcagatgtgatctgggtggacggaatatctccattttgcgataatctgcatgatgatcctcatgatattgtcatgcttgtgatatcatggcgcgtgatagccgacacattgtgcgaatttgctcataaggaattcattgtgggactgccatcagatgcggcagatttatcgataacgtgcgtcgtatgatacca

SEQ ID NO: 55291 - protein, 66 aa, Zea mays
  misc_feature: Ceres CLONE 1486792
  misc_feature (60)..(60): Xaa is any aa, unknown, or other
MYKLGRGNLDEVQQDLTITGACEKVVLLGLKASDWHLERAFDFFYNLPHVSEDKTPHLEXLIHIYP

SEQ ID NO: 55292 - DNA, 655 bp, Zea mays
  misc_feature: Ceres CLONE 1486797
  misc_feature: Encodes the peptide sequence at SEQ ID NO. 55293
  misc_feature (447)..(447): n is a, c, t, g, unknown, or other
  misc_feature (543)..(543): n is a, c, t, g, unknown, or other
  misc_feature (559)..(559): n is a, c, t, g, unknown, or other
  misc_feature (562)..(562): n is a, c, t, g, unknown, or other
  misc_feature (570)..(570): n is a, c, t, g, unknown, or other
  misc_feature (571)..(571): n is a, c, t, g, unknown, or other
aaagctggagctccccgcggtggcggccgctctagaactagtggatcccccgggctgcaggaattcgcacgagaccattacctagaacatcctaatcgaaaaattgattgatcggacggacgcgcgtctccggtcccgtccgtaataacactgatccgatccacgccggccggcgatggagctcatcaagtccagggcgaccgtgtgcgcgctcctcctggcgctgctcctgctctcacactacgacggcgggacgacgacgacgatggtggcggaggcccgggtgtgcatgggcaagagccagcaccactcgttcccctgcatctccgaccgcctctgcagcaacgagtgcgtcaaggaggacggcgggtggaccgccggctactgccacctccgctactgcaggtgccagaaggcgtgctaagcaaagctcttcaaacacccttnggcttgccagaactgaactctagtagtactaagtaacacccttggctagctgtgcacaacctacgtaccgtgcatgcatgtaatgtgggtgtcatngtaaacgtgacaggcnatnaaataggnnttttattattattaaaaaaaaaaaaaaaaaaaaacttttttttttacccccccaacccccagggggggggggccccgggccccc

SEQ ID NO: 55293 - protein, 82 aa, Zea mays; identical to SEQ ID NO: 41020
  misc_feature: Ceres CLONE 1486797
  misc_feature (36)..(82): Pfam Name: Gamma-thionin Pfam Description: Gamma-thionin family

SEQ ID NO: 55294 - DNA, 623 bp, Zea mays
  misc_feature: Ceres CLONE 1486798
gagctccccgcggtggcggccgctctagaactagtggatcccccgggctgcaggaattcgcacgagaccattacctagaacatcctaatcgaaaaattccgatcactcgctgctcccctctctcgccggagcgagtcccgggccggatggcggctgcagctgcagctcctcccgtcgtctcgatcgctgtgatggactccaacgccaatgccgccgcgatcctcctatggacgacgccggaagggcttctcctctcacgcccgagattttgtacgtctctcgcactggctcacccgcgcctagccagcaatccgacaagagcggcggcgactagttctctgtctcttgcggccgggttatataaactacgggcatcctgccaaccagggattgggccacttagatcgaagcgacatgcactttgggttactcccgggctaccatgctacccggctgaaatactgcgtcggacttgctgcgaaaatcggccttggatgcaaagacttcctccttctgataagaaaccggccttttccccttttggagattaagggaaaaattcctttaaaaaggggttccaccccccccgggccttttttaacttggggcccgaaaccgttcaa

SEQ ID NO: 55295 - DNA, 723 bp, Zea mays
  misc_feature: Ceres CLONE 1486829
  misc_feature (46)..(46): n is a, c, t, g, unknown, or other
  misc_feature (51)..(51): n is a, c, t, g, unknown, or other
  misc_feature (59)..(59): n is a, c, t, g, unknown, or other
  misc_feature (61)..(61): n is a, c, t, g, unknown, or other
  misc_feature (462)..(462): n is a, c, t, g, unknown, or other
  misc_feature (506)..(506): n is a, c, t, g, unknown, or other
  misc_feature (520)..(520): n is a, c, t, g, unknown, or other
  misc_feature (521)..(521): n is a, c, t, g, unknown, or other
  misc_feature (529)..(529): n is a, c, t, g, unknown, or other
  misc_feature (530)..(530): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (545)..(545): n is a, c, t, g, unknown, or other
  misc_feature (557)..(557): n is a, c, t, g, unknown, or other
  misc_feature (561)..(561): n is a, c, t, g, unknown, or other
  misc_feature (602)..(602): n is a, c, t, g, unknown, or other
  misc_feature (608)..(608): n is a, c, t, g, unknown, or other
  misc_feature (610)..(610): n is a, c, t, g, unknown, or other
  misc_feature (627)..(627): n is a, c, t, g, unknown, or other
caggctggagcttcttgcggtgggcgccgctctagactagtggatnccccnggctgcangnattcgcacgagaccattacctagaacatcctaatcgaaaaagaaccgatccttacagagagacacacccagcgcgcgagatatctacatcgatcatcatcaccagcgagcgagccggccgagcagcaccgatggcggcgtacatgcgcgtgacgcaccgcgacgaggaaggcaagaaggtgacggagaagatgccggtcccggagacgcggcgcccggacacggccatatccttcgagcggaagctggaggagcagggcctccaccgcttccagcggcacccggcgaaagcgccccggggggtgggtttccgcgccccggttggggaagtccggtcctcctctcttagtcgtcctgggaccccccccgccccccccgtcacaccccagcatcgatgcgggnggcggccggccctcgaccccccatccgccccggctacgaggtanaccctgccgggggnntccctgannagnnnncggccttgnttatcggcacanggtncgacggtcccaccgtgtggtgacgacccgccgcgcccccgnccgccntncacacgaggcgccgtantccacagggccccaccatctcgaccacccctcccccgcggccccccccccgcggccgccgacacgcgcctcgcacccaccccccccccccaagtcg

SEQ ID NO: 55296 - DNA, 673 bp, Zea mays
  misc_feature: Ceres CLONE 1486835
  misc_feature: Encodes the peptide sequence at SEQ ID NO. 55297
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (441)..(441): n is a, c, t, g, unknown, or other
  misc_feature (639)..(639): n is a, c, t, g, unknown, or other
aaagctggagctccccgcggtggcggccgctctagaactagtggatcccccgggctgcaggaattcgcacgagaccattacctagaacatcctaatcgaaaaactcactcgggagtcgggtcctcctcgactcagctcctccacaaacaaagccaccaccatcccaacccaaacacatcggccgaccacgggcgccgccatgtccaccgctgacgcggcgagcccggccctggcgccggactgggacgcgccggcgggcgaaggcctggccctggcccagttcgccgcgggctgcttctggagcgtggagctggtgtaccagcgcctcccaggcgtggcgcgcaccgaggtggggtagtcgcagggggaccnnnnnnccccccccctttttggaaccctttgggaaaaggacggggcaccccccaaatggggccccctggncttccaacccccagggcctaaccccctacaaagtccctcctcaacgtccttctggggccgagcacaacccccaccaccctcaaacagacaggggaaacgaacttcggggacgcagtaacccggggggggggttttcctactttccccggcaaaaaaagaaaaaacttggggccccgcgggtcccttggtttgcaaatnaaaaaagaaagggcggggggggccgccctccccc

SEQ ID NO: 55297 - protein, 52 aa, Zea mays
  misc_feature: Ceres CLONE 1486835
  misc_feature: SWISSPROT Homolog: EC 1.8.4.11 Peptide-methionine-(S)-S-oxide reductase
MSTADAASPALAPDWDAPAGEGLALAQFAAGCFWSVELVYQRLPGVARTEVG

SEQ ID NO: 55298 - DNA, 679 bp, Zea mays
  misc_feature: Ceres CLONE 1486847
  misc_feature: Encodes the peptide sequence at SEQ ID NO. 55299
  misc_feature (376)..(376): n is a, c, t, g, unknown, or other
  misc_feature (384)..(384): n is a, c, t, g, unknown, or other
  misc_feature (580)..(580): n is a, c, t, g, unknown, or other
aaagctggagctccccgcggtggcggccgctctagaactagtggatcccccgggctgcaggaattcgcacgagaccattacctagaacatcctaatcgaaaaagctcctctgcttctggcgaccaaattctgccgtctccaccgccgccgcagccagcgtcaccggagggatctgccgtctcccttgctccacgcgatgaacaccgacatcaccgcctcgactaagccggagtacccggtggtggatcggaacccggccttcaccaaggtggtcggcaacttctctgcgctcgactacatgcgcctctccaccatctccgccgtctccgtcaccgttggctacctctccgggatcaagccggggatccggggcccntcaatggncacgggcggcctcatcggggtcatgggagggttcatgtacgcctaccagaactccgccgggcgcctaatgggattctttcccaacgacgccgaggttgcgcgctacaagcacaagcttcattgaggatccagctccattccgtctctcttttcgcaaccgtttcggctgttccttttcctgattccgtgttaactncagtactttatctgggcactctatggccttgttaaaataaaaaatggtatggttgttgccccggttatgaaggatccatgataaattcaccctcattct

SEQ ID NO: 55299 - protein, 103 aa, Zea mays
  misc_feature: Ceres CLONE 1486847
  misc_feature (63)..(63): Xaa is any aa, unknown, or other
MNTDITASTKPEYPVVDRNPAFTKVVGNFSALDYMRLSTISAVSVTVGYLSGIKPGIRGPSMXTGGLIGVMGGFMYAYQNSAGRLMGFFPNDAEVARYKHKLH

SEQ ID NO: 55300 - DNA, 526 bp, Zea mays
  misc_feature: Ceres CLONE 1486855
  misc_feature (182)..(182): n is a, c, t, g, unknown, or other
  misc_feature (195)..(195): n is a, c, t, g, unknown, or other
  misc_feature (221)..(221): n is a, c, t, g, unknown, or other
aaagctggagctccccgcggtggcggccgctctagaactagtggatcccccgggctgcaggaattcgcacgagaccattacctagaacatcctaatcgaaaaagttccaaccccagctcctcagttctcgtcatcgtcctcgcgctcagtgtcatttgcagttcccggtagcagccatgggncgtcggtgcagcntgtctgggcccgccgggtgggtggcngcctgcgaaaaaccgggctgctttgggcgggggtccctccctgaaccccccgtccccttttggggggtgcccaaaagggggggcgaaagaggccccaaggggcccccccgggggggagaggggcccccccccggggggggggcccccccaaaagaaaaaccccccccaaaaaaaaaattttgggggagaaaaaaaaaaaaaatttttttgaaaaaaaaaaaaaaaaaaacaccccccgggggggggggggaaaataaatttttgtgtgggggggggggggggggggttttttttttcttctctcc

SEQ ID NO: 55301 - DNA, 500 bp, Zea mays
  misc_feature: Ceres CLONE 1486858
  misc_feature (161)..(161): n is a, c, t, g, unknown, or other
  misc_feature (173)..(173): n is a, c, t, g, unknown, or other
  misc_feature (266)..(266): n is a, c, t, g, unknown, or other
caaagctggagctccccgcggtggcggccgctctagaactagtggatcccccgggctgcaggaattcgcacgagaccattacctagaacatcctaatcgaaaagtgagttgtgttggctggccctcgactagcgtgttgtagcgcactagcgccacagtanatcgagagtgcntttcccaggtcgaagggtggtgtaggtgttttggcggacagtcgggcgttgatctgagagagagatggtgtgctgtggtgggccacaacgtcngacccgggggtcccatttggggccccccgcccgcccttttttcttccctttgcccggatggcccccgcccccccttcccaggggtgggaggttttcccagggggaatttttattttgaaaagggggggtaaatttttccccaaaaaaaattttttttcccccgggggggggggaacccccgggggagaaaggttttttttgagggagattttttctccccataaaaaaaaaaac

SEQ ID NO: 55302 - DNA, 647 bp, Zea mays
  misc_feature: Ceres CLONE 1486872
  misc_feature (290)..(290): n is a, c, t, g, unknown, or other
  misc_feature (291)..(291): n is a, c, t, g, unknown, or other
  misc_feature (294)..(294): n is a, c, t, g, unknown, or other
  misc_feature (320)..(320): n is a, c, t, g, unknown, or other
  misc_feature (344)..(344): n is a, c, t, g, unknown, or other
aaagctggagctccccgcggtggcggccgctctagaactagtggatcccccgggctgcaggaattcgcacgagaccattacctagaacatcctaatcgaaaaaatccatcagtacccaatctcccctacaccagaaaaattcccagttcttttggtccgcgtcagagaggcggcggcgatgtctgggcgcggcaagggcggcaagggtctggggcaagggcggcgcgaagcgccaccgggagggtgctcccgcgacaacatccaggggcatcaaccagcccggcgatccnngangctggcctagagggggtggcgtgaangcgcatcttcgggcctcatctacnaaggagaccggcggcgtgcctcagatcttttttgaagaaagtatttccgggaagccgtgcacttacccaagaaagcgcccccaaaaacccgtgacccccatgggaatttctttttaccccttaaaggccccggggacgcccccctttcgggtttttggagggtaaggtttaggccccccttttttattccgcgggaattgttttagggagaacaccccccctggggagacggctttccggggggaaattttgggcccaaaaaacccgggggaacacccccctttctccaaaaaaaacccccca

SEQ ID NO: 55303 - DNA, 621 bp, Zea mays
  misc_feature: Ceres CLONE 1486882
  misc_feature: Encodes the peptide sequence at SEQ ID NO. 55304
  misc_feature (516)..(516): n is a, c, t, g, unknown, or other
ctagctggagctcaccgcggtggcggccgctctagactagtggatcccccgggctgcaggaattcgcacgagaccattacctagaacatcctaatcgaaaactagcagatgtcagcccacgacgaggacggcggccgccgccgcaggacccttgccaaggtttcactctcgttggtctcgagcaccatggcggaggcctccacctactccttagacgcagttaagacgcgccacctctagctccaccacagccccggcggcgcgggcgtgcgcggcgtaatccgggtcgcggccgagctcctccgaaatagcgggggtttaacgggggcttaacccccttccgttctccgccacctgatgtacacccgcttttgcttcgtgggggttcagggatctttggttcccccttcgtttgtattttgcccccccacggccttttttgggaaggggcccccccgggggaactttcagggtttgctcgccaaggggaatggggctggcttttggtaaagcccnaattggaggggggggtttggttcttggaaggctttggttggggggctttaaaattctgaattcccaaccggggggaaatgtggaaaactttctttataaccactc

SEQ ID NO: 55304 - protein, 43 aa, Zea mays
  misc_feature: Ceres CLONE 1486882
MSAHDEDGGRRRRTLAKVSLSLVSSTMAEASTYSLDAVKTRHL

SEQ ID NO: 55305 - DNA, 688 bp, Zea mays
  misc_feature: Ceres CLONE 1486896
  misc_feature: Translation starting site: 154
  misc_feature: SWISSPROT Homolog: EC 1.11.1.7 Peroxidase
  misc_feature (688)..(688): n is a, c, t, g, unknown, or other
ataagctggagctccccgcggtggcggccgctctagaactagtggatcccccgggctgcaggaattcgcacgagaccattacctagaacatcctaatcaaaaaaaacaacactcgacgtacacacggccatctatcttggtcgagaaaagaagatggcgactaagctggcggcgctcatcgtcttggaggcgttcctcggcgggcccccggcgtgcgagggcgacatcatttgcttcaacggctggctgacgctacccatccaggacccgcgcctctgtcctccgggatccaggtccatgatcaacggccgtacgcgagcgctagtgccggtgcctcctccctcggggttagggctcggcctcggctactacaacaacaggagctccacgacgacctactgcccgagagcggaacgcacccccacggatgccataagcaaggccgctcccgcgcaacctggcatcggtgcgagcctcatccgactcttcttccacgactgcttcgttcggggctgcgatgcttcggtcctcctcaccacgaccaactccgaacacaccgacaccgacagggaaggccaccaaacaagaacagcctgcgagggttagaggagatctacttcgccaaggacaagatcgaggccgcctgccccgggagagtctcatgcgccgacatcgtcccctacgccan

SEQ ID NO: 55306 - DNA, 690 bp, Zea mays
  misc_feature: Ceres CLONE 1487064
  misc_feature: Encodes the peptide sequence at SEQ ID NO. 55307
aaagctggagctccccgcggtggcggccgctctagaactagtggatcccccgggctgcaggaattcgcacgagaccattacctagaacatcctaatcgaaaaatcatccgatctcgtcctctacaacctcgtccccgctccccaaaccctaaaccctcccccaccacacgtcaccgccgcccccgatctctccatctccaccgccgtcgcggcggcgccagaacccgtcatccgcggccgggttcgccgcacggtgggctcctcttccgccgaccgccacgccaaggtcgccggccgcggccgccgggtccgcatcccggccatggtggcggcgcgcgtcttccagctcacgcgtgaactcggacaccgcaccgacggagagaccatcgagtggttgctgcgccaggccgagccttccataatcgccgccaccggcaccggtgtcacgaccgaggaggcgccgtcgtctctcgtccccgtctcctccatcgcgtcctcagtgtcccttacgccggtcccgtactacaccgcgctcctcatgcaaccaccgcccaccgccaatgagtcccctgtcgcctctgcatccgtatctggcactgttgcggaggagaataacaactaggctaggtggaagaggattatcaaatggcagttaggctcaaagttagttagtggttagggtttattatg

SEQ ID NO: 55307 - protein, 99 aa, Zea mays
  misc_feature: Ceres CLONE 1487064
  misc_feature (1)..(91): Pfam Name: TCP Pfam Description: TCP family transcription factor
MVAARVFQLTRELGHRTDGETIEWLLRQAEPSIIAATGTGVTTEEAPSSLVPVSSIASSVSLTPVPYYTALLMQPPPTANESPVASASVSGTVAEENNN

SEQ ID NO: 55308 - DNA, 807 bp, Zea mays
  misc_feature: Ceres CLONE 1487069
  misc_feature (37)..(37): n is a, c, t, g, unknown, or other
gtggggcccccgcgcgtcccccgcggggttgtttttnagagaggtggggggccaaagctggagctccccgcggtggcggccgctctagaactagtggatcccccgggctgcaggaattcgcacgagaccattacctagaacatcctaatcgaaaaagatgtatcagatgcgtgctgcgcttatgcctgctcccccacgaggtgagggtctcctctctgccgagtctggcgggaatctcaccctccgatcggtggggggtcgtctctaggccaccatcagcctcgtcggccagatctggctgtggtcgacgcgcccggatctgccggacggcgacgcgtggcgccccacccccgcggatgacgacgacgggcgactcgcctgctctcccaggtagcatggcctgatgacaatgagcgcgtaagggactccagttggcggaacgagatgcaacctcctcggaggggagctggtgataaggcccccccccccgtcgccatgagttttcgatcggatccgacatgcccttccgctctccacagggccgccccgattgcctagattgccctccggcgcgctgtcacgactaaaatggatgcgagcgcgtccgcggaggtatttggcctggaagggggcctgtatccaaggcgtggggtgtatgtgcagaagacgggcgctgatgcctccaggctttggtgggtatggcgtcctatttcacttccctacctcgttggccggtgaggatgagaatggtggagcaggtatccgggacttccgggggggaaacttctaggctcgccggtgtaggat

SEQ ID NO: 55309 - DNA, 697 bp, Zea mays
  misc_feature: Ceres CLONE 1487071
  misc_feature: Translation starting site: 230
  misc_feature: SWISSPROT Homolog: EC 2.7.1.91 Sphinganine kinase
caaagctggagctccccgcggtggcggccgctctagaactagtggatcccccgggctgcaggaattcgcacgagaccattacctagaacatcctaatcgaaaaaggcacaaggatgcgctgtctgctgctgctggtggccggttccaccctggcgtcgcggctgcggggcgtcttccaagtgtgccacaagttcccgccggagtcgaaggggtgccggtgccaacaccaatgcccttcgtgcccacgacggccgccgccacagccgcctcctcacggctgccgacctcccgctcggcggcctcagcctccccactaatacaaggccggccaaagaaattgttcattatagtgaacccttatggtggaaagagaagcggaccgagtattttccagaatgaagtcctccccctcattgaagcttctggcgtgctttatacgatgcaagaaaccaagcatcgccttcatgctcaagagattgcacattcacttgatcttaggaagtatgacggcatcatttgtgtcagtggagatggtgtgatgggtagaggttgtcaatggtctcctgcaaagggaggactgggaagcagcaataaaagtgccccttgggatcattccagcaggtactggaaatggaatggcacgatctctactgcatgctgctggtgaaccattctatatatctaatgctgtgttcgc

SEQ ID NO: 55310 - DNA, 654 bp, Zea mays
  misc_feature: Ceres CLONE 1487073
  misc_feature: Encodes the peptide sequence at SEQ ID NO. 55311
  misc_feature (511)..(511): n is a, c, t, g, unknown, or other
  misc_feature (532)..(532): n is a, c, t, g, unknown, or other
  misc_feature (590)..(590): n is a, c, t, g, unknown, or other
  misc_feature (593)..(593): n is a, c, t, g, unknown, or other
  misc_feature (599)..(599): n is a, c, t, g, unknown, or other
  misc_feature (602)..(602): n is a, c, t, g, unknown, or other
  misc_feature (605)..(605): n is a, c, t, g, unknown, or other
  misc_feature (608)..(608): n is a, c, t, g, unknown, or other
aaagctggagctccccgcggtggcggccgctctagaactagtggatcccccgggctgcaggaattcgcacgagaccattacctagaacatcctaatcgaaaaaaaagaaatatccaattcctcaccctaccccctcgctgctttctcctccccgtcgacctcgccaatcttcctcccgctaaccctagtccagcacccgagatctactccgcgcaaacagccatggcggagacgctcgacatgaccctcgacgacatcatcaagaacaacaagaagagtaacccctcgtctcgcggggcccgccgcagccgcggcgtatccgcccctggcggcgggaccggcggggtcgggccgaccaggcgcccctttaaaagggctgggaacaggcaggcgccctaccagccgccgaaggtacgaacgaatcgaacgggctgttgctccgcgtcgcccggcggaggatgcgggtgcttcggacttcgctgagtcgggcgggaggagaaggtctggtggntttctcactgtggtgtgacgncatcgatccaggcccccgacgctgcgtggcagcacgacatgtacccctgcggtcgccncangaagcngcngcngcngcgggaggggtctcgctctcgagacggggcgcaagctctacatctc

SEQ ID NO: 55311 - protein, 86 aa, Zea mays
  misc_feature: Ceres CLONE 1487073
MAETLDMTLDDIIKNNKKSNPSSRGARRSRGVSAPGGGTGGVGPTRRPFKRAGNRQAPYQPPKVRTNRTGCCSASPGGGCGCFGLR

SEQ ID NO: 55312 - DNA, 694 bp, Zea mays
  misc_feature: Ceres CLONE 1487077
catagctggagctccccgcggtggcggccgctctagaactagtggatcccccgggctgcaggaattcgcacgagaccattacctagaacatcctaatcgcaaaccagtattctggaccatagtatattcaatctcagcttacaagattctcatgattatcacacagtgactattcagtgatgaagaaaatcgttcagtcactacatgattgatctgtagtcatcaaagtttttaaaataacctgagaatagtataggcatcttgtaatagtggaacaattaatgctagagaccaaacttccagtatggatgcagagacaaaggaattgatgtgcatgtttattcataagcttacatttcagacacacaaaggtcatgaacggaagcagtctctaggtttcaactccacaatgaatttctgaacgaaacaagtaaactgtggctgtcttacgcaggatttgtctgtgtgcgaggattcgacatggagactagagcaccaaggcctctgtgcccccatttgcacattatagcaaggccgaaggcccgcaagacagcagcaactgagcaagtactctaatcagcaaagatatcagttttatgaacatcatgtttattgtgatatgacatcaatagctctcgacctatgcatggaatcatattacttcctgcctggcgatggccattgtttaggaaat

SEQ ID NO: 55313 - DNA, 697 bp, Zea mays
  misc_feature: Ceres CLONE 1487083
  misc_feature: Encodes the peptide sequence at SEQ ID NO. 55314
acaagctggagctccccgcggtggcggccgctctagaactagtggatcccccgggctgcaggaattcgcacgagaccattacctagaacatcctaatcgaaaaaagtctcgtgcaggcgaaggacgtacgacgacgcggacgcaccgtcgaagtctacaggctgcgcaatccctttctccctcttatccccaaggcgaggagctgagggggggcccttctgctgctgttcttgtttccccgctctccaagatgtcgtccccgagcaagcgccgcgagatggaccttatgaagctgatgatgagcgactacaaggtggagatggtgaacgatgggatgcaggaattcttcgtcgaattcaaggggccggccgaaagtatctaccaaggcggtgtctggaaggttagggtagaactgcctgatgcatatccttacaaatccccgtccatcggcttcatcaacaagatttatcacccaaatgtcgatgagatgtctggctctgtatgtttagatgtcataaaccaaacatggagcccaatgtttgatctagtaaatgtttttgaagttttccttccacagctgttactatatccaaatccttctgatccattaaatggggaggctgcagcactgatgatgcgtgatcgtcctgtttatgaacagaaagtgaaagaatattgtgagaagtatgccaaacca

SEQ ID NO: 55314 - protein, 149 aa, Zea mays
  misc_feature: Ceres CLONE 1487083
  misc_feature (7)..(143): Pfam Name: UQ_con Pfam Description: Ubiquitin-conjugating enzyme
  misc_feature: SWISSPROT Homolog: EC 6.3.2.19 Ubiquitin--protein ligase
MSSPSKRREMDLMKLMMSDYKVEMVNDGMQEFFVEFKGPAESIYQGGVWKVRVELPDAYPYKSPSIGFINKIYHPNVDEMSGSVCLDVINQTWSPMFDLVNVFEVFLPQLLLYPNPSDPLNGEAAALMMRDRPVYEQKVKEYCEKYAKP

SEQ ID NO: 55315 - DNA, 696 bp, Zea mays
  misc_feature: Ceres CLONE 1487090
  misc_feature: Encodes the peptide sequence at SEQ ID NO. 55316
aaagctggagctccccgcggtggcggccgctctagaactagtggatcccccgggctgcacgaattcgcacgagaccattacctagaacatcctaatcgaaaaggatgattgatgattctgacgagagccgagaactgtcgcgggctcccggcggagtcagctccagagcgctgggcacacggcacagaaaattgcggccttctctgctactcctgcctgcccggggcctgctctggctgcctactagagccgcatgaacgcggagtacagggcgctacagcctccatcagttacctgccgtgctctgcccacctcttccgcctatccgtggcgatcactgcggaaagcccatgctcggccatgacgcgcagcagtgggctccgcctgcgcataattatgaatgctatctgacggctctgaccatataactccgagaaggggcgcccctgcgcaacatattgcgctggatgacggccagaatgagcctgctgcacaagggttgccctccggttggctgaaaaaatgcatgcctaaaaggaaccgatatgcatccagagccaagagtgactcggtctatctggaggctaccaatggatgccaatttcactctcacaacgatgtacgccgattgtcgtgaatctcgagacgtctgcggaatgtctgacagcgccaaactcgagaacagttgatgtactg

SEQ ID NO: 55316 - protein, 78 aa, Zea mays
  misc_feature: Ceres CLONE 1487090
MLSDGSDHITPRRGAPAQHIALDDGQNEPAAQGLPSGWLKKCMPKRNRYASRAKSDSVYLEATNGCQFHSHNDVRRLS

SEQ ID NO: 55317 - DNA, 703 bp, Zea mays
  misc_feature: Ceres CLONE 1487109
  misc_feature: Translation starting site: 207
  misc_feature (46)..(46): n is a, c, t, g, unknown, or other
  misc_feature (50)..(50): n is a, c, t, g, unknown, or other
  misc_feature (212)..(212): n is a, c, t, g, unknown, or other
  misc_feature (312)..(312): n is a, c, t, g, unknown, or other
  misc_feature (315)..(315): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (400)..(400): n is a, c, t, g, unknown, or other
  misc_feature (404)..(404): n is a, c, t, g, unknown, or other
  misc_feature (405)..(405): n is a, c, t, g, unknown, or other
  misc_feature (407)..(407): n is a, c, t, g, unknown, or other
  misc_feature (413)..(413): n is a, c, t, g, unknown, or other
  misc_feature (422)..(422): n is a, c, t, g, unknown, or other
  misc_feature (444)..(444): n is a, c, t, g, unknown, or other
  misc_feature (445)..(445): n is a, c, t, g, unknown, or other
  misc_feature (465)..(465): n is a, c, t, g, unknown, or other
  misc_feature (468)..(468): n is a, c, t, g, unknown, or other
  misc_feature (469)..(469): n is a, c, t, g, unknown, or other
  misc_feature (475)..(475): n is a, c, t, g, unknown, or other
aaagctggagctcaccgcggtggcggccgctctagactagtggatncccngggctgcaggaattcgcacgagaccattacctagaacatcctaatcgaaaaagggcaggggttgcgtctcagttcctggttgtgttgttgtaagctcccaggtttcttctcttcgcgtgagctagctagactagagtgggatcgcgaggaaaaaggatgtcntgctgcggaggaaactgcgggtgcggcagcggatgcaagtgcggcagcgggtgcggagggtgcaagatgtacccgaacatggctgagcaggtgaccaccnccnccaccatcatgggtgttgcaccatccaagggcgggttcgaggcggttcttctcacctcacaagggggggggggggggggnnnccnccanntncacctncaacccctnaacttaaaaataaataaaaccnnctgcagcgtgggggggcgtnacnnataganaaattaaatcccaaaggacaccccttctgtgatttttgctgaaatcaagatcggaaaagactcttgaggcgcctccgtctgtgttttgccgccctgcgtaatcgagctaatatcgcggggggtaaacgaaaaaattccgccggtgcttttttcccccgagggcaccaggagaggggttgagtcgtttgggttcgggacggggctcatacgtaggttcgcagatcaggt

SEQ ID NO: 55318 - DNA, 763 bp, Zea mays
  misc_feature: Ceres CLONE 1487114
  misc_feature: Encodes the peptide sequence at SEQ ID NO. 55319
  misc_feature (13)..(13): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (43)..(43): n is a, c, t, g, unknown, or other
  misc_feature (44)..(44): n is a, c, t, g, unknown, or other
  misc_feature (445)..(445): n is a, c, t, g, unknown, or other
  misc_feature (729)..(729): n is a, c, t, g, unknown, or other
aggaccaaaaaantccggacaatataaaaaannnnnggagttnnttctaactggagctccccgcggtggcggccgctctataactagtggatcccccgggctgcaggaattcgcacgagaccattacctagaacatcctaatcgaaaaatcttatcccccgcctcctccggtcctcccgccgctgttgctcacttctgagtcccgacgcacgagctcccaagagctagccatggcgtccaccaccctctcctccgccttcaccctcctatcccgcccctccacctccccgtgccccgccgcctcgctcccgaggtcctcccacgccgcgccccacatccgccggggccgccgcgccgtcgccgtcgcgtgcaccgccaccgagtcccccaagatcctggagctcggggacgccatcgccgggctcacgctcgaggaggcccgcancctcgtcgaccacctccaggagcggctcggcgtcaccgccgcggccttcgcgccggccgccgttctcgcggcgcccggggcgggcggcggggcctcggccgaggaagaagccccgtcaagaaaacggatttcgacgtgatgatcgaaaaggtgcccagcaacgcgcgtatcgccactatcaaggtgggggcgcgcgctccacaaacctcgcgctcaaggaaggccaaaggaactttatccgaagggcctcccccaaaaaaggtccaaagaaaggcccttccagncaaaggaacaaaggccccaaaggaacccccaaag

SEQ ID NO: 55319 - protein, 117 aa, Zea mays
  misc_feature: Ceres CLONE 1487114
  misc_feature (72)..(72): Xaa is any aa, unknown, or other
MASTTLSSAFTLLSRPSTSPCPAASLPRSSHAAPHIRRGRRAVAVACTATESPKILELGDAIAGLTLEEARXLVDHLQERLGVTAAAFAPAAVLAAPGAGGGASAEEEAPSRKRIST

SEQ ID NO: 55320 - DNA, 680 bp, Zea mays
  misc_feature: Ceres CLONE 1487119
  misc_feature: Encodes the peptide sequence at SEQ ID NO. 55321
  misc_feature (647)..(647): n is a, c, t, g, unknown, or other
aaagctggagctccccgcggtggcggccgctctagaactagtggatcccccgggctgcaggaattcgcacgagaccattacctagaacatcctaatcgaaaaaactctgcccagctaagctaagctccctccgtccatcggcatggcgactaccactactacaatactcctcctcctcctcgtcgcagccacagccgtctcggcggccgacctctccgtgaaccacaacgtgcacacgacgtccccgtccccgctcgagtccatcatcgcgctcagccgcgccgacgacgcgcggctcctcttccctcttcaatccaaaagggaggggggcccctccaaatcgcgagggtttgaagcccctttccctacccccttttctcccgcggtgtctcgtttttaccgccgcgcagaatgagggtaattgttttaatacacggtataagagaaaactatacactagaaagtataaatgagattagaaagaaagcaaaacgcctaaatactaaatattgatccaccaccccaccgagcaagacaacgccgcagcggtccgggcgaaccaccaaaccaaaatttttaaaaatacgcccgtatcaccccacatagcgaggatgtcaagccccacgatctacccaactagaaagagnctgaaggccagcaatccacaagaaatacgaatg

SEQ ID NO: 55321 - protein, 33 aa, Zea mays
  misc_feature: Ceres CLONE 1487119
MRVIVLIHGIRENYTLESINEIRKKAKRLNTKY

SEQ ID NO: 55322 - DNA, 700 bp, Zea mays
  misc_feature: Ceres CLONE 1487120
  misc_feature: Encodes the peptide sequence at SEQ ID NO. 55323
  misc_feature (544)..(544): n is a, c, t, g, unknown, or other
  misc_feature (625)..(625): n is a, c, t, g, unknown, or other
  misc_feature (644)..(644): n is a, c, t, g, unknown, or other
aaagctggagctccccgcggtggcggccgctctagaactagtggatcccccgggctgcaggaattcgcacgagaccattacctagaacatcctaatcaaaaagggattggtcgggttcggctccgccttcggagagtcccaagagatgggtggcgcggcggcgggtaccaagtggatccaccacatccagcgcctcagcgcggccaaggtgtcggcggaggcggtggagcggggccagagccgcgtcatcgacgcctccctcaccctaattcgcgagcgcgcaaagctcaaggcagagttgctgcgtgctctgggtggcgtgaaagcttcagcgtcgctcttaggggtccctcttggtcacaactcatcctttttacaaggccctgcatttgctcctccacgcatacgggaggccatttggtgtggaagcacaaactctagcacagaggaaggcaaagaattgaatgatcctcgggtgctaactgatgttggagatgtccccattcacgagatccgtgactggtggtgtcaagatgacagattnatgcatgtaatttagtgagtctgtcaaaacagtgatggagggagagcctcttccaaccggttgttgtttagggaggggccnaaaaatattttttttttcnaaaaaatattattcttccccctctcctaaaaaaaaacccccccccccccggggggg

SEQ ID NO: 55323 - protein, 137 aa, Zea mays
  misc_feature: Ceres CLONE 1487120
  misc_feature: SWISSPROT Homolog: EC 3.5.3.1 Arginase
  misc_feature (133)..(133): Xaa is any aa, unknown, or other
MGGAAAGTKWIHHIQRLSAAKVSAEAVERGQSRVIDASLTLIRERAKLKAELLRALGGVKASASLLGVPLGHNSSFLQGPAFAPPRIREAIWCGSTNSSTEEGKELNDPRVLTDVGDVPIHEIRDWWCQDDRXMHVI

SEQ ID NO: 55324 - DNA, 768 bp, Zea mays
  misc_feature: Ceres CLONE 1487142
gttttggtcacttcttcctcacccccacaccgatctccttcaaactccaaaaggtggaactacccgaggtggaggccgctctttttcaatggatcccccgggctgcaggaattcgcacgagaccattacctagaacatcctaatcgaaaagtttccctgctgtctcgcctctctttcggttctcacggcgacgactgggcgagcgccgcctcccctccctcgctccgtgaggtcctcgccggcgacgagtgccgccgcccatttccatgttttttccgccgattagtgtccaccagatctagtgaaggctggtaacttgacgcaaggtgttcaagaaatttaagccacacactcttcatcataggcccaggcaatatttgtgttaatctcagggacctccagtagattgctgagagttatccttgatacagggaaatataaacacagaattttttgaacattgttctcgcccccaccgctgcaatgggtacaaagcttgtggttctcggtatcccctgcgatgttgacactgaagggttacgagagtacctgggcaaattttggacccctatatgaatgtgccatacatgaaagaagcggccttctgggcgaatctccagggttatggctatgtaaaatttcctcttcaccccaacaaatgcaaataaattggttcttgatttgcccacccatgttttctctgggaacccgttcccttttaacatatcgaaagatttagcctaccccccaataggcaaagaaaactga

SEQ ID NO: 55325 - DNA, 711 bp, Zea mays
  misc_feature: Ceres CLONE 1487153
  misc_feature: Encodes the peptide sequence at SEQ ID NO. 55326
aagctggagctccccgcggtggcggccgctctagaactagtggatcccccgggctgcaggaattcgcacgagaccattacctagaacatcctaatcgaaaacgcaaaccctcctaccccattccgccgcccgccccgcgaccccgaggaggaggcaagatgaagacgatcctggcgtcggagacgatggacatcccggagggcgtcacagtgacggtggcggccaagctggtgacggtggagggcccccgcgggaagctcacccggaacttcaagcacctcaacctcgacttccagctgcaggagggcggccgcaagctcaaggtggacgcatggttcggcacccgccgcaccatggccgccttcttccccgccatctccagggggcggaggggcatcaagggggtcaccaagggctaccccccccccatgaggtttgtctacgcccatttccccggcaggggcgccatcaccaactcccacaccggcatcgagataagggacttcctcggcggagaataaggtcagagagggggacttgcttgtagggcgtgacctccctccgctccaagaaagggcatggacgaccttattccccgttggcacctacgcgcagttaagaccctcctctccgccgcccccctccgaacaccaaggtcttgcgcgagagattggctaccccccccttttttggacgggtcccttttgcgag

SEQ ID NO: 55326 - protein, 120 aa, Zea mays
  misc_feature: Ceres CLONE 1487153
  misc_feature (12)..(86): Pfam Name: Ribosomal_L6 Pfam Description: Ribosomal protein L6
MKTILASETMDIPEGVTVTVAAKLVTVEGPRGKLTRNFKHLNLDFQLQEGGRKLKVDAWFGTRRTMAAFFPAISRGRRGIKGVTKGYPPPMRFVYAHFPGRGAITNSHTGIEIRDFLGGE

SEQ ID NO: 55327 - DNA, 785 bp, Zea mays
  misc_feature: Ceres CLONE 1487154
  misc_feature: Encodes the peptide sequence at SEQ ID NO. 55328
aattaccaccagcgaagctaatcaaaccctctctcaccattatccgcgcttaaactggagctcaccgcggtggcggccgctctaaaactagtggatcccccgggctgcaggaatgcgcacgagaccattacctagaacatcctaatcgaaaaaagtcaagtgttcacggtccatcctctcgagagtctaggcccttctcccgaagccgcagacgcagaaaacggctctacatatggaggcgaagaagaagccgtcggcccccaccgccgtcggagccgcgccgccgcctccgggtaacgggtacttcagcaccgtcttctccgcgccgactgcgggaagcgcaagtgacgcaaagcatgcggacttgtacacgatgctgaacaagcagagctccagagggcagaatggcagagatggcaaatcccacagccgccctacttacaaggatggcaaacatgcccatccaaatgagccatcacaatctccttactttggctcatccgtgcattacggtggtcgggagttctactgcagcgttttttcggaagcaaccagccaatgaaccccataaggaattacagggggacaacccggatggctccgctaccataagagattggggggcaaggttcacctttatttatggattaatctggtggggacctcctccccttttggggaaaaaggaaataaaaaaggggttaaaagctgaaaaaatgggtttcgtctggaaatggttggaaaactgcttgaatgcgaaagactcattctagcaaatcgagaat

SEQ ID NO: 55328 - protein, 109 aa, Zea mays
  misc_feature: Ceres CLONE 1487154
MEAKKKPSAPTAVGAAPPPPGNGYFSTVFSAPTAGSASDAKHADLYTMLNKQSSRGQNGRDGKSHSRPTYKDGKHAHPNEPSQSPYFGSSVHYGGREFYCSVFSEATSQ

SEQ ID NO: 55329 - DNA, 689 bp, Zea mays
  misc_feature: Ceres CLONE 1487161
  misc_feature: Encodes the peptide sequence at SEQ ID NO. 55330
tggagctccccgcggtggcggccgctctagaactagtggatcccccgggctgcaggaattcgcacgagaccattacctagaacatcctaatcgaaaacaatggataaaacagtacggttgtggcacatgtcaagcacttattgtttgaaaaccttctcacacactgactatgtgacttgcatacagttcaatcctgttgatgatagatacttcattagtggttccctggatgaaaaggttcgtatctggagtattccaaagcgtgaaattgttgattgggttgatcttcatgaaatggttactgctgcctgctatactccagatggaaagggcgcgctgatcgggtcccacaagggcagttgccattgtatgatacatctgatgacatgctttgctacaaacacaaattgacccgcaaaacaagaaaagaaaatgctaccacaaaaaataccaggattcaggtttgccccagggaaatcttcaatggccatatcccttctgcgaatccccaatccaaaatcctggaaggttttaaacctgtccataggttaaaaggattcggaaaacccggcacccaattcccacttttgtttaccgggaaacggacggtattttttctccggaaaagaggatatcccccgttattattcttgggaaaaaaaaaaatggttccaaaccccttttaaaaa

SEQ ID NO: 55330 - protein, 103 aa, Zea mays
  misc_feature: Ceres CLONE 1487161
  misc_feature (12)..(51): Pfam Name: WD40 Pfam Description: WD domain, G-beta repeat
  misc_feature: SWISSPROT Homolog: EC 2.3.1.48 Histone acetyltransferase
MDKTVRLWHMSSTYCLKTFSHTDYVTCIQFNPVDDRYFISGSLDEKVRIWSIPKREIVDWVDLHEMVTAACYTPDGKGALIGSHKGSCHCMIHLMTCFATNTN

SEQ ID NO: 55331 - DNA, 701 bp, Zea mays
  misc_feature: Ceres CLONE 1487166
  misc_feature: Encodes the peptide sequence at SEQ ID NO. 55332
tccccgcggtggcggccgctctagaactagtggatcccccgggctgcaggaattcgcacgagaccattacctagaacatcctaatcgaaaagatttccgatctttccgtcctcggtcttcttgatttttccttcctacctccaccggttataccacctgctagcgccgtccgccgttcctcaggaaaatcctctcacctgagtatggagcagcaccccacttgcgcccagccaccggcgccggcgcccctggctgggcctgtcgtcccggtggacttcaaggtcgtcaagaagggacccgagatggcgatgcacgacgcgatcggccgcctcgccttccgcgtcgcgggcagcgccggcggggccacggcgctccaggatgacgctggaggtgtcctggtcaccgtcaggagcagcggccagggcgagtggggagcattcagtgggaatagtttggaagagagacacatcattttcactgcaaaagctatgcctgctttcttcatgtcaagaggaggtacttgtgtcctggctcccaagaagcaccttttgaaaattcaaaacccaagctacagaactcctaaggaagtggatttcgcaagaagcgggccccaataaataaaggggggactcccttcgttgggacaagaacaaacctccttggacaatgttccaagaaaaaagaacctatttcaccgggaa

SEQ ID NO: 55332 - protein, 137 aa, Zea mays
  misc_feature: Ceres CLONE 1487166
MEQHPTCAQPPAPAPLAGPVVPVDFKVVKKGPEMAMHDAIGRLAFRVAGSAGGATALQDDAGGVLVTVRSSGQGEWGAFSGNSLEERHIIFTAKAMPAFFMSRGGTCVLAPKKHLLKIQNPSYRTPKEVDFARSGPQ

SEQ ID NO: 55333 - DNA, 713 bp, Zea mays
  misc_feature: Ceres CLONE 1487173
  misc_feature: Encodes the peptide sequence at SEQ ID NO. 55334
ggagctccccgcggtggcggccgctctagaactagtggatcccccgggctgcaggaattcgcacgagaccattacctagaacatcctaatcgaaaaagaagacgactgactgcctcgagcagcagagatcagggaggccgagggcgggatgacgatccggttcgtgctgttcgtcaacaagcagggccagacgcggctggcgcagtactacgagcacctctccctcgacgagcgacgggccctcgagggcgagatcgtccgcaagtgcctcgcccgcactgaccagcagtgttcgtttgtggagcaccggaactacaaggtcgtttacaggcgctacgcctcccttttcttcctcgtcggcgtcgacagcgatgagaatgagttagctatccttgaattcatgcatcttctggggggaaactatggatcgccccttcgggaaggtgggcaacccaatttcttgttccacggggaaaagggccttcctgttggaaaaaatgggaataatgggtgccttgggaaacaaaaaaaaaaaaatcttggccccataacactttgggagaaaactccccaaaaaaggggatcccctttgggggattttcccccccccttttaaaaaattggggggggggccccttccaaaaaatttccccccgtggggggggggggggaaaaaaacccttttaacaccggggtatttttttttccccccg

SEQ ID NO: 55334 - protein, 155 aa, Zea mays
  misc_feature: Ceres CLONE 1487173
  misc_feature (2)..(127): Pfam Name: Clat_adaptor_s Pfam Description: Clathrin adaptor complex small chain
MTIRFVLFVNKQGQTRLAQYYEHLSLDERRALEGEIVRKCLARTDQQCSFVEHRNYKVVYRRYASLFFLVGVDSDENELAILEFMHLLGGNYGSPLREGGQPNFLFHGEKGLPVGKNGNNGCLGKQKKKNLGPITLWEKTPQKRGSPLGDFPPPF

SEQ ID NO: 55335 - DNA, 677 bp, Zea mays
  misc_feature: Ceres CLONE 1487175
  misc_feature: Pfam Name: DUF500 Pfam Description: Family of unknown function (DUF500)
  misc_feature (509)..(509): n is a, c, t, g, unknown, or other
  misc_feature (535)..(535): n is a, c, t, g, unknown, or other
  misc_feature (544)..(544): n is a, c, t, g, unknown, or other
  misc_feature (609)..(609): n is a, c, t, g, unknown, or other
  misc_feature (610)..(610): n is a, c, t, g, unknown, or other
  misc_feature (613)..(613): n is a, c, t, g, unknown, or other
  misc_feature (615)..(615): n is a, c, t, g, unknown, or other
  misc_feature (616)..(616): n is a, c, t, g, unknown, or other
ggagctccccgcggtggcggccgctctagaactagtggatcccccgggctgcaggaattcgcacgagaccattacctagaacatcctaatcgaaaactttacatggaagggcttcttattatcaatctagcaccatgtaacatataagatatctgcttgactatttcaacaggctggaggtgagatagctgactttattattgttctgaggaacacggatgccatcaaaacattcagtgggaaggcacatctatctgttggtgctggtgttagcgcttctgctggccatgttggacgtgcagctgaagctgacttccgtgctggtgatggtggttatgccgcatgttatacatacagttgtagcaaaggtgcctttgtgggctgtgcgttgaatggcggcatagtatcaactagagacactgagaacgcacgattttacggaggtcctgtccaggcatctgatatccttctaggatcgacggcgaagccgcctgcagcctctcctctgntacaagctctgtcagaattatttgancagattggnaaagtatcctctctcttgcagaccctgcctcacccttgtaatacaatcgaatttgtgcccttcanngantnngttggaaacattgcccaactgtacagtaaaggcattcttcaacacgtccaatgggtttaag

SEQ ID NO: 55336 - DNA, 700 bp, Zea mays
  misc_feature: Ceres CLONE 1487180
  misc_feature: Translation starting site: 185
  misc_feature (404)..(404): n is a, c, t, g, unknown, or other
tggagctccccgcggtggcggccgctctatactagtggatcccccgggctgcaggaattcgcacgagaccattacctagaacatcctaatcgaaaactccactcgctctcccacacagaaaaccctagccgccgccaccgaagcggcctcccaggtaagcaggatcgtccagcccgccgccgccatgaagcgcaatccccgcgtcacgagctcccgccggaagtgccgcaaggcgcactttacggccccgtcctccgtccgccgtgttctcatgtccgccgggctgtcgacggagctccgccacaagtacaacgtgcgctcccatcccgatccgcaagacgactaagtgcaggtcgtgcgcggcacctacagggccgtgaggggaaagtggtggaggtgtactnccggcgccgccccaccccggtaaaggaacacccgcgaaaaggggaacggttcccccggaaaggggggacccacccccccgggggattccccccaagttaaattccccaaggaccgtaggggcccccctaaacaaaaggccgggggcccccccccaaaaggttagggggatttttttggcaaaaaatttcccccccccccccctggggggggccccaacacggcccctttccaaaaaaaaaaaaaaaattccccgcggggctttttttgtttggtgacaaactttttttttctcttt

SEQ ID NO: 55337 - DNA, 760 bp, Zea mays
  misc_feature: Ceres CLONE 1487188
  misc_feature: Encodes the peptide sequence at SEQ ID NO. 55338
  misc_feature (23)..(23): n is a, c, t, g, unknown, or other
  misc_feature (37)..(37): n is a, c, t, g, unknown, or other
gagaggggtcggtgggttggggnaggtataaaatttnaggcgtatcaataacaaagctggagctccccgcggtggcggccgctctagaactagtggatcccccgggctgcaggaattcgcacgagaccattacctagaacatcctaatcgaaaaaaaacctttcccctccctttcctttcctttcctttcctatccttgtgccctcgaatcggaaacccagccagccatgtcgtactacggcgaccggcgcgcggagtcgtcgatcgtggaggcgttcacgctgtcgccgctgccgtacccggtgatcctggtgctgctgatggtgacgctgctgctgggcgcctcgtggttcttcacgtacgacgacttcatcgaggaggcgtcgcagcagctgagctgggcgctgctgggcgtgcccatcgcgctcgtcctcctcatccgcgggatctcctccgtcgactccttcgagggctacctgggcttctacccgagggagagccgctggaagggccgctacgagcggggccccgccgaggggcagctcgccctggggcgtcccctttgctcgtcctcctaatcctcgtggtcgccagcttccaatccaccattccacgaaaagtgggggggccgtgaaaaggcccggaaggggggtcccggccccctggttcgggttccaaggaagggggcgcttggtgccataaggggttggctgccttgtgagccaatcgaaagaattcccggggtgacaaaatttaaggt

SEQ ID NO: 55338 - protein, 116 aa, Zea mays
  misc_feature: Ceres CLONE 1487188
MSYYGDRRAESSIVEAFTLSPLPYPVILVLLMVTLLLGASWFFTYDDFIEEASQQLSWALLGVPIALVLLIRGISSVDSFEGYLGFYPRESRWKGRYERGPAEGQLALGRPLCSSS

SEQ ID NO: 55339 - DNA, 796 bp, Zea mays
  misc_feature: Ceres CLONE 1487189
  misc_feature: Encodes the peptide sequence at SEQ ID NO. 55340
  misc_feature (22)..(22): n is a, c, t, g, unknown, or other
gaggcgccccctcgtgtggtancgatcaagaggggtgcctctatgtttcgtaaaactggagctccccgcggtggcggccgctctataatagtggatcccccgggctgcaggaattcgcacgagaccattacctagaacaccctaatcgaaaaaatcggccccatcactcttccgtcgtgtcttctcgcgctttccactcccaacgagatccatcacccccgacctctgtaagcttcccttgacgtcgtcgtcatcatccatggagagcaaggacggcacccacgatcccgccacgacggccgcgccaccggccggcgcgccgcagcccgcgatgccttccgcggagacggcgcggtggggcacgcggcagatgggcccgccggcggcccccggggcgcacccggataaccaggaggcggcgcggtggatggcccctcacggggaaccaagagctgacgacgtaagtaaacccccccctgtagccgaaggcggcgccaccgccacagcataagggcaaggggggaacagccccatgggagcacatcctcgaacttctttaaaaaccgggaagccacaagggccaaggagttgggcctccagcaatcagagttaaatcaggaaggacagggccactccattggtcaaaacccccagatgggggaaatgctagcgcttcggcctcgaaaggtgcttagtctgaaaaggcgggtttcgaaaaaacttggaaaaagcaaaaagttcctaaatcccgccccccaacaaagcccccttgataaaagaagatccctcctggccc

SEQ ID NO: 55340 - protein, 83 aa, Zea mays
  misc_feature: Ceres CLONE 1487189
MESKDGTHDPATTAAPPAGAPQPAMPSAETARWGTRQMGPPAAPGAHPDNQEAARWMAPHGEPRADDVSKPPPVAEGGATATA

SEQ ID NO: 55341 - DNA, 906 bp, Zea mays
  misc_feature: Ceres CLONE 1487191
  misc_feature (36)..(36): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (906)..(906): n is a, c, t, g, unknown, or other
aattatgttttttcctggtttctccacccagggatnaaaatgctttnnnnacaaagcggagctccccgcggtggcggccgctctagaatagtggatcccccgggctgcaggaattcgcacgagaccattacctagaacatcctaatcgaaaaacaagacccactgaaccctcgccgtttcgtcgcacccacgaacacaagagatgagctccggcggcgcggacaagccccggcgtggcgggggcgcgatgaagacgccgacggacttcctcgggtccatctagggtcgccccggagacgtaaagcgacactccgaggcacgacaacagaggcgtagtggtgttagtttgggctggggacgggaagaaagacaacgctacgacaccggaggaagtagcggggattggccacggctggagagcccagtaagagaaaaagcactcaacaagagggggaaccaaaacactactatcacatggaaggaaggaactaattgtgagagccccccccccccacgggattcccatcaacacaagaagaggggagataacaccaggtggcgccagcctacgcacccaggcacgcgcgcgccccggcggcaagtaaagaagagagtccctcggaggcggtgtcacgccatacagggacggccgggagaaggagagaaggaagaaaagtgaacgccggaaacccacgggagccacaccccttaggtaatgacaggagataacgtctcgcggaacgtaccggatagttgaacaaaaggacatccgtaaccagcgctctgcggcagttgtgcttgagagtgaaggccgggagctaacttcaccttcaaaccgtcgagtttataactcacacacatatcagacactcaatgagctagtgtgtgtcacggggcgacgctcan

SEQ ID NO: 55342 - DNA, 689 bp, Zea mays
  misc_feature: Ceres CLONE 1487195
  misc_feature: Encodes the peptide sequence at SEQ ID NO. 55343
  misc_feature (689)..(689): n is a, c, t, g, unknown, or other
tggagctccccgcggtggcggccgctctagaactagtggatcccccgggctgcaggaattcgcacgagaccattacctagaacatcctaatcgaaaacccgtactagttgtcgctgctgccctgttgcggcgacgactccgtgattccctagtccctacccagatcggcgcccgacgcaaggccgagcaggcgatggccgcagcgacgtcaatggggcacccttacgccagccgagctggaccttccgggtttcgtgccgctgaagctgtcccaggtcgagatcctcgtgtcctacctcggcgcctccgtcttcgttttcctcgccgtctggctcgtctccggaagatgtgtcagattatccaagaccgaccgtctgctcatgtgctggtgggcattcacagggttgacccacataatgatcgaggggcccttcgtcttcactcctgatttcttcaagaaggagaaccccaatttctttgatgaagtttggaaagagtatagtaagggagactctaggtatgttgctagggacactgcaactgttacggtcgaagggatcaccgctgtattggaaggccctgcatcactacttgctgtctacgctattgcatccaggaaagtctttcagccacattctcccagttcgccctaatgtctggggccagcctctaacggttgcctggttttn

SEQ ID NO: 55343 - protein, 90 aa, Zea mays
  misc_feature: Ceres CLONE 1487195
  misc_feature (1)..(91): Pfam Name: EBP Pfam Description: Emopamil binding protein
  misc_feature: SWISSPROT Homolog: EC 5.3.3.5 Cholestenol Delta-isomerase
MCWWAFTGLTHIMIEGPFVFTPDFFKKENPNFFDEVWKEYSKGDSRYVARDTATVTVEGITAVLEGPASLLAVYAIASRKVFQPHSPSSP

SEQ ID NO: 55344 - DNA, 802 bp, Zea mays
  misc_feature: Ceres CLONE 1487201
  misc_feature: Encodes the peptide sequence at SEQ ID NO. 55345
  misc_feature (37)..(37): n is a, c, t, g, unknown, or other
  misc_feature (38)..(38): n is a, c, t, g, unknown, or other
tttttttggtctccccggcgtgcgggctttctttcgnngggagagaaaggatcaaaactggagctccccgcgggggcgggcgctctaaaatagtggatcccccgggctgcaggaattcgcacgagaccattacctagaacatcctaatcgaaaattttcggtctaaacatttcgtcgaacgccagcggcgagtcgagctcgagctcgagccccagtcaccgcagccatgctcctcacgaaaccctacctctccaactcgctccttccagtcccatccccgccgccgtcgggccctactctcagctccaaccatgcaagcccccttgccgcccctacttgccgtcgcagccgcctccgcatctccgccacatccacggctgcgccgtctccttcgtcggctgccgctgccaccgcgtcgctgagtcaagtggacgtgctctcgaaaggcgctcccctttttattcagcgattccaaggcaagacggtgggtggtcaaatactgcgagggcggccatgaaagttcccccggagctgcaggcggtccgggaatccgcggattctcggggcctggctcgccctgcggtcggggctccggccccgtggcttggttcaccgggtggaccggcccggaaaaattaatatccctggggatgatgggaagattaccgagtccaaacccgccaggtttccgctaaacggccctcccgccggttcccgggaaatccgcctccacccaatggttaaggcacgtacaaaaaatgaggtgccttaggacgctaaaaatggcccctcccgaaccaac

SEQ ID NO: 55345 - protein, 41 aa, Zea mays
  misc_feature: Ceres CLONE 1487201
MKVPPELQAVRESADSRGLARPAVGAPAPWLGSPGGPARKN

SEQ ID NO: 55346 - DNA, 785 bp, Zea mays
  misc_feature: Ceres CLONE 1487204
  misc_feature: Encodes the peptide sequence at SEQ ID NO. 55347
  misc_feature (36)..(36): n is a, c, t, g, unknown, or other
  misc_feature (37)..(37): n is a, c, t, g, unknown, or other
  misc_feature (45)..(45): n is a, c, t, g, unknown, or other
tttgtgtgcccccgcggctctttcctccctccccannaaaagttnttttaaaaactggagctccccgcggtggcggccgctctagactagtggatcccccgggctgcaggaattcgcacgagaccgttacctagaacatcctaatcgaaaaacaggctgtacgtagggccgtgccgtcgcccctccttccttcgtcgatctctctctcggcgacgactgggcgaccgctgcctcctgttgccctggtctccattgggccctttgccagattttctttcgcctctctgccggcgacgaacaccaccaccaggaatgggcttgtggacgttgctggaaggctttgtgcttcttgctctcgccctggctatattgaatgaagaccgctttctcgctcctgggggatggatcgtgtctgaagatccatgatatgggcaaccaaaagtctctaaagggtcagatggtggggacccccccatgctacacaatttctggaggatgcccttaatacacctccatggtcctgaatcattgttgtggaaactgggtgtcaggggttgaagcctcaattatcttatgatttcactggttgtgtttggaatgaatatcccgttccccgcgaagaagctaaaaccgcagctaggacctcttcgcctggctggaactattgttcagttgtttaaccgctaaatgaggaaatttcctaacctatttccttaccggggtaaaatttaattccgggcaaagaaaaaatggcctacggagacgtttttaaaaccacctcaaaa

SEQ ID NO: 55347 - protein, 37 aa, Zea mays
  misc_feature: Ceres CLONE 1487204
  misc_feature (3)..(35): Pfam Name: Yos1 Pfam Description: Yos1-like
MGLWTLLEGFVLLALALAILNEDRFLAPGGWIVSEDP

SEQ ID NO: 55348 - DNA, 769 bp, Zea mays
  misc_feature: Ceres CLONE 1487206
  misc_feature: Encodes the peptide sequence at SEQ ID NO. 55349
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (20)..(20): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
  misc_feature (50)..(50): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
ggggggttggcttnnncttntcgcagagtcccaaggatttaggggnngnntnnncaaaactggaactccccgcggtggcggccgctctataactagtggatcccccgggctgcaggaattcgcacgagaccattacctagaacatcctaatcaaaaatcaccaccaccccgcggctgcagctcagcagctccagacctcaccagaggcacctaccacaccgcccgccgccgatcccgtcacccgtctcctccccgctgcggagcgtctccagccctgcccggtgcccgcccagatggcaaacgcggcgtcagggatggccgtggacgacgactgcaagcgccggttcctggagctcaaggccaagaggacgcaccgcttcatcatctacaggatcgacgagaagaagaagatggtggtggtggagcaggtgggcaagcccatgctcggctacgacaacttcaccgccagcctccccgccaacgagtgcaagtacgccatcttcgactacgacttcgtcaccgaggagaactgccagaagagcaagatcttcttcatcgcttggtctcctgacacggcgcgccgggaggaaaaagaaggatctacgccagactccaaggaaaaggttcaaagcggggagctggaacggcattcaaggggggatcccccaggaccaccgaacttccgcccgaaaggtggggccttggacgtccatccccggggacctggaacaagctgaaggaatgccccaacccatattaaacccgcccc

SEQ ID NO: 55349 - protein, 147 aa, Zea mays
  misc_feature: Ceres CLONE 1487206
  misc_feature (12)..(120): Pfam Name: Cofilin_ADF Pfam Description: Cofilin/tropomyosin-type actin-binding protein
MANAASGMAVDDDCKRRFLELKAKRTHRFIIYRIDEKKKMVVVEQVGKPMLGYDNFTASLPANECKYAIFDYDFVTEENCQKSKIFFIAWSPDTARREEKEGSTPDSKEKVQSGELERHSRGDPPGPPNFRPKGGALDVHPRGPGTS

SEQ ID NO: 55350 - DNA, 654 bp, Zea mays
  misc_feature: Ceres CLONE 1487207
  misc_feature: Encodes the peptide sequence at SEQ ID NO. 55351
  misc_feature (654)..(654): n is a, c, t, g, unknown, or other
ggatcccccgggctgcaggaattcgcacgagaccattacctagaacatcctaatcgaaaactcttcttcctccgtcctccgacctccgagatttgaaaccgtgctgcgaatcccccactcataaaattgaccactcgtcctcccccctgcccgtcatcatgcttaatctctctccagtttcccccagttcccgtttccatctccatcctcccccccgggagcaggagctgcagccaggagtcgagtcggcgtcgtcacgggagatatcagcttcgctatcaccggatccccctctgctccctccgcacctcccatctgcgctctctgttttcttccgcgcaccccggctgttggtgtcccgtccggcagcgttgctgccccctgaatccgagcctttgaagggtctgctgccgccgccgccgccgctgtcaccgctcttgagatctctttattgatctggagagattaaaagagggattcttgccttcctactggaacaagagaaaggggagaacgtgtttcttcaagcgtggttgatcagtgaggaacggaaaacaatgcgaggttcgggatttaaaattgtctggctttaggggccgttcttctgaaacaggggacgggcgattcaaccacccgagctcaaatctgattaan

SEQ ID NO: 55351 - protein, 98 aa, Zea mays
  misc_feature: Ceres CLONE 1487207
MLNLSPVSPSSRFHLHPPPREQELQPGVESASSREISASLSPDPPLLPPHLPSALSVFFRAPRLLVSRPAALLPPESEPLKGLLPPPPPLSPLLRSLY

SEQ ID NO: 55352 - DNA, 732 bp, Zea mays
  misc_feature: Ceres CLONE 1487303
  misc_feature: Encodes the peptide sequence at SEQ ID NO. 55353
  misc_feature (411)..(411): n is a, c, t, g, unknown, or other
  misc_feature (413)..(413): n is a, c, t, g, unknown, or other
  misc_feature (477)..(477): n is a, c, t, g, unknown, or other
ggagctccccgcggtggcggccgctctagaactagtggatcccccgggctgcaggaattcgcacgagaccattacctagaacatcctaatcgaaaaaccagcgcagcgccctctcctacccgactcccagctagcccctcacgcgctcgtcggcgccctgtcgagtcgagcccgcatctcgcccgatcgagagcgagcgcatccgcgcgccggggagagctttgctttcggtggtctgtaacgactcaacgacgacggcaggcggtagataaaggcgcgcgatgtgcgacgcggcgccgaggtacaggggcgtgcggaagcggccgtggggccggttcgcggcggagatccgggacccggcgaagcgcgcgcgcgtctggctcggcaccttcgactcggccgagggcgcgncncgcgtctacgacgtggtcgcgcgggccctgccgggctgttcgcaggaacaatttcccggggttnacaacaacttccggcggctcgggcccaagggaaatttcgggttccacggtcaaatcctccaggggggcccggcgcccgggacccccggggccaggggggggcaatccgggccggggttgttgaaaaaccccggggggccccccgggagggggcccccccctcccccccaccccaaatggcaaaagaaagggggggttttcggctccccctggggaaaaaaggaaaaaacaccctccccggttgggggcggggggg

SEQ ID NO: 55353 - protein, 150 aa, Zea mays
  misc_feature: Ceres CLONE 1487303
  misc_feature (6)..(57): Pfam Name: AP2 Pfam Description: AP2 domain
  misc_feature (44)..(44): Xaa is any aa, unknown, or other
  misc_feature (66)..(66): Xaa is any aa, unknown, or other
MCDAAPRYRGVRKRPWGRFAAEIRDPAKRARVWLGTFDSAEGAXRVYDVVARALPGCSQEQFPGVXNNFRRLGPKGNFGFHGQILQGGPAPGTPGARGGQSGPGLLKNPGGPPGRGPPPPPHPKWQKKGGVFGSPWGKKEKTPSPVGGGG

SEQ ID NO: 55354 - DNA, 724 bp, Zea mays
  misc_feature: Ceres CLONE 1487305
  misc_feature: Encodes the peptide sequence at SEQ ID NO. 55355
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
tggagctccccgcggtggcggccgctctagaactagtggatcccccgggctgcaggaattcgcacgagaccattacctagaacatcctaatcgaaaaacacacagacacacagttacaccgaggaggtttcctccctggctccctgtgaatctgcgatactgactctgccttcttcgttcagccagcgccgaaagagagggagagccaagtcgccttccgccgcgacgcacgatggatcgcgcgcagttgctcctcgtcggactcccggccttgctcttcttctccgacctcactcacatattcgcgccgccgcctccccacctccgccacccccatcaccaccctcctcaccaccaccatccgcatccgctgcatcatccccactcgcctcatccccacccgcacccgccgcatcatccccacccgcacccgccgcaccaccaccagcaccccgacccctccacggcaatcatacaggagccacgtgtggatgaggctggattcggcagcacagtggagctgcatctggctctgtggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 55355 - protein, 17 aa, Zea mays
  misc_feature: Ceres CLONE 1487305
MRLDSAAQWSCIWLCGG

SEQ ID NO: 55356 - DNA, 725 bp, Zea mays
  misc_feature: Ceres CLONE 1487316
  misc_feature: Pfam Name: Cyclin_C Pfam Description: Cyclin, C-terminal domain
  misc_feature (677)..(677): n is a, c, t, g, unknown, or other
ggagctccccgcggtggcggccgctctagaactagtggatcccccgggctgcaggaattcgcacgagaccattacctagaacatcctaatcgaaaattccaacaacaaacacatttctcaggagattccttagagcagcacaggcttctcgtacagctcatctgaccactttgaattatctggcgagttatcttgccgagttgactttaatcagttacgatttcatgaaatttcttccctcagaggtggcagcatcttcgattttccttgcaaaatggacacttgaccaatctgaccatccttgggtttaaccctactcttgagcactacacgtcttacaaaagcttcgatattagaacttgcgtgcgggctctacaggaactgcagcacaacaccagtaattgccccctcaacgccatccgtgagaagtatgggcagcagaagttcgagtgcgttgccaacctcaggtcaccggagctgctgcggtcgctcctcagttgatgtgctcccctgcactctgctgattcaactcgccattgctgcaacgatcctgaacctgaataaatatttcttccggttctgttccatttccaaacttccttccatttgaaatgaattccgggacttgggcccccgaaaaaaaggcgcgaccccctaaatatccttttggaacctcnaaaaaaaaaaaaaaagcttttccaaccgggccaccctggggggggccc

SEQ ID NO: 55357 - DNA, 712 bp, Zea mays
  misc_feature: Ceres CLONE 1487318
  misc_feature: Encodes the peptide sequence at SEQ ID NO. 55358
ggagctccccgcggtggcggccgctctagaactagtggatcccccgggctgcaggaattcgcacgagaccattacctagaacatcctaatcgaaaattccgcttccaaaggtttccatctctctctcccgccatatgactagtgttcctgttggctgttgctgtgtcggtccgccatgtacgcgtccctggattgctccggtaactcctttgggaaaaccgttaacgatcatctgaggtcaactttgagttttgataacaagcaacctccatttgcgagtcaaaactttgactacggtcaaacaatagcttgcatttcatacccgtacaatcgttctagatcaggagatgtttgggcagcctatgagtcacgcaccagcactgccactgtgcagttccgttcccaaattgctggtggccccccatccacaagaattcccttgcctttggaattagcagagaatgaacccatatatgtgaatcccaaacaatatcacgggatacttcgcagaagacagttacgtgccaagctagaggctcagaacaagctagtcagagcccgaaagccttaccttcatgagtctaggcatcttcatgcaatgaagagggcacgaggttccggtggacgattcctcaacactaagcagctccagcagtctcacacagccctcatcaggtccaccaccacaagtggcacaagctcctcaggctca

SEQ ID NO: 55358 - protein, 179 aa, Zea mays
  misc_feature: Ceres CLONE 1487318
  misc_feature (96)..(152): Pfam Name: CBFB_NFYA Pfam Description: CCAAT-binding transcription factor (CBF-B/NF-YA) subunit B
MYASLDCSGNSFGKTVNDHLRSTLSFDNKQPPFASQNFDYGQTIACISYPYNRSRSGDVWAAYESRTSTATVQFRSQIAGGPPSTRIPLPLELAENEPIYVNPKQYHGILRRRQLRAKLEAQNKLVRARKPYLHESRHLHAMKRARGSGGRFLNTKQLQQSHTALIRSTTTSGTSSSGS

SEQ ID NO: 55359 - DNA, 714 bp, Zea mays
  misc_feature: Ceres CLONE 1487328
  misc_feature: Encodes the peptide sequence at SEQ ID NO. 55360
  misc_feature (419)..(419): n is a, c, t, g, unknown, or other
tggcggccgctctagaactagtggatcccccgggctgcaggaattcgcacgagaccattacctagaacatcctaatcgaaaaatgtccacgatgggcttcttccaggacacccgcgtcgtcggtggtggcagcagccggacggccaggtttctccagtaccagaggctggagtgctgggaggacgccggagtcgctcccagtcccaggtcccggtggcggtggccgtggctgccgacggagaatggtaagatggctcccccctgtttgttcaatgtcaagaggctgaagtggagcaagatcacctcggctctgatactaccaaggaaggttgctgagctctccgcaaagatccgtcacgccagcgccagggacgaagccgcccccaccatctgcccggccgtcgtcctcgtggtcccgngggggctttctgtgctctccggcccctcttggtcggccccagagcaggtcccgttttcctttggaaaggaccctggtgaataactgaacaggtaaaccccacctggtttctgggggaaaatatttatgcggggagctatgttaactttggaaaatgggaaaaaccccccttttttatttccccggcaagccttgggccaaggctaaaatggccccccttcccccaggggtggtgttttgggcccctctaaaaaaatccggccaagaaaaaaaaattgttattttttccccccccg

SEQ ID NO: 55360 - protein, 139 aa, Zea mays
  misc_feature: Ceres CLONE 1487328
  misc_feature (113)..(113): Xaa is any aa, unknown, or other
MSTMGFFQDTRVVGGGSSRTARFLQYQRLECWEDAGVAPSPRSRWRWPWLPTENGKMAPPCLFNVKRLKWSKITSALILPRKVAELSAKIRHASARDEAAPTICPAVVLVVPXGLSVLSGPSWSAPEQVPFSFGKDPGE

SEQ ID NO: 55361 - DNA, 707 bp, Zea mays
  misc_feature: Ceres CLONE 1487329
  misc_feature: Encodes the peptide sequence at SEQ ID NO. 55362
tggagctccccgcggtggcggccgctctagaactagtggatcccccgggctgcaggaattcgcacgagaccattacctagaacatcctaatcgaaaaatcatccatccgtccacaaccacatagagagccagtaaacaccgcgcacgcaaacgcaacagcgagatcgtgtcgagcagccggggcgacttgcgaggcatggacttccaccacggctgccacaacagcagcatccacgcggcggcggcgccgccggcgcggccgtggagcaaggaggagaacaagatgttcgagagcgcgctggtgatgtggcccgagcacacgcccgagcgctgggcgctcgtcgcggcgcagctccacgggcgcacgccgcgggaggcctgggagcactacgaggcgctcgtcgccgacatcgcacttatcgagcgcggcggggtcgacgtgcccgcctgctggaacgacgacaaccaagtccgcggcggctgcgagggtggcactggcaacagccgccgcgccggcgctgaccgggcgcaccgcgagggccggcgccccgggaaaccctggagcgaggaagagcacaggctcttccttcaagggctggagaagtacgggcgcggggactggcgtaacatctcgcgcttcacggtgcggacgcgcacgccggcgcaggtggccagccacgcgcagaagtacttcaaccggcagctca

SEQ ID NO: 55362 - protein, 170 aa, Zea mays
  misc_feature: Ceres CLONE 1487329
  misc_feature (119)..(166): Pfam Name: Myb_DNA-binding Pfam Description: Myb-like DNA-binding domain
  misc_feature: The sequence is a functional homolog of SEQ ID NO 1893 in the 11/479,226 US patent application
  misc_feature: The sequence is a functional homolog of SEQ ID NO 2678 in the 10/374,780 US patent application
  misc_feature: The sequence is a functional homolog of SEQ ID NO 340 in the 10/225,066 US patent application
MDFHHGCHNSSIHAAAAPPARPWSKEENKMFESALVMWPEHTPERWALVAAQLHGRTPREAWEHYEALVADIALIERGGVDVPACWNDDNQVRGGCEGGTGNSRRAGADRAHREGRRPGKPWSEEEHRLFLQGLEKYGRGDWRNISRFTVRTRTPAQVASHAQKYFNRQL

SEQ ID NO: 55363 - DNA, 724 bp, Zea mays
  misc_feature: Ceres CLONE 1487332
  misc_feature: Encodes the peptide sequence at SEQ ID NO. 55364
  misc_feature (394)..(394): n is a, c, t, g, unknown, or other
  misc_feature (466)..(466): n is a, c, t, g, unknown, or other
tccccgcggtggcggccgctctagaactagtggatcccccgggctgcaggaattcgcacgagaccattacctagaacatcctaatcgaaaacctccctcctcatcaaccagcagcacctccatcgaatcttgtaggcaaagccaaataatcaatcaccagcgacatcaattcctcgcccgcccgcgcgtcgaggaaccgccgcacagttccagttccatgggcaaggtgcgctccttcttctgccgcgcccgcagcggcaagcgcggcggctcccggccaggctcgtcgtcctcgtctctctcgtcccagtgcccgtccgcgaggatggcgtcgccgccggcctgggacgagacggagcgcgtcttccgcaagttcgacgcgaacggcgacggncagatctcgcgcccccagctggcggcgctgttcgagagcgtggggcacgcgggcaccgacgacgaggtgtcncgcatgatgaaggagggcgaagcggaacggcgacggctacattcatctgcccaagttcgcggcgttatggattcgggttcggggaaacccaaacccgtcaagaaagaactggccccgccttttctggtctttaaagccaaagggaaagggtcttattaagccccccaaatttcggggggttctgtgggggctccgggaaaacccgccccccttcccccaggggcccccatggactcagggggttaaacaccaagggga

SEQ ID NO: 55364 - protein, 135 aa, Zea mays
  misc_feature: Ceres CLONE 1487332
  misc_feature (45)..(73): Pfam Name: efhand Pfam Description: EF hand
MGKVRSFFCRARSGKRGGSRPGSSSSSLSSQCPSARMASPPAWDETERVFRKFDANGDGQISRPQLAALFESVGHAGTDDEVSRMMKEGEAERRRLHSSAQVRGVMDSGSGKPKPVKKELAPPFLVFKAKGKGSY

SEQ ID NO: 55365 - DNA, 926 bp, Zea mays
  misc_feature: Ceres CLONE 1487333
  misc_feature: Encodes the peptide sequence at SEQ ID NO. 55366
gtgtgggtcggctaccttgattggatcttgacttgctcagcttctcctagcccagctcctgctagctaggcctaggctgctacatactgccatcatccatggaggcgcctcctgatcaggcggcagcggcggcgcggcaggaccaggagcggcgggactacagactcatcgcaaaagccgtggacgaagcgtaccgggcggtggagtgcgacggcggcgggtaccccttcggcgcggtcgtcgtccgcgtcggcggcggcggcggcgacggcgacgacgacgaggtggtcagcagcagccacaactcggtccggaaggacgccgatccgtcggcgcacgccgaagtgaccgccatcagacaggcgtgcaagaagctggggaaaaccagcctctccggctgcgagatctacacgtcctgcgagccgtgcccgatgtgcctggggctcattcgcctggccaagataaagaaggtggtgtacggagccaagtcggaggtcgccgctgccgccgggctcaacggcgtcctcccagaggtcttcagagagtactaccagaaatccggcgtggagatgaggcaggccgagggcgaggcggcaacccggatcgccgaggaggtgttcgagaagaccaagggcaagtttcgcaacaagtaaacgcgctggagatggcgccgggcggatggctgttgcctgttgctagtggaatggttgccgtttccaagctttttgtccgggggacctttgatcagaggtcacatgcccagagaccggaataaattcacccctttccccccctaaaaaatactccatttcacatggtttgttgtatcagtgtgttatttctttttttaacgcccgcctcgaccgtgtgacattttttttcttaataatgtagggtgttacttgttgggaaaaaaaaaaaaaaaa

SEQ ID NO: 55366 - protein, 184 aa, Zea mays
  misc_feature: Ceres CLONE 1487333
  misc_feature (17)..(129): Pfam Name: dCMP_cyt_deam_1 Pfam Description: Cytidine and deoxycytidylate deaminase zinc-binding region
  misc_feature: SWISSPROT Homolog: EC 3.5.4.3 Guanine deaminase
MEAPPDQAAAAARQDQERRDYRLIAKAVDEAYRAVECDGGGYPFGAVVVRVGGGGGDGDDDEVVSSSHNSVRKDADPSAHAEVTAIRQACKKLGKTSLSGCEIYTSCEPCPMCLGLIRLAKIKKVVYGAKSEVAAAAGLNGVLPEVFREYYQKSGVEMRQAEGEAATRIAEEVFEKTKGKFRNK

SEQ ID NO: 55367 - DNA, 895 bp, Zea mays
  misc_feature: Ceres CLONE 1487342
  misc_feature: Encodes the peptide sequence at SEQ ID NO. 55368
  misc_feature (19)..(19): n is a, c, t, g, unknown, or other
  misc_feature (484)..(484): n is a, c, t, g, unknown, or other
  misc_feature (895)..(895): n is a, c, t, g, unknown, or other
accacattccccccgttcnccgcgacaacaaaaaacaccccccccttacccccgaagatccccgtggccgccggcccctcttttaataatggatgccccgggctgcaggagttcgcacgagaccattacctagaacatcctaatcgaaaaaccaatctcagcttccaaggcaaaccaagaggagagaccaaggtagacgacgatggcggtgtcggtggagctgcccaaggagtacggctacgtggtgctcgtcgtggtggcctacgtcttcctcaacttctggatgagctttccggtcggttccgcccgccccgaagtacaaggagttctaccccactatgtactttaccgattccgaatacaagggagccaagtgctttccgcggcgctccgaaggggggcactaaaactccatttgaaatggatggggtatccaccatccccacccttgcctgattgggggggatggaaagagtcgtacaancccccccaacccataattgggatttggttttatcttcagggctcattgggtttccccccctccccctccacgagcgctaagctcacccgtaatgttcgttccagaggagactttcgttatcaacggttgttcgtgcggccccgattttccaatggtcatttataattataggtgcgtatttccgagaattcgtgggttgtgttgtcgtcgcgtttttttttggccgttatgtttagcgtttttgtagaggttcccatgaaaaactatccttaacctgaaggcgccacgcccgtatttaaccgtcctaagttgtctttcagatgcctcgtccctttcccgccccgcagccttgtgggcgcgcgtgtaatgcccccccctttgagaccgcggttctccgagattacgccctcn

SEQ ID NO: 55368 - protein, 148 aa, Zea mays
  misc_feature: Ceres CLONE 1487342
  misc_feature (94)..(94): Xaa is any aa, unknown, or other
MAVSVELPKEYGYVVLVVVAYVFLNFWMSFPVGSARPEVQGVLPHYVLYRFRIQGSQVLSAALRRGALKLHLKWMGYPPSPPLPDWGGWKESYXPPQPIIGIWFYLQGSLGFPPSPSTSAKLTRNVRSRGDFRYQRLFVRPRFSNGHL

SEQ ID NO: 55369 - DNA, 747 bp, Zea mays
  misc_feature: Ceres CLONE 1487355
  misc_feature: Encodes the peptide sequence at SEQ ID NO. 55370
  misc_feature (387)..(387): n is a, c, t, g, unknown, or other
tcgcacgagaccattacctagaacatcctaatcgaaaaatagcccatttcttaggtttcggcgcctcagtgggacgaaactcactggctccctctcctcccccagtccgcggcgctcgctccgttcacctcggccgcggcgaccttcgaggcgacgagacgatgctgcggctctcccgcttcctcccctccgcctgcaggaggggttttgatctaaaagaatctctttggagtggttcattgaccttccaaccagctgtttcccctgccgcaacacatcttgatgggcacttgtctggcaaaaagtttggaagttaataccgtggttcagggaaagggcttgccctttctttacgtcccccccccggtcaaatttttagcaaattanaattccggaggattttcccagggaacaaaaatgggatcagtaaaggctgacctttcttttcctggtgtgggccccagggaggtttggccctttccaaagaaagaggttcttttgcttgcgccccccccctggaagttggaaccctctgaaaaaacctctggggcctgcgtaaaaccccggggaatttttttcccaggacccacccccttaggaaccatcgccctttgaaaccgcaccggagaaaaaaatcccggtggcgaacacccccaccctgggggcggggcgggtgggagcacttctgttataaaacacccccctgtggaaacgcccgggaaaaaagagaattattaggccctctct

SEQ ID NO: 55370 - protein, 51 aa, Zea mays
  misc_feature: Ceres CLONE 1487355
MLRLSRFLPSACRRGFDLKESLWSGSLTFQPAVSPAATHLDGHLSGKKFGS

SEQ ID NO: 55371 - DNA, 771 bp, Zea mays
  misc_feature: Ceres CLONE 1487360
  misc_feature: Translation starting site: 285
  misc_feature: SWISSPROT Homolog: EC 4.1.1.20 Diaminopimelate decarboxylase
  misc_feature (403)..(403): n is a, c, t, g, unknown, or other
  misc_feature (417)..(417): n is a, c, t, g, unknown, or other
acccgcggtggcggccgctctagaactagtggatcccccgggctgcaggaattcgcacgagaccattacctagaacatcctaatcgaaaaagaacacttcgcttcctggaaggctggaacagaaagaaccctaaaccctagcaatggcggcggcgaacctgctgtcgcgctcccttctccccaccccaaacactatccgaacgagccaccccaccccgctgagcccagccgtcgtctccttcccccgccgccgtgcccgcctgtccgtgtgcgcctccgtctccatggcctccccgtcccccacgcacagcccgcggcggccggcgtgccgaagcactgcttccggcgcggcgccgacggctacctgtactgccagggaatgaaggtgaaaaacccaatggcngctgcccaacgganccctttctatccctaaggaaaggttaaaatcttcgggaatttccccgttaaccggaaacttttcaggggccccccgtccatcgccgggaaggccggaaaggcaaaaaaacctccccgggaaaacccccctggggaaatttgtggtggggcccctcccttctcgggggaaaaaatctccatctcccctccgcggggaaattcccccccccgggggttttttttgggggggggggaaacccccaaaattttttgggggtgggagagaggggatttttttggggggggggggtttttttttaaaaaaatattcccccccccaccccccccgaaaaagggctggtttttttaaaaaaa

SEQ ID NO: 55372 - DNA, 759 bp, Zea mays
  misc_feature: Ceres CLONE 1487364
  misc_feature (339)..(339): n is a, c, t, g, unknown, or other
  misc_feature (367)..(367): n is a, c, t, g, unknown, or other
  misc_feature (394)..(394): n is a, c, t, g, unknown, or other
  misc_feature (395)..(395): n is a, c, t, g, unknown, or other
  misc_feature (422)..(422): n is a, c, t, g, unknown, or other
  misc_feature (431)..(431): n is a, c, t, g, unknown, or other
  misc_feature (440)..(440): n is a, c, t, g, unknown, or other
  misc_feature (446)..(446): n is a, c, t, g, unknown, or other
tggagctccccgcggtggcggccgctctagaactagtggatcccccgggctgcaggaattcgcacgagaccattacctagaacatcctaatcgaaaaaaggcgccctcagccagcgaagccgacgcgcccggcccggtcggcgacgccgccgccgccgacaccgcggccgctggaaggaccgtggcaggcggaatcatggcagcgggcgcgctggcgctgggcctcgtcggcctgctcgcctaggcacggcgcgcgcgagcgggtggcgctggcgcctgcacggcacagcatggatgccgcggctacgtgcgtgacgacgacataactcctacgcgaangatgcagccggtgcgccgcgcgcgctcnacgtccatggatgccgcggctgacggnntgtactctgtcccgttttttaaccggnccggccggncctacgtgnatgtantaatactagtgcagtcagggccactcccgttttgggtcgcggggctacctggggaagtaccgccgccccccggaaccttttcaaaaattccctttttaaattcccccttaaattcccggaacccggggccccctcttcgaagggtttttttttattcttttttccccccaaaaaaaaaaaaaaatttttttttttccttcccacctcagggggggggccgggaaccattttccccctaaggggggttaataacccgcgccccgtggcgcccttttttaaccccgggggaggggaaaacccttgttttcccctt

SEQ ID NO: 55373 - DNA, 773 bp, Zea mays
  misc_feature: Ceres CLONE 1487372
  misc_feature: Encodes the peptide sequence at SEQ ID NO. 55374
  misc_feature (335)..(335): n is a, c, t, g, unknown, or other
  misc_feature (416)..(416): n is a, c, t, g, unknown, or other
  misc_feature (435)..(435): n is a, c, t, g, unknown, or other
  misc_feature (446)..(446): n is a, c, t, g, unknown, or other
  misc_feature (661)..(661): n is a, c, t, g, unknown, or other
  misc_feature (662)..(662): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
ggagctccccgcggtggcggccgctctagaactagtggatcccccgggctgcaggaattcgcacgagaccattacctagaacatcctaatcgaaaaatacgccgccatcttcgcaagccaccgcaaccgaagcccgccttcgccgccgccgcctctgcgatccccgcaaggtcgcaaacatgtctaccgtgctccagcgcccgacccccggcacggtccagtgcttcggccgcaagaagacggctgtggccgtcgcctacaccaagccggggcgcgggctgatcaaggtgaacggcgtcccgattgagctcatcaggccggagatgctccgcctncaggccttcaagcccatcctgctggtgggggggctccaggttcaaggacatcgaaatgagggatccgcgtccgagggcctnccaaccccctccccaaaanaacccattttnccagggccggccccaagggggttgcgcccccaattacccataataacttctaaaaaggccgccaaaaaagggaggtcaaggaactccttcaccgggaaaaaaggggaccttttttttcctaacccctgggtttaaacaaaaaatggggggccgccccccccgttccaaactccctaaccccgccccctgcaatgggcttaagccgtttccagggnntnnnnnnnnatnnnaatgattttcttaactcccaaattaacttttagaaccacgttacaatctactatccatatccctccgcttccattattaatccccgccgcgcgctgt

SEQ ID NO: 55374 - protein, 133 aa, Zea mays
  misc_feature: Ceres CLONE 1487372
  misc_feature (17)..(122): Pfam Name: Ribosomal_S9 Pfam Description: Ribosomal protein S9/S16
  misc_feature (86)..(86): Xaa is any aa, unknown, or other
  misc_feature (89)..(89): Xaa is any aa, unknown, or other
MSTVLQRPTPGTVQCFGRKKTAVAVAYTKPGRGLIKVNGVPIELIRPEMLRLQAFKPILLVGGLQVQGHRNEGSASEGLPTPSPKXPIXPGPAPRGLRPQLPIITSKKAAKKGRSRNSFTGKKGDLFFPNPWV

SEQ ID NO: 55375 - DNA, 521 bp, Zea mays
  misc_feature: Ceres CLONE 1487376
  misc_feature: Encodes the peptide sequence at SEQ ID NO. 55376
  misc_feature (479)..(479): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
ggagctccccgcggtggcggccgctctagaactagtggatcccccgggctgcaggaattcgcacgagaccattacctagaacatcctaatcgaaaaataaccttctagatttttttccgctgcctcaatggatctctgggagagggcccgggccttcgccggcgaggcggcgaagcggtcgcaggaactctcccgcggagcgggcaagcgctcgtcggggctggtctccgaaacgggcaaaaaattccagggaaattttcccccaaaacccccctcccaatcccggggaaaaatcccccttgagagccccccaagggggggggaaacctcctccccgggggcaaaaaaaaaaacaaactctccccctcaaaaaaaacccccggggggggggttttaaaaaccccccccccccccccccccccggaaaaaccccccttatttttcccccccgcggggggggggggttttctcccgggggncgcccccccccccaccccnnnnntatatttcttttttttttg

SEQ ID NO: 55376 - protein, 89 aa, Zea mays
  misc_feature: Ceres CLONE 1487376
MDLWERARAFAGEAAKRSQELSRGAGKRSSGLVSETGKKFQGNFPPKPPSQSRGKIPLESPPRGGETSSPGAKKKTNSPPQKKPPGGGF

SEQ ID NO: 55377 - DNA, 744 bp, Zea mays
  misc_feature: Ceres CLONE 1487836
  misc_feature: Encodes the peptide sequence at SEQ ID NO. 55378
  misc_feature (744)..(744): n is a, c, t, g, unknown, or other
atagctggagctccccgcggtggcggccgctctagaactagtggatcccccgggctgcaggaattcgtctcacccctagaaaaaatccaccatcacacagcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgagttccacgagcgcagggagagcttcctcgccagggctaactgagccgcccggcggccggcatccacgcccgttcgtgcttgcctgcgtgccttatgtatgtctggggttgactggttgttgcacggtcatcgtacttggctatcgtacgtgcaccccactcagctcctgttccaaatttccaacaataagctccgggaccccgaaaaaaaacttccttcgtaatacctaatacccaacatcccccggtgagacaaaaattaaaaacgcctgggcccgctccgggtggccccccacttccgcccgcttatgaatgatgttcctcattttcccggccccccn

SEQ ID NO: 55378 - protein, 93 aa, Zea mays
  misc_feature: Ceres CLONE 1487836
MAYYQEVDYCSEEVRSVAPAGFGRHGGGVQQHVVKEKFEEVDTVSRAGANHHHHHGHHGGHGFVVRETRVEEDINTCTGEFHERRESFLARAN

SEQ ID NO: 55379 - DNA, 751 bp, Zea mays
  misc_feature: Ceres CLONE 1487844
  misc_feature: Encodes the peptide sequence at SEQ ID NO. 55380
ccaagctggagctccccgcggtggcggccgctctagaactagtggatcccccgggctgcaggaattcgtctcacccctagaaaaaaagcatccaagcttaacgcaagcagatctaagctccaggcagcgtcgcgacagagtgagtgagtagcacgacaacaacaatggcttccctgaaggccgcgaagcccagcggagttgcggcgcaaggcaaggagccggcgcccaagctcagcgagacggcgacgaagccgtcagccgcgaagaggggcggcgttaagaatgctgagcagaagccccgggaaaccaaaaggaaggtgaagagcagcaaaccggcggcggcggccaaaaagtgacgtacagtacgtgtggagtgtaatggagcttccatgcatgcatgagtggatccctgccctgttatgaatctagaccttcctttcttgtatcttccatgtgacgcggagtgtgcgtcccttcatgtgtgatgatgccagatgaatactacaaataagacgctgggactgtgtccggcaaacccacaaaaccgaaagcctcacgcggcttggggcctcttctcggaaggcagagatcaaataacccttcctcgcattggctaggaaaaagccgccaacccccgaggtcccctaatctccccgtaaagcggatccctaattgcgccccgcacacaggagccgcctatctcaccacccccgggagccgtgggaaagccccgtggtgttttacctagttg

SEQ ID NO: 55380 - protein, 63 aa, Zea mays
  misc_feature: Ceres CLONE 1487844
MASLKAAKPSGVAAQGKEPAPKLSETATKPSAAKRGGVKNAEQKPRETKRKVKSSKPAAAAKK

SEQ ID NO: 55381 - DNA, 728 bp, Zea mays
  misc_feature: Ceres CLONE 1487847
  misc_feature: Translation starting site: 403
aagctggagctccccgcggtggcggccgctctagaactagtggatcccccgggctgcaggaattcgtctcacccctagaaaaaattctccccccactacccaaacctaatatgttgggggaggagtatcgtcacgaccgttttagaagagcaaagatggtgaacttcctcaagcccggcaaggccgttatcctccatccagaggccggttcgccgtgccagaacgcctgtgatcgtgcacgttttcgaagagggcacccgggaatcgtccctatctggtactgcctcgtcgcggggctcgatgactaccccaagaaggtgatccgcaaggtactccgccaaaaatacggccaagaatgcccaagatctgtgattcgtcagactcgtcaagttcactcacgtcatgcccaccaactacatcctcaaggtcgactttaacgacgtcgcatctcgtggaccagacgcgctctccacccgggacaagaagtcgaagactgccatgacgccgaagcgcgcctctaggagaggttcaagacccgcaagaacatgagggtctttaccgaactccgcttctagacttcgtggcgtccctcataatgtcggatctaattgtcaatttattgtacgtaagacccttctaggcatcgctgttctgctatctccaggaatgcttcgtgcatggtatggatcctgcagaggatgctgattgtaacatgtcaatgatattaa

SEQ ID NO: 55382 - DNA, 758 bp, Zea mays
  misc_feature: Ceres CLONE 1487853
  misc_feature: Encodes the peptide sequence at SEQ ID NO. 55383
aagctggagctccccgcggtggcggccgctctagaactagtggatcccccgggctgcaggaattcgtctcacccctagaaaaaatctcagcagtgacgaactcgaagcttgcgttcttgtagtagaggtcggcagcaagcggtggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggggccatcaagtacaggtgccgcgacttcttcccccgaaaactggggctgcaaaatccactagaaactcttccaattcccccttggccgcccgccccagggggccaacccgagggatccttcatggtcctcccgtcggccccccttggttacaagagggcccccccacaaaaaaccacccctttggtggggtttttaaaagttaaaatggggggtcccctcccccccccaatgggaaaaaaaaataaacccccgggcccccaaaaaaaaaaaaaaaaaaagaaaccgccgggggccccattttccgcccatatgggggggcataacacccccgccccctcccggcccttttttttataaacccgcgggtgtggggaaaaccaccg

SEQ ID NO: 55383 - protein, 188 aa, Zea mays
  misc_feature: Ceres CLONE 1487853
MKSSTLLAILVLQALLVSAAVAKGPAGPTTKKQCWCGECTSWSGVWTCDDLLTKCAATCKNCVPVSTDKGAIKYRCRDFFPRKLGLQNPLETLPIPPWPPAPGGQPEGSFMVLPSAPLGYKRAPPQKTTPLVGFLKVKMGGPLPPPMGKKNKPPGPQKKKKKKKPPGAPFSAHMGGHNTPAPSRPFFL

SEQ ID NO: 55384 - DNA, 797 bp, Zea mays
  misc_feature: Ceres CLONE 1487860
  misc_feature: Encodes the peptide sequence at SEQ ID NO. 55385
atagctggagctccccgcggtggcggccgctctagaactagtggatcccccgggctgcaggaattcgtctcacccctagaaaaaagccgtcatcgtttcgcgtctgcctcagcccgccgcaaggagaggtaagttcaggagacatcttcgagaagctgaaatggctcctaaagctgctcctgccaagaagggtgatgccaagacccaggccttgaaggttgccaaggctgtgaagtctggggcagccaagaagaagaccaagaagatccgcacgtctgtgacatttcaccgccccacgaccctgaagaaggctagggaccccaagtacccacgaatcacccctaccggaagggagcaagcttgatccttacccaattcccaagaaccccctttccacaaaaccgccatgaaaaaaattggaaataaccaacccccggtccttcttttttaccccccagggaaaaaaaaaaaaaaaccaaggtcccccctaaaaaaaatttttacacccccccccaagaaaggccaacccctctttcccgcccccttaaggaaaaaaaaacgctcctccgaaaatcctccccccccctttagcacccctttatgtgcccacacaaaaccgcgcccccctcatcgcccgtctattaggcccctctattctccctctggggtgcccctcctcttctgtagaaaacaaaagtgttttccctggggggccccccacccccccccccccccccggtggcgccccacaccctctatagattatactccctccacgtactctgtaatagagaggg

SEQ ID NO: 55385 - protein, 67 aa, Zea mays
  misc_feature: Ceres CLONE 1487860
  misc_feature (11)..(64): Pfam Name: Ribosomal_L23eN Pfam Description: Ribosomal protein L23, N-terminal domain
MAPKAAPAKKGDAKTQALKVAKAVKSGAAKKKTKKIRTSVTFHRPTTLKKARDPKYPRITPTGREQA

SEQ ID NO: 55386 - DNA, 788 bp, Zea mays
  misc_feature: Ceres CLONE 1487866
  misc_feature: Encodes the peptide sequence at SEQ ID NO. 55387
  misc_feature (297)..(297): n is a, c, t, g, unknown, or other
  misc_feature (322)..(322): n is a, c, t, g, unknown, or other
  misc_feature (394)..(394): n is a, c, t, g, unknown, or other
ctggagctccccgcggtggcggccgctctagaactagtggatcccccgggctgcaggaattcgtctcacccctagaaaaagaagcttatcgcttatcatccgcgcctctacatttcttctctctctgctcctccgcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgncaggttgtggagggttctacctccnagactggtaagcatggccacgccaaatgccactttgtcgccatagacatattcaatgggaaaaagcttgaangatattgttcttcatcaccacaactgggacattccgccatgtggacccgtactgaagatcaccctgattgatttttccggaggatggatttgggaagccttcttcctcccgaaggggacctctaggagagatcttaaaccccaaacgggaaaaaaccctttggggcccaaaataaagaagggtttcaaaaacgggaaaaaaactttgtggaacccgcccccccccccagggggggaaaagaaaattctcccccccaaaaaagatttgccccccaaaaattctcttttgtttgtgaggagagaaccctctttttttttttttttataaggaaaaaaaaagtgtccccccaaaagggtgtgggccaaaaaaactctccggggggggggggggtttt

SEQ ID NO: 55387 - protein, 96 aa, Zea mays
  misc_feature: Ceres CLONE 1487866
  misc_feature (41)..(41): Xaa is any aa, unknown, or other
  misc_feature (50)..(50): Xaa is any aa, unknown, or other
  misc_feature (74)..(74): Xaa is any aa, unknown, or other
MSDSEEHHFESKADAGASKTYPQQAGTVRKNGFIVIKNRPXQVVEGSTSXTGKHGHAKCHFVAIDIFNGKKLEXYCSSSPQLGHSAMWTRTEDHPD

SEQ ID NO: 55388 - DNA, 765 bp, Zea mays
  misc_feature: Ceres CLONE 1487876
  misc_feature: Translation starting site: 192
ctagctggagctcaccgcggtggcggccgctctagaactagtggatcccccgggctgcaggaattcgtctcacccctagaaaaatgcctgcttaatgctgggctatccgccggtctcttgctctgatagcttgctccaggacgtacgtacgtacgtagatcgatccatcgatcgctagctagctgacgaccatggcgtccctctcctctggcgccatcaccgccccttccttcacggtcgcgcccgctcgcgcagtggtcagcaggaggtccttcaccgcgcgtgcctctcgccgcaagggcactgccaccgccgccgtggacgttgccgccagcgtcctgctagccggcggcggctccatggtccaggaggtgctgctgggggcaggcgactgcagtctcatcttcaagcaccttccccccaccgtcgagggcgggcgacaccatcacccttcagaacaacgccggcttcccgcaaaacgtcatgtttgaacaaatacgaaggtgccgagcggcgacctacgcctcacaagatctcggcaggagggagcaccctcaacggccccttgtgcagaactaccgccgtaccccctgccccgtggtcgtggggtgcttactgggttctacccgtcgaagcccctcccaaaggcaggcgaaaagggcccggccgaagaaaccccccctccacctaaaggccaagctcttcccacattcccggccatgcccccccgccccgcagacgccaccccgcccccttcccccgtcg

SEQ ID NO: 55389 - DNA, 721 bp, Zea mays
  misc_feature: Ceres CLONE 1487882
  misc_feature: Encodes the peptide sequence at SEQ ID NO. 55390
  misc_feature (721)..(721): n is a, c, t, g, unknown, or other
aaagctggagctccccgcggtggcggccgctctagaactagtggatcccccgggctgcaggaattcgtctcacccctagaaaaaaaacaacccaaaaaaagtttgaggcagaatttggctcaaacagtcaatctactgggcagattgttaaagaaaagttctctcaaagtcgcatgaagaagcgtaagcagaaagagaaggttgacaaaattactgaggatgccaggagcaacaaatcagacttttctcagaaaggaaacagtaagaggccaaaatctggcagcgcaatttctgagaaaggatcaagtgacaagaaccccctgagtgaaggtgctagtgctagcatggtgttcttgaagggctctgtcaagaggaagtccccaggtttcctttcagataaactgagcttcaagaaacaaaaacctcacaaacccgattctggtagaccagacggcaaacgttttgttcgagatagtgatactagcgcaccgttcgtcaagaatgccggcaaacagaaacagtccattgctgagctcgcggacctggctggtaaggagaagctgactgcgtctgaagttcgcaaattgctgaagcctgaaatgtcaggcaagagctaatgagtttagggtgagcagaagcagcaattttgttggtcgtttttcctcgtatgttgcggaaagaaactgtggcacgtgatatgggtttgtttcagtagaaacgn

SEQ ID NO: 55390 - protein, 147 aa, Zea mays
  misc_feature: Ceres CLONE 1487882
MKKRKQKEKVDKITEDARSNKSDFSQKGNSKRPKSGSAISEKGSSDKNPLSEGASASMVFLKGSVKRKSPGFLSDKLSFKKQKPHKPDSGRPDGKRFVRDSDTSAPFVKNAGKQKQSIAELADLAGKEKLTASEVRKLLKPEMSGKS

SEQ ID NO: 55391 - DNA, 614 bp, Zea mays
  misc_feature: Ceres CLONE 1487884
  misc_feature (351)..(351): n is a, c, t, g, unknown, or other
  misc_feature (566)..(566): n is a, c, t, g, unknown, or other
aaagctggagctccccgcggtggcggccgctctagaactagtggatcccccgggctgcaggaattcgtctcacccctagaaaaatcctcatccagtgttgtgtcctagcgccgccgccgccccaactcgccttgcgtgactgaaagctcgtcggcttccgtccacgcgagaagcgagagcatggacacccaggtgaagcttgctgttgtggtgaaggtgatgggcaggacggctccagggtcagtgaccaggtcagagtaagttctagatgacgagaacggctcatcatgaggatgtcaggggcccgtccgcgaggtgacatctaccctgctcgagtcgaaagggagccangaagctgccctgaagccctaacgttcctgggggctcttggttgggctttggggccctccaatttgggccaggtttgacctccgggacccttcctgaaaaaaaaaacccggggaaaaaaatgccattttgtttcccccgggtaaaaaggaatttgggggtaaaaacgggaaacccccgcccatttcccttaaaaaccccccgcgttgttatttttnaaaaaaaaataaattatgtattaaatcaacccctgttaaaagaatgtg

SEQ ID NO: 55392 - DNA, 796 bp, Zea mays
  misc_feature: Ceres CLONE 1487898
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (20)..(20): n is a, c, t, g, unknown, or other
  misc_feature (25)..(25): n is a, c, t, g, unknown, or other
  misc_feature (32)..(32): n is a, c, t, g, unknown, or other
  misc_feature (630)..(630): n is a, c, t, g, unknown, or other
nnnnnnnnnnnnnnnggggnggggnttggttngtgggtggaattatataaaactggagctccccgcggtggcggccgctctagaactagtggatcccccgggctgcaggaattcgtctcacccctagaaaaaaggaccggtcactcggcacgcaggctagcagcacagcagcagccagagccatcccctctcctcgctacgcttcgcttcctcggcgccgattcctcctcctcctcctccaccctcgtccgtccccttccggcgcgcgagatcgtccgagatggcgaacgcgagatcgggtgtcgctgagaacgatgagtgcatgctgaagtttggccagctgcactcaaagaggctgcaccagcctcataactttcaagatggacgacaagctcaaggagatagaagtggaccaggccggggatcgcgctaccagctacgatgacttcacaaacagccccccctgagaatgactgccgatacgcgaatctatgatttcgacttaattaccggtcgaggatggcccaaaacgagcaagcatctatctatttccttatgagtccccatccttccgctcatatgagaaagagcaaaaatgctcttaaaaataagctcaacccaggaaattcnaggaaaggcccccaattggctactcatagttgaatatccgtgcacacccattcttagatgaaatcaaaccccgaagagaattaaggatcaggggcaccaacgactcacccgccatccgctcaattcacacgtaaaatcacacgggggaaacaactatctcctgtgt

SEQ ID NO: 55393 - DNA, 774 bp, Zea mays
  misc_feature: Ceres CLONE 1487905
  misc_feature: Encodes the peptide sequence at SEQ ID NO. 55394
  misc_feature (774)..(774): n is a, c, t, g, unknown, or other
ggagctccccgcggtggcggccgctctagaactagtggatcccccgggctgcaggaattcgtctcacccctagaaaaaacctcgcgccgccatccgacgcccatctgctccaccctccacccagccgccgccgccgccgcctaaggagaagagggtccggccgtctccttgccccgatggcgtccgagaagaagcagtccaacccgatgcgggagatcaaggtgcagaagctggtcctcaacatatccgtaggggagagcggcgaccgcctcacccgcgccgccaaggtgctggagcagctcagcggccagacccccgtcttctccaaggcgaggtacacggtgcgctcgttcggcatccggcgtaacgagaaaatcgcctgcttcttcacggtcaagggcctaaaaggccttggcacctcgctttgaagcggccttcagggacaggagttccaagcctgcttcggaaggaatttctgagaaaaccggggtgctttttggttttcgcctttctcggagaccctttcacccctgggttactatgtttaatcccctcgacaggggtcttttgggaggggggcttcttttcctctcggtataaagcgttttataacccacgagtccgccccccccagagggaggggagattcccctgcggggtgtctcctgcatatggggcgcccattggttatgcctcctgcggtgggggtcccgtgggcatacttcggagagagaggtttcctcttattgggtttatcattattttttgtttttn

SEQ ID NO: 55394 - protein, 83 aa, Zea mays
  misc_feature: Ceres CLONE 1487905
  misc_feature (9)..(62): Pfam Name: Ribosomal_L5 Pfam Description: Ribosomal protein L5
MASEKKQSNPMREIKVQKLVLNISVGESGDRLTRAAKVLEQLSGQTPVFSKARYTVRSFGIRRNEKIACFFTVKGLKGLGTSL

SEQ ID NO: 55395 - DNA, 778 bp, Zea mays
  misc_feature: Ceres CLONE 1487914
  misc_feature: Encodes the peptide sequence at SEQ ID NO. 55396
  misc_feature (10)..(10): n is a, c, t, g, unknown, or other
  misc_feature (16)..(16): n is a, c, t, g, unknown, or other
  misc_feature (21)..(21): n is a, c, t, g, unknown, or other
  misc_feature (778)..(778): n is a, c, t, g, unknown, or other
aatgggtttntttttntttgnattatttttgtattttttaaacttccttccaaactggagctccccgcggtggcggccgctctagaactagtggatcccccgggctgcaggaattcgtctcacccctagaaaaaagaagccaccctgccgcctcaccgcctctctcactctgagaccgcagatccgttgtccggtgagtggaagccgcacgaacccatggcctccggcgagcttgcctgcacctacgccgctctcatcctcagcgacgatggcatcgccatcaccgccgagaagatcgccacgatcgtgaaggcggccaacatcaaggtcgagtcctactggccggcactcttcgccaagctcctggagaagcgcaacgtcgaggacctcatcctctccgttggatctgggggcggagctgctccagttgctgctgccgcacctgctggtggtgctgcagctgctgctgcccctgcgtggttaaggataagaaggaagagggcaaggaggaggcttatgacgacgtgggctgcgagcctggttcactgaggagacccccgtcacccggccattagaaaatgtgaacttgcgctgtcaaatactagtcttggcttatgttatggctcataagattttgcttcaaccacgccgaggtacgaaggtctcttaagatggaggattgccgcaggaagtccgtgccaatctgcatgaaagggaaaaaagcgagcctccccaaaagaaaaagaaagaaaaagccagggcgcttggacggcacccn

SEQ ID NO: 55396 - protein, 110 aa, Zea mays
  misc_feature: Ceres CLONE 1487914
  misc_feature (21)..(90): Pfam Name: Ribosomal_60s Pfam Description: 60s Acidic ribosomal protein
MASGELACTYAALILSDDGIAITAEKIATIVKAANIKVESYWPALFAKLLEKRNVEDLILSVGSGGGAAPVAAAAPAGGAAAAAAPAWLRIRRKRARRRLMTTWAASLVH

SEQ ID NO: 55397 - DNA, 724 bp, Zea mays
  misc_feature: Ceres CLONE 1487920
  misc_feature: Encodes the peptide sequence at SEQ ID NO. 55398
  misc_feature (578)..(578): n is a, c, t, g, unknown, or other
  misc_feature (607)..(607): n is a, c, t, g, unknown, or other
aaagctggagctccccgcggtggcggccgctctagaactagtggatcccccgggctgcaggaattcgtctcacccctagaaaaaatttccattcgaccccatccacttctcacctcaatctcgcgagaagcgaagccggaggaggagggtgcgaggagatcgcgagcagccggagccggagccggagccggaggcctagtagatgaagacgttcgatccgtggccggtcttcttccgccgggagtggaagcgcaattggcccttcctcacggggttcgccatcaccggcttcatcatcactaagatgacggccaacttcaccgaggaggacctcaagaactccaagttcgtccaggagcacaagaagcgctgaccaaccaggtgttgtccgaattgcctgtctggacagccagttatgttatgctgtttgaatgaaaaattagcttctttttcttcatctaaatgcgtgcagcctatgctccatctgtaatgtaataagaggcaactgacttgatccaaaagctaccagcttctgattatgaatgatacttcaagtttgatctggttctctgacctgngcatcgatccacttatatgcatgaaaaanaaaaaaaaaacgagacgctcgaggtacccaattcgccctatagtgagtcgtattacgcgcgctcactgggcgtcgttttaccacgtcgtgactgggaaaaaccctggcgttccccaa

SEQ ID NO: 55398 - protein, 56 aa, Zea mays; identical to SEQ ID NO: 5462
  misc_feature: Ceres CLONE 1487920

SEQ ID NO: 55399 - DNA, 724 bp, Zea mays
  misc_feature: Ceres CLONE 1487929
aaagctggagctccccgcggtggcggccgctctagaactagtggatcccccgggctgcaggaattcgtctcacccctagaaaaagcgtgactgcatctatactgcgcaggcacgagggtttgtgttgcggcggggttttcgtgcggccgctgcggtgacaagcaggtcctccctcaagctcgcggcggatcagcgaccgatcgacccgtcatcctcggttcctcatccaaccgggcatccggattccggtgagcggaggaaggcgccatgaaagctgcggaggacgccactcgctgccctcagatcccccggcgttgccaccactgtgccgggccactctccaaggacatggaaacgagcagctggacagtacctccgttggttcgagatagcttctccatgattggttcggctcttgggggtatagcaggagcgttttatggtttcaaccatgttatgcctgttgttcgacgtcacattaagggcccaatgtggatgcattttttttgttggtgcaccaccagttattgtgttctcttctgcatgtgctggattagcaggtggtacaataccagccaccgcacagctggtttcatcatcctgtcatgccgtgtcatcgcactcctttgcccgctcttcttcgcgtgtacaacacatgcaccctccttcgcccccgctgcatctcatgacgacatgcgcaagacaagaagctcctcaccgttgt

SEQ ID NO: 55400 - DNA, 715 bp, Zea mays
  misc_feature: Ceres CLONE 1487932
  misc_feature (61)..(61): n is a, c, t, g, unknown, or other
  misc_feature (427)..(427): n is a, c, t, g, unknown, or other
  misc_feature (439)..(439): n is a, c, t, g, unknown, or other
  misc_feature (500)..(500): n is a, c, t, g, unknown, or other
  misc_feature (503)..(503): n is a, c, t, g, unknown, or other
  misc_feature (518)..(518): n is a, c, t, g, unknown, or other
  misc_feature (519)..(519): n is a, c, t, g, unknown, or other
  misc_feature (537)..(537): n is a, c, t, g, unknown, or other
  misc_feature (567)..(567): n is a, c, t, g, unknown, or other
  misc_feature (569)..(569): n is a, c, t, g, unknown, or other
  misc_feature (594)..(594): n is a, c, t, g, unknown, or other
  misc_feature (595)..(595): n is a, c, t, g, unknown, or other
  misc_feature (598)..(598): n is a, c, t, g, unknown, or other
  misc_feature (626)..(626): n is a, c, t, g, unknown, or other
  misc_feature (642)..(642): n is a, c, t, g, unknown, or other
  misc_feature (684)..(684): n is a, c, t, g, unknown, or other
  misc_feature (686)..(686): n is a, c, t, g, unknown, or other
caagctggagctcaccgcggtggcggccgctctagactagtggatctcttgggctgcaggnattcgtctcacccctagaaaaaatcacaattcacagcgctcaagttctcgcgcccacaggcaaatttttctccactcaatcaaggcataagctgccctgcttccgtggacgccagcggatcccgtccccaggagaacaacggggcggctggacgcaaggctggcagccccaccaagaagtcggtgctctcggaccttcaaggccgggctgcagatccccctccggcggatcgcgcgctaccgcaagaaggggcggtacgctgcatggcgtgggtaccggcgcccccggctatctcgccgccgcgcttgagtacgtcgatggcgaggagctggagctggccgggaaccttgtgaaggaccaccgacnaaccgcatgggntcgccgagctcggttctggccattcataccgggtttaactccaccagctcctgtctcgggnggnaatagttcagcgggnngtcctccccgaattttcnttctggccccccccccaatggggtcgtggnantaggcctcctggttgccgccccctnnggngcgcttgcgctcctctagcctccccccncgattttcttgttgangggtgggacgtcttgcgctctacaaagatctccgtaattccntnccaccccccccacccccccgcgccacaac

SEQ ID NO: 55401 - DNA, 680 bp, Zea mays
  misc_feature: Ceres CLONE 1487935
  misc_feature (230)..(230): n is a, c, t, g, unknown, or other
  misc_feature (238)..(238): n is a, c, t, g, unknown, or other
ctaagctggagctccccgcggtggcggccgctctagaactagtggatcccccgggctgcaggaattcgtctcacccctagaaaagcctcggtcacgacgcgcagtcgcccattccgcatctcgccctcccgtcctgtcccgtccgtccgttctccgattggccgccgcccgcctcgccctcgtcaacaaaagcccaccgcaagcgagcgagcgagccaccctccccgccngccgccanccggccccccggggtccccggccccccccccccccgaaaattcccccttttaaaaaaacccgcggggggggggggggggggcccccgggtttttcctccccccccccgggggggggaaaaaaaaaaaaattttcccccccgcgggggggggggggggccccccccccccccaaaagatttttttttttttttttgtggtgggaggaagaaaagaaaaaacacaacccccccccccccccccctcccgctttttttttttataataaaccccccccccccccccccccccccccccccaagggggaggggaaagaaaagaggagaccccgcccccccccccgccggcgggcggtgggggggttttttttcccctcctccgggaacccccccccccacccacaaaaaaagactacggttcttttttttttttttgtgggagggg

SEQ ID NO: 55402 - DNA, 727 bp, Zea mays
  misc_feature: Ceres CLONE 1487937
  misc_feature: Encodes the peptide sequence at SEQ ID NO. 55403
aagctggagctccccgcggtggcggccgctctagaactagtggatcccccgggctgcaggaattcgtctcacccctagaaaaagtcgagactcgagacttcgagttccctctccgttataaaaccgaacgctcagggcgctccgtgttcaatctccttgcccgttgtgctctctctcttcattcgttcccggcctcaccccgagccagtcgtctcgctagggtttcgccgccgccgccgccatgcctcgccgcagctcaggaaggtctgccccacgcccagctccccgtgctgcttcactgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgactctgtattaggtccccggaccatccagcatgagactcttgccacagaagctcctgctgctgcccctgctgctccagcgatgaatgctgatgcttgcaacttccattctaaggctttccaagaattgtctgaacaacttatggcagcgagatcagcaagtgcccatttcttccctagacattgctgaacgagtgcccccccggggtggtggtgtcttgtccttaacctgcccttctgggaataatttcattgggattttcctttttccgaatgaaggggt

SEQ ID NO: 55403 - protein, 130 aa, Zea mays
  misc_feature: Ceres CLONE 1487937
MPRRSSGRSAPRPAPRAASLRNPPQPARQAPPPAPVRDGGGSMFGGIGSTIAQGMAFGTGSAMAHRAVDSVLGPRTIQHETLATEAPAAAPAAPAMNADACNFHSKAFQELSEQLMAARSASAHFFPRHC

SEQ ID NO: 55404 - DNA, 847 bp, Zea mays
  misc_feature: Ceres CLONE 1487938
  misc_feature: Encodes the peptide sequence at SEQ ID NO. 55405
  misc_feature (19)..(19): n is a, c, t, g, unknown, or other
  misc_feature (21)..(21): n is a, c, t, g, unknown, or other
  misc_feature (30)..(30): n is a, c, t, g, unknown, or other
  misc_feature (31)..(31): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (50)..(50): n is a, c, t, g, unknown, or other
ttttggggggatggtttgngngtttttggnngtggcgccccccnnnnctntcaaagctggactccccgcggtggcggccgctctagaactagtggatcccccgggctgcaggaattcgtctcacccctagaaaaaatccaacccatcagtacccaaccttcccctacaccagaaaaatccccagttctttggtccgcgtcagagaggcggcggcgatgtctgggcgcggcaagggcggcaagggtctgggcaagggcggcgcgaagcgccaccggaaggtgctccgcgacaacatccaggggatccccaagccgggcgatccggaggctgggttaggaggggtggcggtgaagcgccatttcgggggctcacctaccaaggagacccgctggcgtgttcaaaaatttttttcgagaaacttttttccgggacccccttccccctacacccgagcaccgcgcgcctcttaagaaccttgaacccccctttggatttgtgttttacccgcccctaaggcgccccagggccccccccccctctttagcgttttcgggagagggttgggttcaggagccccccctctccccctttaacggggaattcgggtttgaggggaacgttggggttctttgggggaagaggttgttcggggggggaggatttgggcccgccagggcggcggggaaaaagtggcctgggtttgtggggggaggaaacgcgttttaaaaaggtgagccccagaagcggcgggggaccccgaggggaaaggatgatcattaggggagaaacaagagggggccccccgcgcaacgttgtgagggaagaccatcctccccctctgcacaaa

SEQ ID NO: 55405 - protein, 84 aa, Zea mays
  misc_feature: Ceres CLONE 1487938
MSGRGKGGKGLGKGGAKRHRKVLRDNIQGIPKPGDPEAGLGGVAVKRHFGGSPTKETRWRVQKFFSRNFFPGPPSPYTRAPRAS

SEQ ID NO: 55406 - DNA, 814 bp, Zea mays
  misc_feature: Ceres CLONE 1487939
  misc_feature: Encodes the peptide sequence at SEQ ID NO. 55407
tccccgcggtggcggccgctctagaactagtggatcccccgggctgcaggaattcgtctcacccctagaaaaaagcagtgacgaactcgaagcttgcgttcttgtagtagaggtcggcagcaagcggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactggcttcccgtgtccacggacaagggcacccccaagtaccggtgccgcgacttccccccccaaaaactgcggggtgcaagatccccctaaactcctccccaagggggcgcagcccaatgggaacccttccttggccccccccgtcccgcccccctttgttttttaaccggggggggcgccccccccaaaaaacccaccccccttggcggtggtttttcccacgttttaaattggtggtgccccctctccccccccgcggagggggaaaaaaaaaaaatttgcccgcgcccccctcccaattgtggttccaaaaaaaaaaaaaaaaaaaaaaaagcccccggggagccccacacttccccccctttagggaggtgtttattttccccccccccccgcgcgccctcttttttataccccggcgtgggggagaaaaacaccgcggggttccacacaaaatatagtggtgttggggaaaccccccctg

SEQ ID NO: 55407 - protein, 90 aa, Zea mays
  misc_feature: Ceres CLONE 1487939
MKSSTLLAILVLQALLVSAAVAKGPAGPTTKKQCWCGECTSWSGVWTCDDLLTKCAATCKNWLPVSTDKGTPKYRCRDFPPQKLRGARSP

SEQ ID NO: 55408 - DNA, 708 bp, Zea mays
  misc_feature: Ceres CLONE 1487940
  misc_feature: Encodes the peptide sequence at SEQ ID NO. 55409
aagctggagctccccgcggtggcggccgctctagaactagtggatcccccgggctgcaggaattcgtctcacccctagaaaaaatcatcgtccgtccaatccatccattcatctacacacgcagttgcagcacatacagctagctagctcgttactgtttttgcagctgatctgatcgaccgacgcgacccaccgatcacgatcatgagctaccaagcgggctacccaccgccgggccaacaggcctacggcgcgcctccgccggcgtacgtcgcgccaccgccggcgtacccgccaacggcccaggacggcggcgcggcgtactacggccagcagcagacaaccaccaccagcagcagccgcggcggcgacggtttctggaaaggatgctgcgccgccatctgctgctgctgcgtcctcgacatgtgcttctgaggacatatcgtcgatcgatcgacgacggccagggcatgctagctagctgatgaccggccggtacgtgcgtggttgatgatcaccatcatgtgctgctctagtagctgctgtgtcattatatattacacatcgtgtatacatatatacctatacgtacgtactcgtacgtcttcgaattcattccctggggttattgtattatacctatgcagcacactttgtactccaaccccgtggctgtggcccgggaattccaatgtccaagaccatcct

SEQ ID NO: 55409 - protein, 76 aa, Zea mays
  misc_feature: Ceres CLONE 1487940
MSYQAGYPPPGQQAYGAPPPAYVAPPPAYPPTAQDGGAAYYGQQQTTTTSSSRGGDGFWKGCCAAICCCCVLDMCF

SEQ ID NO: 55410 - DNA, 619 bp, Zea mays
  misc_feature: Ceres CLONE 1487941
  misc_feature: Encodes the peptide sequence at SEQ ID NO. 55411
  misc_feature (142)..(142): n is a, c, t, g, unknown, or other
  misc_feature (157)..(157): n is a, c, t, g, unknown, or other
  misc_feature (532)..(532): n is a, c, t, g, unknown, or other
  misc_feature (552)..(552): n is a, c, t, g, unknown, or other
  misc_feature (588)..(588): n is a, c, t, g, unknown, or other
aaagctggagctccccgcggtggcggccgctctagaactagtggatcccccgggctgcaggaattcgtctcacccctagaaaaactctgcttctggcgaccaaattctgccgtctccaccgccgccgcagccatcgtcaccnggagggatctgccgntctcccttgctccacgcgatgaacaccgacatcaccgcctcgactaagccggagtacccggtggtggatcggaacccggccttcaccaaggtggtcggcaacttctctgcgctcgactacatgcgcctctccaccatctccgccgtctccgtcaccgttggctacctctccgggatcaagccggggatccggggcccgtcgatggtcacgggcggcctcatcggggtcatgggagggttcatgtacgcctaccagaactccgccgggcgcctaatgggattctttcccaacgacgccgaggttgcgcgctacaagcacaagcttcattgaggatccagctccattccgtctctcttttcgcaccgtttcgcctgntcctttcctgatcccgtgtnaactcagtactttatctgggcactctatggcctggntaaataaaagtggtatgtttttgcacggtat

SEQ ID NO: 55411 - protein, 103 aa, Zea mays
  misc_feature: Ceres CLONE 1487941
MNTDITASTKPEYPVVDRNPAFTKVVGNFSALDYMRLSTISAVSVTVGYLSGIKPGIRGPSMVTGGLIGVMGGFMYAYQNSAGRLMGFFPNDAEVARYKHKLH

SEQ ID NO: 55412 - DNA, 714 bp, Zea mays
  misc_feature: Ceres CLONE 1487942
  misc_feature: Encodes the peptide sequence at SEQ ID NO. 55413
aagctggagctccccgcggtggcggccgctctagaactagtggatcccccgggctgcaggaattcgtctcacccctagaaaaagtgctttcttagaggtgggttggcttctcctccccctccggttcgggttctggttcgtgaggttctccggggttcgggttcgtgggtgagcggatcgagatggcggcgtcggatgttgagtaccgctgcttcgtcgggggcctcgcctgggccacggacgaccactccctccacaacgccttcagcacctacggcgaggtcctcgagtccaagatcatcctcgatcgggagacgcataggtcccgcggcttcggcttcgtcaccttctccacggaggaggcgatgcggaacgccatcgagggcatgaacggcaaggagctggacggccgcaacatcaccgtctacgaggcccagtcccgcggctgccttgtaggccgctgctgtggctacagtgttggccatagaggctgctgctacggcggtggctcgcgcccggatggcggttgccgctccggctttggcggccgctacggtgggcggccccggctacggagtttggcgtgggccgcttcccggggagagcaaccgtgggcgtcggtttccggcacctccctacgggtaactgggagaaattggagcggggggagccccccgccggcccaatttattccgggtccgccacccccggaag

SEQ ID NO: 55413 - protein, 177 aa, Zea mays
  misc_feature: Ceres CLONE 1487942
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETHRSRGFGFVTFSTEEAMRNAIEGMNGKELDGRNITVYEAQSRGCLVGRCCGYSVGHRGCCYGGGSRPDGGCRSGFGGRYGGRPRLRSLAWAASRGEQPWASVSGTSLRVTGRNWSGGSPPPAQFIPGPPPPE

SEQ ID NO: 55414 - DNA, 726 bp, Zea mays
  misc_feature: Ceres CLONE 1487947
  misc_feature: Encodes the peptide sequence at SEQ ID NO. 55415
aagctggagctccccgcggtggcggccgctctagaactagtggatcccccgggctgcaggaattcgtctcacccctagaaaaaaacggcgccacggcggcgacgagaagtggcgagccccgagagcgggtttagttagaggctacgggcggtcgggcgcggcggcggcggcggccatgagcagcgggagcgagagcactaccgccagcaggtggcccgagctggccacgctgcgcgcgctggcgcgcgacgccgcggagcagcttcggctgccgcgggccggcacgtcggcgtcggcgtcgtcgccgtggcgcgggcgcgaggaccacctccacggccacggcaagacggccaaggtgatgcacctgctgctctggggacccaagtgaagcggcgagaggccaccgtaccgccgggctctcccgctggcgttgctcgttttgctctgcctgcaatccgccccgcacggactgtactgtacctatatatacccctacatactacgacgtgcacctgtactacgacgtgctgctgtaccatactaaatactaatgcgctgctgctcccttgcctttcttgcttgcaccagccactccgctttttttgctcgaacgatcaactggctcgtgttcccgtccgggccaccgccccggtcctcaattttggggggggtcccctcccccttttaaagttcctttttttggggaacccccctgcaatggcaaaa

SEQ ID NO: 55415 - protein, 70 aa, Zea mays
  misc_feature: Ceres CLONE 1487947
MSSGSESTTASRWPELATLRALARDAAEQLRLPRAGTSASASSPWRGREDHLHGHGKTAKVMHLLLWGPK

SEQ ID NO: 55416 - DNA, 710 bp, Zea mays
  misc_feature: Ceres CLONE 1487949
  misc_feature: Encodes the peptide sequence at SEQ ID NO. 55417
  misc_feature (402)..(402): n is a, c, t, g, unknown, or other
aaagctggagctccccgcggtggcggccgctctagactagtggatcccccgggctgcaggaattcgtctcacccctagaaaaagcccagatagatctttcccccgtcctccctcgccttcgcctcgccggcaggagatttccaccaccaccgccggaccaccccgaccctccttccctctcgcgctatggcccagactgttgtgctcaaggttggcatgtcctgtgagggctgtgttggagctgtcaagcgggtcctgggcaagatggaaggcgtcgagtcctacgacgtagacatcatggaacagaaggtcaccgtgaagggcaatgtgacacctgacgccgtcctgcaaactgtttccaagactgttaagaacactccgctctgggaggcgggaggcctnacaagtgaatccgccacacctgccggcgccaccgcctgacaggttcgatgatctggaagtgcccgcaaaaaaatgtgaatgtatttagcttggatcttgtacaaataattgcaaactgctagctccgcctgtacattttacagctgcttttggatactggggagttcccgtatggttggggagccgataaaccacttttgtcaaaaaaaaaaataacaacaagtccttcaagttccccttttccccctttggggtgttattccccgggccctggggacgtttttttattccttgcggctcggaaaacc

SEQ ID NO: 55417 - protein, 84 aa, Zea mays
  misc_feature: Ceres CLONE 1487949
  misc_feature (5)..(66): Pfam Name: HMA Pfam Description: Heavy-metal-associated domain
  misc_feature: SWISSPROT Homolog: EC 3.6.3.4 Copper-exporting ATPase
MAQTVVLKVGMSCEGCVGAVKRVLGKMEGVESYDVDIMEQKVTVKGNVTPDAVLQTVSKTVKNTPLWEAGGLTSESATPAGATA

SEQ ID NO: 55418 - DNA, 727 bp, Zea mays
  misc_feature: Ceres CLONE 1487954
  misc_feature: Encodes the peptide sequence at SEQ ID NO. 55419
aagctggagctccccgcggtggcggccgctctagaactagtggatcccccgggctgcaggaattcgtctcacccctagaaaaacaagtgaggcccgggatgccggggccgccaccgcctggaatgaggcctggaatgcctccgccaccattcggacagacgaggcctggaatgccacctccgccacctgtgccacagcagcctgaacagaacccgccgcactatcttcctggataagcttcttgcagatacaccgtatgagaagatttttgtatctcgagagaggatcataatcacacctggggaggacctgagaattgcaccaaaactccaccattctgtctcgcatcaaggcagaaccttcctttgggtattgtgacttgtaaagcaggagaaccttgccagcgagtgtaccactcatccttcgatgtcagacgggaccttgtacggagagaggccacgactagcatcttaactgttggcgtacgccacgcaaggaaatatgataacttggctgcaggctcgataccgtggtgattcttgctcagattaagcccctgatttctctctctaaaaaaaggacgcttgcgttggttgatgaagcaagaaaaattggtctaaacgaacgttgttccctggttcttcactattccaaaaaaaaaaaaagaacagataacgtgcgagggccccaattcccccttttagtgggataaaattagccccgcccc

SEQ ID NO: 55419 - protein, 77 aa, Zea mays
  misc_feature: Ceres CLONE 1487954
AGAPRGGGRSRTSGSPGLQEFVSPLEKQVRPGMPGPPPPGMRPGMPPPPFGQTRPGMPPPPPVPQQPEQNPPHYLPG

SEQ ID NO: 55420 - DNA, 702 bp, Zea mays
  misc_feature: Ceres CLONE 1487955
  misc_feature: Encodes the peptide sequence at SEQ ID NO. 55421
aagctggagctccccgcggtggcggccgctctagaactagtggatcccccgggctgcaggaattcgtctcacccctagaaaaagccttcaattcatcgagcaccactgcacatctcgatcatcattttgcgatacacattctaccaaactcgatcgcaagaagaagaaacagctagctagctaccaatcaatggcgtccaacgacaacgtcgccgtggccagcgaggtgagcagcgccgtggccaagctcaacgaccacctcgccaccgccctcaccggcagcggcagtgagaacgccggcaccgtcatcacgctggcggggaagaacagcggcgccaccatggaggcggcggccgcgggcgacgtggaggacctcgtcgtcgtcggcagcgtggacgcggaggagcaccacgaaggccatggccaccaggacgaggaggaggaggtggaggagaacgtggtcatcaccgcctacgccaacagcaactaccaggccgtcaacaactcggtgctcgtcgctggcagctgcgccgtcgacgaccccggcgtgcacgtcgtcgtggtggagcatgtcgacgagatacgcgactacgacgaggacatcgacggccaagagttctaagcactactgcattgttattactgcaagctatatggatggattaattgaggggcatatatatatatatatatatatacacc

SEQ ID NO: 55421 - protein, 143 aa, Zea mays
  misc_feature: Ceres CLONE 1487955
MASNDNVAVASEVSSAVAKLNDHLATALTGSGSENAGTVITLAGKNSGATMEAAAAGDVEDLVVVGSVDAEEHHEGHGHQDEEEEVEENVVITAYANSNYQAVNNSVLVAGSCAVDDPGVHVVVVEHVDEIRDYDEDIDGQEF

SEQ ID NO: 55422 - DNA, 795 bp, Zea mays
  misc_feature: Ceres CLONE 1487957
  misc_feature: Encodes the peptide sequence at SEQ ID NO. 55423
  misc_feature (10)..(10): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
tgtttttttntttttttttttttttttttttttttttnnngcaaacaaaaaaaaaactggagctcaccgcggtggcggccgctctagactagtggatcccccgggctgcaggaattcgtctcacccctagaaaaaataccaacctacaattgtcacttccattttctcaataccttaagcaaggaccaatgtctcaagcccagccccctcgttcccaagcccagtggaaacacgttaaatttcaggataaccaagctaatgccatgaaggaaccaggaaccggtgggtatggctatgggacgaaaaatgacaagaataaggatgtggatacaatatcttcagacttcatcaagctgatacacaaggcttgggcactccagaagagcacaaccatgtaccaaccttctaccaaaagccttggatatttgcggatgcgcaatgaagttaccatggcatcattgctaataataagaaagtaatgtggtaatgaggagatgtgtaattttttttgcaatcttattttgcaacaattgatgtatatatggggcatgttttggttcaaataaataaaaactgatatggaaattaaaaagtatagaaagagagggcttcataaccgcttattttattaataaacatcgagggttacatataaacattatataaaaatatattttgaccgtacccctctctttggacccccctcttccctccttttgtgtcttgactatatattccattacaacaactgtgacctgtattataaaatagggttgtaaaaaaaaaaaaccccgg

SEQ ID NO: 55423 - protein, 71 aa, Zea mays
  misc_feature: Ceres CLONE 1487957
MKEPGTGGYGYGTKNDKNKDVDTISSDFIKLIHKAWALQKSTTMYQPSTKSLGYLRMRNEVTMASLLIIRK

SEQ ID NO: 55424 - DNA, 723 bp, Zea mays
  misc_feature: Ceres CLONE 1487963
  misc_feature: Translation starting site: 123
tctgaactagtggatcccccgggctgcaggaattcgtctcacccctagaaaaaagccgtcatcgcttcacgtccgctacagaccggcgaggagacgaaaggagggagttttgagaagctcaaatggctcctaaagccgctcctgccaagaagggtgatgccaaggcccaggccttgaaggtggccaaggctgtgaagtctggggcaggcaagaagaagaccaagaagattcgcacatctgtaacatttcaccagcccaagaccctgaagaaggccagggacccgaagtacccaagaatcagcactactggaagaaacaagcttgatcagtaccaaattttcaagtaccccctcaccacagggaatctgcaatgaagaaaattgaagataaccacccttctggtctttatttgttgacctccaaggcaaccaaaaaaaaaatccaaggctcccgtcaaaaaaaatgtatgacactttcagccaaagaagggcaaccccccctgattcagccctgatggggaaaaaaaaaagctttattttaaaacttaacacccgcacatccgatgccccttgaggtgggccaaaaaaaattggcctccctcccaagattaaaaagcgacctcagttcccacactcgcggatccaattaagtccggaagacaaccctcccaatttattctcatgggatccaggacatttcgttgtgcaccaatcaggcatttta

SEQ ID NO: 55425 - DNA, 664 bp, Zea mays
  misc_feature: Ceres CLONE 1488109
  misc_feature: Encodes the peptide sequence at SEQ ID NO. 55426
aaaagctggagctccccgcggtggcggccgctctagaactagtggatcccccgggctgcaggaattcgtctcacccctagaaaaagattacaaacccgtcctctgtccgtcctaccaccacagctcaccgcggtttggctttctcccctcttccgcacccgcttctcgctccggattccctctgctctttccctaacgaaggtagccatggcggggagaggtaaggcgatcggctcaggcgccgccaagaaggccacgtccaggagctccaaggctggcctccagttccccgtgggaaggatcgccaggttcctcaaggccggcaagtatgccgagagagtcggcgccggcgcccctgtctacctcgctgccgtgctcgagtatcttgctgctgaggttcttgagctggccggcaatgcggcacgtgacaacaagaagacccgcatcgtaccgcgccacatccagctcgccgtccgcaacgacgaagagctctcccgcttgctgggcacggtgaccatcgctagcgggtggtgtcatgcccaacatccataaactgcttctccccgaaaaagccggccgccggcaacgcccaggctgcggctgggtgacaaggactaaatcccttgactaccgcctggtgggcacttcccaggatgctgcccat

SEQ ID NO: 55426 - protein, 114 aa, Zea mays
  misc_feature: Ceres CLONE 1488109
  misc_feature (19)..(92): Pfam Name: Histone Pfam Description: Core histone H2A/H2B/H3/H4
MAGRGKAIGSGAAKKATSRSSKAGLQFPVGRIARFLKAGKYAERVGAGAPVYLAAVLEYLAAEVLELAGNAARDNKKTRIVPRHIQLAVRNDEELSRLLGTVTIASGWCHAQHP

SEQ ID NO: 55427 - DNA, 599 bp, Zea mays
  misc_feature: Ceres CLONE 1488114
  misc_feature: Encodes the peptide sequence at SEQ ID NO. 55428
aaagctggagctccccgcggtggcggccgctctagaactagtggatcccccgggctgcaggaattcgtctcacccctagaaaaagagagggggagagagagaggcgaggaaggagggagagagcacgggggcttgatcgaagatggatgccggagcaaaggtggtgaagaaggccgcggcggggcgtcgcggcgggggcggccccaagaagaagccggtctctcgctccgtgaaggccggcctccagttccccgtaggccgtatcggccgctacctcaagcagggtcgctactcccagcgtgtcggcaccggcgcccccgtctacctcgctgccgtcctcgagtacctcgccgccgagctcctcgagttggcggggaacgcagcgcgggacaacaagaagaaccggatcatcccgcgacacgtactgctggcgatccgcaacgatgaggagctcggggaagctactggcccggcgtcaccatcgcacaccgggggggttctgccccaacatcaacccctgggcctgctcccccaagaaaaccgccggtcgcctgctggcaaggggaaggcaaagaagaaaaaagtcccccccaaggaac

SEQ ID NO: 55428 - protein, 152 aa, Zea mays
  misc_feature: Ceres CLONE 1488114
  misc_feature (28)..(101): Pfam Name: Histone Pfam Description: Core histone H2A/H2B/H3/H4
MDAGAKVVKKAAAGRRGGGGPKKKPVSRSVKAGLQFPVGRIGRYLKQGRYSQRVGTGAPVYLAAVLEYLAAELLELAGNAARDNKKNRIIPRHVLLAIRNDEELGEATGPASPSHTGGVLPQHQPLGLLPQENRRSPAGKGKAKKKKVPPKE

SEQ ID NO: 55429 - DNA, 660 bp, Zea mays
  misc_feature: Ceres CLONE 1488116
  misc_feature: Encodes the peptide sequence at SEQ ID NO. 55430
aaagctggagctccccgcggtggcggccgctctagaactagtggatcccccgggctgcaggaattcgtctcacccctagaaaaagccctgcccctcctccgccttttcgcctctctccactttccccgtccttcgccgtcgcggccgcgtcctagtctgatggccagccgctgggtccgacccgaggtgtacccgctgttcgcggcgatgggagttgccgttggcatctgcgggtttcagctcttccggaacatcaccggcaacccggaagtcagggtaaacaaggcagggagggcagccggcgtgcttgagaaccatgaggaggggaggcgttacgccatgcatggcctcagaagctttgtgcacgacaagacccccgagatcatgccagctatcaacaagttctttactgaccccaagtgaagcaaagcagctttggttggccgctgatgacgatggttctgctactagttgcccttggggattgtgtaccctttttatggcaattcgatatgtgaatgagttcgacggtccctgtttgttcctcgtactcacctgtcatgtggatttgatgcacttcagtgataaaactgtcagccaacgttcattacaagtggatttttgcaaactggttatgtaaaagaataattaattgtcatt

SEQ ID NO: 55430 - protein, 87 aa, Zea mays; identical to SEQ ID NO: 40041
  misc_feature: Ceres CLONE 1488116
  misc_feature (2)..(88): Pfam Name: B12D Pfam Description: B12D protein

SEQ ID NO: 55431 - DNA, 754 bp, Zea mays
  misc_feature: Ceres CLONE 1488123
  misc_feature: Encodes the peptide sequence at SEQ ID NO. 55432
agaatgaataccggctgctactagtagtactggtacgacggcgagcagagcacagcacagcacagcagcgctacacgttgggcgtgcatccattcaggatcatggacgacggcgactggatcacggcgaggtacctcctctcgtcgatcctcgggcggaacccgctggtggtggactacgtcgacgaggagtccttccccgtcgaccttccacctcccgcgccgtccccctcttcctccggcggccgccgcgcggagccgccgccgccggtgcgcgcgcccgcgggggtggccggcacggtgtgcgcggtgtgcacggaggagatcgcggcggcggactccgtggcgcgcctgccctgcgcgcactggtaccaccacggctgcatcgcgccgtggctcgggatccgccccacctgccccatgtgccgcgccgagctgccgccgagggaagccgccgccggggaggatggcgccgggcgcgccaagccgccgcccgcggggaccagcgccggcgcgacggtcgcggccgcacgcgcaaggcgggacgcgccgtacgagctcctcgccggcggcgtgctgtccggctgatccggccgtcgagtagatagagagagagtttggcgcgtggacccggtcctagctgtgagctcagggccgccggctcctttgtttgtacagggcaaattgggtactccgaaaatcaataaaaaaacaaaaaaacaacatttttcgacccgcaaaaaaaaaaaaaaaaa

SEQ ID NO: 55432 - protein, 161 aa, Zea mays
  misc_feature: Ceres CLONE 1488123
  misc_feature (68)..(108): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MDDGDWITARYLLSSILGRNPLVVDYVDEESFPVDLPPPAPSPSSSGGRRAEPPPPVRAPAGVAGTVCAVCTEEIAAADSVARLPCAHWYHHGCIAPWLGIRPTCPMCRAELPPREAAAGEDGAGRAKPPPAGTSAGATVAAARARRDAPYELLAGGVLSG

SEQ ID NO: 55433 - DNA, 674 bp, Zea mays
  misc_feature: Ceres CLONE 1488126
  misc_feature: Encodes the peptide sequence at SEQ ID NO. 55434
  misc_feature (400)..(400): n is a, c, t, g, unknown, or other
caaagctggagctccccgcggtggcggccgctctagaactagtggatcccccgggctgcaggaattcgtctcacccctagaaaaacccttcgctgcgccgccgcctccgacatcgtctcttcgtccccacgagcaaccgataatccgccggcgctgagatgttggtttatcaagacctcctatctggcgacgagctcctgtcggattcattcacctacaaggagctcgagaacggcgtcctgtgggaggtcgagggaaagtgggtcacccaaggtcctgttgatgtagacattggtgccaatccatccgccgagggtggtgaggatgaaagcgttgatgacacagccgtgaaggtggctgatattgttgacacattccgtctacaggagcaacctccttntgacaagaaatcatttgtctcttccgtaaaaaactacatcaagaatctcactgctgtgttggagccggacaaagcggatgatttcaaaaagggtgtcgagggtgcaaccaagtttctccttagcaagctgaaggaccttccattttttgtttgtgagagcatgaaggaccaaccgtccgtggtattccgcctaattacaagatggtgcccctaatcccacattcctctatttccccccagggccttaaggagatcaggtgctagattagttacc

SEQ ID NO: 55434 - protein, 151 aa, Zea mays
  misc_feature: Ceres CLONE 1488126
  misc_feature (1)..(147): Pfam Name: TCTP Pfam Description: Translationally controlled tumour protein
  misc_feature (81)..(81): Xaa is any aa, unknown, or other
MLVYQDLLSGDELLSDSFTYKELENGVLWEVEGKWVTQGPVDVDIGANPSAEGGEDESVDDTAVKVADIVDTFRLQEQPPXDKKSFVSSVKNYIKNLTAVLEPDKADDFKKGVEGATKFLLSKLKDLPFFVCESMKDQPSVVFRLITRWCP

SEQ ID NO: 55435 - DNA, 634 bp, Zea mays
  misc_feature: Ceres CLONE 1488128
  misc_feature: Encodes the peptide sequence at SEQ ID NO. 55436
  misc_feature (634)..(634): n is a, c, t, g, unknown, or other
aaagctggagctccccgcggtggcggccgctctagaactagtggatcccccgggctgcaggaattcgtctcacccctagaaaaatcccccaccatttcttccctctcgccttcccctccgccgggaatcccacgtccaatcaaccgccgctccagccttccatccatacagcccgtagatggtctctattacgccagcgatcgacagaccaagaggagcaggagcgatggggaagagctcgttcaagctggagcaccccttcgaaaggaggcaagctgaggctaaccgcatcagggagaagtaccccgatagaattcctgacattgttgacaacgacgacaggagtgacatcccagacatcgacaagaaaaagtacctagtcccagccgacctcacatcgggacaatttgtgtacgtgctgcaagaactcataaaactcagcgcctaaaaggcaatattcatcttcgtgaaaaacaccctcccaccaacagctgctctgatgtctgccatctaccaggagaacagagacgatgacgggttcctctacatgacctacagcggcgagaacacctgtgggctgctatgagtggcgccgcgccgccgtggatcgacgaccgacaatgcccctactccn

SEQ ID NO: 55436 - protein, 73 aa, Zea mays
  misc_feature: Ceres CLONE 1488128
  misc_feature (14)..(74): Pfam Name: MAP1_LC3 Pfam Description: Microtubule associated protein 1A/1B, light chain 3
MGKSSFKLEHPFERRQAEANRIREKYPDRIPDIVDNDDRSDIPDIDKKKYLVPADLTSGQFVYVLQELIKLSA

SEQ ID NO: 55437 - DNA, 809 bp, Zea mays
  misc_feature: Ceres CLONE 1488130
  misc_feature: Encodes the peptide sequence at SEQ ID NO. 55438
aagcacagaatcaaaaatatctgcctgcctacctaccgatggccgccgcgttgtagttgtagtgtaacctagccacacgacgcatccgcggttcatcggcctcgcaggaaacgagcgtcgagcaaaaggtcgaattctcaactctcaagcaccagcaggaatcgagcgagcgagcgagcagtgtccgccccccatggccatggtcgcgtccacctccttcgcgtaccacaagccgcgtttcgcggtggtgtgcaggaagaacagggacggccgggacagggagcgggacggcaaggagcacaagcaccccttcaaggtcgtcgagatcacgccgcctccgcggtgcctcggcgtccgctgcttccccaccaacatccactgcggcgagagcgtgacgatcgaggggcaggcgtacacggtgtcggcggtgacgcaccggtaccagctgcgcaaggggcggtacgagccgagcgagaagcgcctcgacgtcctctccaccggcagatacatcctcaacctctacctccagaacctgctcgaccagtcctagctaccatacctgtatctgtactgtacatcagcatcgcttcactctgtatagatatacatacatatatatgttagctagtagcatcgaacacttgtcccggtgggtggcggacggagatagtgtttccctgcgtgctgctctgtgtaaactgaaaaatgcgagatgaggcataaagttcagtgaaaggttgcatacattttcttgaagaaaaaaaaaaaaaaaaaaaaaaaaaaaaaaaaaagaaaaaaaaaaaaaaaaa

SEQ ID NO: 55438 - protein, 118 aa, Zea mays
  misc_feature: Ceres CLONE 1488130
MAMVASTSFAYHKPRFAVVCRKNRDGRDRERDGKEHKHPFKVVEITPPPRCLGVRCFPTNIHCGESVTIEGQAYTVSAVTHRYQLRKGRYEPSEKRLDVLSTGRYILNLYLQNLLDQS

SEQ ID NO: 55439 - DNA, 735 bp, Zea mays
  misc_feature: Ceres CLONE 1488132
  misc_feature: Encodes the peptide sequence at SEQ ID NO. 55440
aaactggagctccccgcggtggcggccgctctagaactagtggatcccccgggctgcaggaattcgtctcacccctagaaaaactcaccaccactcatcaccaccagctgccattgccatctactgacctgtgacctccgcatttccaaacagcccgagcgagcgagctagcagagcggcggcaggcacctccctcctcaaggaacatggcccgcacgcagcagttggcagtagtggcggcggccgtggtggccttggtgctgctggcggcggcgacgtcagaggcggccatcagctgcgggcaggtggcgtcggccatcgcgccctgcatctcctacgcgcgcggccagggctcgggggcctcccccggctgctgcagcggggtcagggaactttaacaaatgccatccgcacccaccgcccaacccgccgcgccgccctgcaaattgccttcaagaaaccccccccgcccgggcgtcagccgggccctcaaccggccggttaaccccccgccaagcaatcccccttccaaaggggccgggggtccggcattccccctaccctcattcaggcacccctccacccaaactggttcccggggggtgaaacttgaacccccctaaaccaacgaaccaacgggcgccccgggcgggccttccctgaaagaacgaatcccactaatcttattcccaccccctcctttcggggtccctggcggggttcccgagaccgccc

SEQ ID NO: 55440 - protein, 63 aa, Zea mays
  misc_feature: Ceres CLONE 1488132
MARTQQLAVVAAAVVALVLLAAATSEAAISCGQVASAIAPCISYARGQGSGASPGCCSGVREL

SEQ ID NO: 55441 - DNA, 656 bp, Zea mays
  misc_feature: Ceres CLONE 1488137
  misc_feature: Encodes the peptide sequence at SEQ ID NO. 55442
aaagctggagctccccgcggtggcggccgctctagaactagtggatcccccgggctgcaggaattcgtctcacccctagaaaaaaagccagacataagacagcccgtcagcccctctcgtttttcatccgccttcgcctccaaccgcgtgcgctccacgcctcctccaggaaagcgagagcttctgcataagaacaacaagtcaaaagcttgatcagctcggtgccaacaaaacctcaacaaccaagtttcatgtctgatctcgacgtccagcttccatctgcctttgatccgtttgctgaggcaaatgctgaggactctggtgctggtcctggaacgaaggattatgtgcatgtgcgcatccagcagcgcaacggcagatagagtctgactacagtccagggtctgaagaaggacttcagctataacaagatcctcaaggatctgaagaaggaattctgctgcaatggtactgtagttcaggacccagagctaggccaggtcattcagctccaaggtgatcagcgcaagaatgttgctactttcctagttcaggcttggattgccgaaaaaagagaacatcaagattcacggggttccaagggcaccttgtaaatgccttgtgcccctaatattggggtgccccccaccctattg

SEQ ID NO: 55442 - protein, 43 aa, Zea mays
  misc_feature: Ceres CLONE 1488137
MSDLDVQLPSAFDPFAEANAEDSGAGPGTKDYVHVRIQQRNGR

SEQ ID NO: 55443 - DNA, 510 bp, Zea mays
  misc_feature: Ceres CLONE 1488140
  misc_feature (161)..(161): n is a, c, t, g, unknown, or other
  misc_feature (188)..(188): n is a, c, t, g, unknown, or other
  misc_feature (298)..(298): n is a, c, t, g, unknown, or other
  misc_feature (299)..(299): n is a, c, t, g, unknown, or other
aaagctggagctccccgcggtggcggccgctctagaactagtggatcccccgggctgcaggaattcgtctcacccctagaaaaaacccaagtccaagcaccttcccaaaaaaatcccccattttcttcgaggcgaggagagcgtgaaagacagggcacccnggcagcgacgaatgtcgggggcgcggncaaggggccggcaaaagggtctgggggccaagggggccggaaagcaaaaaaccggcccaccggtaaaggggggcctccccgggggacaaaaaccccttccccaggggggnngatttccccaaacccccaaatcctaggttgggttccaaggggggggttaaaaccttttgggggttttttccaaaggaacccccggggcctcaaaaatttccccaaaaaaccttcccgggacccccccccttaccaaaaaaccccccccccaaaaagtttttccccccggggagcctttttcccccccccagggggggggggggaaccccct

SEQ ID NO: 55444 - DNA, 662 bp, Zea mays
  misc_feature: Ceres CLONE 1488141
  misc_feature: Encodes the peptide sequence at SEQ ID NO. 55445
  misc_feature (612)..(612): n is a, c, t, g, unknown, or other
  misc_feature (662)..(662): n is a, c, t, g, unknown, or other
aaagctggagctccccgcggtggcggccgctctagaactagtggatcccccgggctgcaggaattcgtctcacccctagaaaaaaagccacaccaaacccgcgttcatcgacggacgagctcgccggcgagagagcgactgagatggaggcggcggcagcggcggccggcgtggagctgggctcctcgaagccccagatcgcgacgcaggcggagatggcggaggcccgggtgccgctcgcctaccgcgatcagtgcgcgcacctcctcatcccgctcaacaagtgccgcgtcgccgagttctacctcccctggaagtgcgagcccgagcgccacgcctacgagaagtgccagtacgagctcgtcatggagcggatgctccagatgcagaagatccgcgaggcgcaggagaccaaggtcaagggcggcgcctccattggcctcatcccggccaccgccaagctcgcctgatacgggtcccagaccgatccgcttgatttaggtctgcctgttggctatagcagcgtccagaggcgttgcgcccgtgcaggatccctcatgtttgtgtgtgacagagatacgcgtttgaatttgggcataagtaactgttgtncttcttttcccttccctctctctctatctccctgcctgatggctatcttn

SEQ ID NO: 55445 - protein, 108 aa, Zea mays
  misc_feature: Ceres CLONE 1488141
  misc_feature (1)..(89): Pfam Name: NDUF_B7 Pfam Description: NADH-ubiquinone oxidoreductase B18 subunit (NDUFB7)
MEAAAAAAGVELGSSKPQIATQAEMAEARVPLAYRDQCAHLLIPLNKCRVAEFYLPWKCEPERHAYEKCQYELVMERMLQMQKIREAQETKVKGGASIGLIPATAKLA

SEQ ID NO: 55446 - DNA, 658 bp, Zea mays
  misc_feature: Ceres CLONE 1488144
  misc_feature: Encodes the peptide sequence at SEQ ID NO. 55447
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (648)..(648): n is a, c, t, g, unknown, or other
  misc_feature (649)..(649): n is a, c, t, g, unknown, or other
aaagctggagctccccgcggtggcggccgctctagaactagtggatcccccgggctgcaggaattcgtctcacccctagaaaaagtccgactcccagccgtcgtctgctgcggactccgcctccagtttggtctgtttcttgcaagttgatcttgtggtagttcccccaactgtcaccatgcagaacgaggagggtaagactgtggacctctatgtccccaggaagtgctcggccacaaacaggatcatcactgccaaggaccatgcctctgtccagatcaacattggccacttggatgcgaatggcctgtatgatggtcacttcacaacgtttgctctctctgggtttgtccgtgctcagggcgacgcagacagctccttggacaggctgtggcagaagaagaaggctgatatcaagcagtagattttacatctagtttaccaagaattggacactgccttagctatgttttgaattcatgtcactatatgcaatgttgtgatttcagctggtaccttaaatctgaagatttagtatctttggttgggttccttctgattttgatgcgggggtgttcgtttaattccctttacaaccccatttagtatcattgtgatgattttgggatcaaaannnnnnngnnnngnnaaaaaaaaa

SEQ ID NO: 55447 - protein, 81 aa, Zea mays; identical to SEQ ID NO: 6959
  misc_feature: Ceres CLONE 1488144
  misc_feature (1)..(81): Pfam Name: Ribosomal_S21e Pfam Description: Ribosomal protein S21e

SEQ ID NO: 55448 - DNA, 649 bp, Zea mays
  misc_feature: Ceres CLONE 1488145
  misc_feature: Encodes the peptide sequence at SEQ ID NO. 55449
aaagctggagctccccgcggtggcggccgctctagaactagtggatcccccgggctgcaggaattcgtctcacccctagaaaaagcggcagctcgcatcaaaagaaaaagaaaagaaaaaaactagttccaactagtccctcccccaaccaccatggccgcttctgatgaccatgacctgaaggcgctgctgcaggtaagggtgagcgatgaggatggtgcgctggtggacgcgctcaaccgtcgagctgctgtttctgccgccgcccccagcttcttcgaggggttcgcgctccacgggatccgcgtggagagcatccgcccaggccacatcctctgctccttcacggtccccgcacgcctcacctccggcagcgatcacatagcccccggcgccgtggtggccctggtggacgagatcggctccgccgcctccgtgtccgacggccaccacctcaaggtctccgtcgacatgtccgtcaacttcgttgacctcgacgccggcgcgcccggggacgccctccgcatcacggccagggcgctcgggcacaaaggcgtctactccggcacgcacgtcatcgtcgccacccccgcaccgggcaagtggtcgccgagaggaagccctccctcctccggcagataagaacaag

SEQ ID NO: 55449 - protein, 162 aa, Zea mays
  misc_feature: Ceres CLONE 1488145
MAASDDHDLKALLQVRVSDEDGALVDALNRRAAVSAAAPSFFEGFALHGIRVESIRPGHILCSFTVPARLTSGSDHIAPGAVVALVDEIGSAASVSDGHHLKVSVDMSVNFVDLDAGAPGDALRITARALGHKGVYSGTHVIVATPAPGKWSPRGSPPSSGR

SEQ ID NO: 55450 - DNA, 658 bp, Zea mays
  misc_feature: Ceres CLONE 1488147
  misc_feature: SWISSPROT Homolog: EC 5.2.1.8 Peptidylprolyl isomerase
aaagctggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcttgggtgagcggatcgagatggcggcatcagatgttgagtaccgctgcttctgtcggcggactcgcctgggccacggacgacaactccctccacaacgccttcagcacctacggagaggtcctcaagtccaagatcttcctcgatcgggagacgcacaggtcccgcgtgcttcagcttcgtcaccttctccacggaggaggcgatgcggaacgccatcgagggcacgaacggcaaggagctggacggccgcaacatcaccgtcaactaggcccaatcctctcactgccgtggaggccgcgaccgtggttacagtggctgacgtgaatgcggcggctacggacggtgctgacgacaatgatggcatccgccctacggcggtagcctcatctgctactgtgagccgctcgcttacgatggtagtggcggcgactacagctgcgggatcgatgtgtcctctatcgtgactctgatgtgaactgtggaactgagcga

SEQ ID NO: 55451 - DNA, 678 bp, Zea mays
  misc_feature: Ceres CLONE 1488151
  misc_feature: Encodes the peptide sequence at SEQ ID NO. 55452
  misc_feature (458)..(458): n is a, c, t, g, unknown, or other
  misc_feature (591)..(591): n is a, c, t, g, unknown, or other
tctgaactagtggatcccccgggctgcaggaattcgtctcacccctagaaaaaacgctgcgagtgtctcggtagcttcttccccattcacattcggccattctccaccgtccaaccaaccaccggcggcggcacaagggaagcgaagaggaatcaacgcgatgtctgcgaccacggcggcggtgcccttctggcgggcggccgggatgacctacatcggctactccaacatctgcgctgcgctggtacggaactgcctcagggagctcttcaagtccgaggccgcgtcccgcgagaaggtccttttctccctctcccagtggactgtttttttttcccccccaccgcgggggggggggggggatccccatcaataaccccccctggtgtgtgttgtcggctcgatcattgattatggaatcaatctggacggggtccgtgaacgtcttgccgaagcanggcttttaggcggggccggaattatcttggacctccccccgacccccccccactattttaccaccccattggtccctctcgcggttccgcctttctcgccccccccccccgccgcgtttcgccccacccaaanccgcatcgccccgtcccgcccccactcgctccccccaaccacgtatgcgtctctcttctcaccctccctccctccccctctattctg

SEQ ID NO: 55452 - protein, 71 aa, Zea mays
  misc_feature: Ceres CLONE 1488151
  misc_feature (9)..(57): Pfam Name: ATP-synt_Eps Pfam Description: Mitochondrial ATP synthase epsilon chain
MSATTAAVPFWRAAGMTYIGYSNICAALVRNCLRELFKSEAASREKVLFSLSQWTVFFSPPPRGGGGDPHQ

SEQ ID NO: 55453 - DNA, 682 bp, Zea mays
  misc_feature: Ceres CLONE 1488152
  misc_feature: Encodes the peptide sequence at SEQ ID NO. 55454
  misc_feature (1)..(1): n is a, c, t, g, unknown, or other
natagctggagctccccgcggtggcggccgctctagaactagtggatcccccgggctgcaggaattcgtctcacccctagaaaaaatccactgcggcacgcgtcccgcctctggtttgcttgcctcccagatcttgccaactaattggaggcagccgagctgatctcccatcccgcaacgcgccgtctcgacggcggatcgttttcttctgcttctactgcgtgatctttgggcaagaagataagacacgtccaagcgtcgccacagtcaagggcggcttggttgcagtcaagatggggaaggacagagaatctgccaagctgaaggaggagaaggggtccaaggatgagatccatatgaaggtcaagagcaagggcgagccgtccggcgaggaagacggcaaggaggaggtcgaggtagagattgaggccaagtttgttgagaaggaagaggtcacaggctcgggtgacggtgcgggaggaaagggtaccaagaagaaggatccaaaggagaaagaccagaaaaagaaggaaaggtggtgaccattcagggaaggcagaggaagacaataagggtaaaccgaaagattcggaaggcaagggcccagtgaaaaaggaaaaaaaggatgggtgctggggaccaccggaggccaaggaaaaggggcaaacaaaaaaaaaggttg

SEQ ID NO: 55454 - protein, 82 aa, Zea mays
  misc_feature: Ceres CLONE 1488152
MGKDRESAKLKEEKGSKDEIHMKVKSKGEPSGEEDGKEEVEVEIEAKFVEKEEVTGSGDGAGGKGTKKKDPKEKDQKKKERW

SEQ ID NO: 55455 - DNA, 666 bp, Zea mays
  misc_feature: Ceres CLONE 1488156
  misc_feature: Encodes the peptide sequence at SEQ ID NO. 55456
  misc_feature (171)..(171): n is a, c, t, g, unknown, or other
  misc_feature (507)..(507): n is a, c, t, g, unknown, or other
  misc_feature (666)..(666): n is a, c, t, g, unknown, or other
aaagctggagctccccgcggtggcggccgctctagaactagtggatcccccgggctgcaggaattcgtctcacccctagaaaaaaaggcaccaacacaacaccactccaccgccgttcgaatattccaagcttgagattggaggaggggaggggaggggagccgagcgcanaaccctaattacctccatcgattgctaacagatctcagaggcaggggaggtaaaatgccaagagcaaatgaaatgttcagggcagattctagaatgatggtggtttttggtgccttgacatcgaaaccagagcagctgacattcgaagaaaccctcagatttgtcaagaaagtgaaggcccgcgattacatgctatacctgtcattgttcgacattcttggcagaatggaactatcccagctcgatgcctaccgagagttacagctgctgtttggaaaccacccggatctgtgcgaagagctcgagaagttcaggccaccggtgcctacaaagcangcagcaaacaacatctggccctgggtcatttgttgccccgtccccgttggttgcggtcagcctgatcccggcgctcggaaacccagtgctgtggttcgttcagcaaactgtccggccagaaatggccgccctgattgaagaaaccactgcagtacatan

SEQ ID NO: 55456 - protein, 139 aa, Zea mays
  misc_feature: Ceres CLONE 1488156
  misc_feature (94)..(94): Xaa is any aa, unknown, or other
MPRANEMFRADSRMMVVFGALTSKPEQLTFEETLRFVKKVKARDYMLYLSLFDILGRMELSQLDAYRELQLLFGNHPDLCEELEKFRPPVPTKXAANNIWPWVICCPVPVGCGQPDPGARKPSAVVRSANCPARNGRPD

SEQ ID NO: 55457 - DNA, 666 bp, Zea mays
  misc_feature: Ceres CLONE 1488157
  misc_feature: Encodes the peptide sequence at SEQ ID NO. 55458
  misc_feature (624)..(624): n is a, c, t, g, unknown, or other
aaagctggagctccccgcggtggcggccgctctagaactagtggatcccccgggctgcaggaattcgtctcacccctagaaaaactcgagcctgacccttacgccttcgctcgcgccgccgccgccgccgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaggagcacgatccgccgcctgagggagcagactgaagcatgatatagctctttatattattggggtttcctgtagttgctcttgtcaggcatgttgtgggggccttatctagtggaaatgtggaatcactgtactggctgttttgccaaaacaatgctccttataattgggtttatgctctaaggatctcaaagttggtgttaaaaaaaacccccanccaaaaaagggagaaaaaaaataaaaaccgagaccgctcgag

SEQ ID NO: 55458 - protein, 92 aa, Zea mays; identical to SEQ ID NO: 7812
  misc_feature: Ceres CLONE 1488157
  misc_feature (2)..(91): Pfam Name: Ribosomal_L37ae Pfam Description: Ribosomal L37ae protein family

SEQ ID NO: 55459 - DNA, 685 bp, Zea mays
  misc_feature: Ceres CLONE 1488158
  misc_feature: Encodes the peptide sequence at SEQ ID NO. 55460
ataagctggagctccccgcggtggcggccgctctagaactagtggatcccccgggctgcaggaattcgtctcacccctagaaaaaccgtccctgtccgcgcctcgttcgcaccacagaaccagctggggctagcccgccgcgcagcgcagccacaaattaaacggagcccggccggggcatccattattcgttgcagtagtcgcagctgacggacgactgaaccaccgacagacaacatggccgcctccgcctccaccgtctccggcctcgccggcgcctccctggccagccgcccggcgttctccaccagcttcacgcggggcagccgggtgtcggcgaggaaccccctgatgagcaggaacctggagaggaatggcaggatcacctgcatgacgtttccccgggactggctgcggagggacctgaccgtcatcggcttcgggctcatcggctggatggggccgtccagcgtcccggccatcaacggcaacagcctcacggggctcttcttctcaagcatcggccagaagctgggccatttccccacgcccccggccggtaacctcccaattctgggtgggggctagtgaacggggcacctgggccctggttatccggggcccaccttcgggccaaatacgaattcaaggggaaggacccgaagactaacttccgaaaaatgga

SEQ ID NO: 55460 - protein, 116 aa, Zea mays
  misc_feature: Ceres CLONE 1488158
MAASASTVSGLAGASLASRPAFSTSFTRGSRVSARNPLMSRNLERNGRITCMTFPRDWLRRDLTVIGFGLIGWMGPSSVPAINGNSLTGLFFSSIGQKLGHFPTPPAGNLPILGGG

SEQ ID NO: 55461 - DNA, 955 bp, Zea mays
  misc_feature: Ceres CLONE 1488160
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (34)..(34): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
tttattcccacttttttttcaccccnnnnnnntnttnnnccgttannnncaaccgatgggctccccgcggcggcggcccctctacaatagtgggatcccccgggctgcaggaattcgtctcacccctagaaaaaaacccctagaaaaaagtctcgctccaaaccaaagccatcggaggagcaactggacgaccctggcttccccgctgctcaggtcacactgggaggtcgtcgccgccgccgacctgaactccttgaggagagccaaccgcccgccctgcccaccccacccggggcccactccatgcccgcggcgtgcggccggggctcttctcccccctcccccttgccccggggtgtccccctctccgcgcccctgttttatgttccccccgcttgccccgggtcgggcgcccgattctctttttccccccccccccccgggggggggggggggggggggggccctcctctttccccccccctactctctccccgtggggcattggttggttcccccctgtggcgccgcgttaccccttcctcgtctacctctcttccgatctccgccgcgcttccgcgcctcctttctcccctacccgccctacccgcgagcccggcccccctgacataagacatggcccagccctgtatttccgcggtgactccggggagcgcaggagtctgaataaatccccccgctcatagttccgtttcccaccactattttcctctttattgggccacggttggccccttccccccttaagtagcccccctctccatacaaaataacgccagcgcgcgcagttcgcgggttgtggccgggcgaccgcgccgccggcacctcggttacccgcgcctggccgtaagccgcggacgaatggccgctcggggtgtgcccgccggacgcgcggcggggcgtgctggccgctaagatccatggcgccgcgcct

SEQ ID NO: 55462 - DNA, 706 bp, Zea mays
  misc_feature: Ceres CLONE 1488265
tcgagccctgcagtggtaaaggcttgtggcgtatacgttcctgtactggcttcccttctatatcagccacacaggtttgtttgtcaagtttctaaaatgttttgccattttattttactgcatcgaatcgctgtggttctaactaataactgtgttcctgtgtttcagctatcggtgcagaatacttgtcggactccgcagccggggtactgtcgacgctgttctacatgggcggcgtcgtgggcggcatcctcgccggccacatctccgaccacctggacgcccgggcgctgacggccgcgagcttcaccttctcggcgataccggccgctcttcttctaccgcgtctacgggaacgtctcgcttggcctggaaaaattgccctcatgttcgttcccccccgaagctgggtgaaaggggccccttattcccttaatcaggaccggccgttgttccgcggaacctttggcaacggccaggttttggttaatcgggaaattccccgtgcggctgggcccacccgtaccgggctaatcatcttacggggccgggggtcctattggaccctcccagatggaacccggtccctcacggggctatatttttcccccccgaaaactaggagaacccccttgtttcccaattcctcaagagggatcctcccctcatcctcagggggccatccggtatttcaaccttcttgcgc

SEQ ID NO: 55463 - DNA, 663 bp, Zea mays
  misc_feature: Ceres CLONE 1488267
  misc_feature: Encodes the peptide sequence at SEQ ID NO. 55464
tcgagccctgcagtggtaaaggtcttccctcgccacaaaacaccatctgctctgctctgctctctccctctgtcttcccttcctccttcccaggaactccattgcactatttccaccccaagaacacagcacagagtcggatccgaatccacaggagaggcagaagcacaactcactccccactccctccacccatcagctagccatgggcaaggactgcggcaaacacggcgacgacgacctccggcgctcgtgcaggcgcctgctagccatcctcgtggtcctcgcgctgaccgttggcgtcgtcgcgctgatcgtctacctggtgctccgccccacgcacccgcgcttctacctgcaggacgcgtcgctccggcagctggacctctccaacgccaccaccagcaccagcaccagcaccctgctctccaccgcgatccaggtgacgctagcgtcgcgcaacccgaacgagcgcgtcggggtctactacgaccgcctcgacgtgtacgcgtcgtacaagtaccagcagctcacggtggcggcgtcgctgccgcccgcgtaccagggccacggggacgtcggcgtctggtcgccggtgctggccggtcccaacgtgcccctcgcgccctacctcgccgacgcgctccgccaggactgccaggc

SEQ ID NO: 55464 - protein, 152 aa, Zea mays
  misc_feature: Ceres CLONE 1488267
  misc_feature (39)..(151): Pfam Name: Hin1 Pfam Description: Harpin-induced protein 1 (Hin1)
MGKDCGKHGDDDLRRSCRRLLAILVVLALTVGVVALIVYLVLRPTHPRFYLQDASLRQLDLSNATTSTSTSTLLSTAIQVTLASRNPNERVGVYYDRLDVYASYKYQQLTVAASLPPAYQGHGDVGVWSPVLAGPNVPLAPYLADALRQDCQ

SEQ ID NO: 55465 - DNA, 685 bp, Zea mays
  misc_feature: Ceres CLONE 1488277
  misc_feature: Translation starting site: 509
cgattgggtaccgggccccccctcgagccactgcattggtaaagggtgctttcttagaggtgggttgggttctcctccccctccggttcgggttcgggttcgtgaggttctccggggtgcggtttcgtggctgagcggatcgagatggcggcttcggatgttgagtaccgctgcttcgtcggcggcctcgcctgggcgacggccgaccactccctccacaacgccttcagcatcgtacggcgaggtcctcgaatccaagatcgtcctcgatcgggagacgcaaagggcccgcggcttcgagcttcgtcaccttctccgctgaggaggctgatgcggatcggccatcgacgacatgaagctcaaggtatctggagggccacatcatcaccgtcaacgaggaccagaccggcgacggccgtggaccccgctccggcggctacgtgggtcgcccctggatctggcagctccgcacctgggcgctgccccgagacccgcggcgcctacggcaatgtctgcttcttgctcggcgccgccggctgctacagtgctgctggcggtactaacggaactggatcttctgcgtgaagataccgaaactccgaagagaaagtgcatggacttcatcgtcggggcacgtggtccgacatcttctcctgatgccctagcacaggggtggcccgccaaa

SEQ ID NO: 55466 - DNA, 677 bp, Zea mays
  misc_feature: Ceres CLONE 1488282
  misc_feature: Encodes the peptide sequence at SEQ ID NO. 55467
cgattgggtaccgggccccccctcgagccactgcagtggtaaaggagggcgcggcagcagcggcggcgagagaaaaaagcagcggcagtgggcagaggcgagagggcactcgactcctccagcgtccaacgccatccatccccgacctcgcaacgcaagcaaagaaagcccaggcaggcgtgtgcacggcgcggcggggcaaccaagggtgggtgaacccgcagagaggggcagctagcttccttccttcccaggcgcgcgggagaggttagccgccgtataagtagacagccagccagccatgtcgtcggtgtcgtcgtcgctgtccaacttcctgctctgctgcttctacccgtcatccgccggccaccaccgcggcggcgcctactactacagcagccacccgacgagcgccagcaccctgcactaccacgagggcaccttcgccgggcgcagggccatgggccggagcagcaggccgctgtcgctgcagacggtggagctgaaggtgcgcatgtgctgctcgggctgcgagcgcgtggtgaagcacgcggtgacgaggctgcccggggtggactccgtggaggtggacgtggagatggagaaggtgacggtgacggggtacgtggacccgcctcggttgctcaaagaggtccggcgcgacgggaagaaagcga

SEQ ID NO: 55467 - protein, 125 aa, Zea mays
  misc_feature: Ceres CLONE 1488282
  misc_feature (67)..(124): Pfam Name: HMA Pfam Description: Heavy-metal-associated domain
MSSVSSSLSNFLLCCFYPSSAGHHRGGAYYYSSHPTSASTLHYHEGTFAGRRAMGRSSRPLSLQTVELKVRMCCSGCERVVKHAVTRLPGVDSVEVDVEMEKVTVTGYVDPPRLLKEVRRDGKKA

SEQ ID NO: 55468 - DNA, 662 bp, Zea mays
  misc_feature: Ceres CLONE 1488284
  misc_feature: Encodes the peptide sequence at SEQ ID NO. 55469
tcgagccctgcagtggtaaagggaagacggcagaaccgcagaagtgcagcagaacgatcggatctagcagaattctctcaacctcatcggcggcggcgaagagcgtgcggatcggagatggagacaagcgggtggaggaggagagcggcggcgcgggcctcctggagccccgccacggtgtacctgtggctcgcgctcgccgcagcagcactgacgctcgcccaggctaagaaggacctaacggaggttacccacaaggtctacttcgatgtcgagattgacggcaagcccgcaggtcggattgtcatggggctttttgggaagactgttcctaagacagcagagaacttccgagctctttgcacaggagagaaaggaattggcaagagtggcaaagctctccactacaagggaagtacattccacagaatcattcccagcttcatgctccaaggaggtgacttcactcttggggatgggaggggtggtgaatctatctatggcatgaaagttgctgatgagaacttcaagatcaagcacactgggacaggccttctgtccatggccaatgctgggagagatacaacggatctcagtttttcatcaccacccgtgacaacaagctggttggacgggaagcatgttgtgttttggcaggtgtt

SEQ ID NO: 55469 - protein, 181 aa, Zea mays
  misc_feature: Ceres CLONE 1488284
  misc_feature (47)..(181): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
METSGWRRRAAARASWSPATVYLWLALAAAALTLAQAKKDLTEVTHKVYFDVEIDGKPAGRIVMGLFGKTVPKTAENFRALCTGEKGIGKSGKALHYKGSTFHRIIPSFMLQGGDFTLGDGRGGESIYGMKVADENFKIKHTGTGLLSMANAGRDTTDLSFSSPPVTTSWLDGKHVVFWQV

SEQ ID NO: 55470 - DNA, 654 bp, Zea mays
  misc_feature: Ceres CLONE 1488292
  misc_feature: Encodes the peptide sequence at SEQ ID NO. 55471
cgggccccccctcgagccactgcagtggtaaagggggcggccaggctccctcctcctccctgcaaatcctgcagacaccaccgctcgtttttctctccgggacaggagaaaaggggagagagaggtgaggcgcggtgtccgcccgatctgctctgccccgacgcagctgttacgacctcctcagtctcaggagcaagatgggtgccggcggcaggatgaccgagaaggagcgggagaagcaggagcagctcgcccgagctaccggtggcgccgcgatgcagcggtcgccggtggagaagcctccgttcactctgggtcagatcaagaaggccatcccgccacactgcttcgagcgctcggtgctcaagtccttctcgtacgtggtccacgacctggtgatcgccgcggcgctcctctacttcgcgctggccatcataccggcgctcccaagcccgctcggctacgcggcctggccgctgtactggatcgcgcaggggtgcgtgtgcaccggcgtgtgggtcatcgcgcacgagtgcggccaccacgccttctcggactactcgctcctggacgacgtggtcggcctggtgctgcactcgtcgctcatggtgccctacttctcgtgaaagtacagccaccggcgccaccactcca

SEQ ID NO: 55471 - protein, 142 aa, Zea mays
  misc_feature: Ceres CLONE 1488292
  misc_feature: SWISSPROT Homolog: EC 1.14.99.33 Delta(12)-fatty acid dehydrogenase
MGAGGRMTEKEREKQEQLARATGGAAMQRSPVEKPPFTLGQIKKAIPPHCFERSVLKSFSYVVHDLVIAAALLYFALAIIPALPSPLGYAAWPLYWIAQGCVCTGVWVIAHECGHHAFSDYSLLDDVVGLVLHSSLMVPYFS

SEQ ID NO: 55472 - DNA, 687 bp, Zea mays
  misc_feature: Ceres CLONE 1488293
  misc_feature: Encodes the peptide sequence at SEQ ID NO. 55473
cgattgggtaccgggccccccctcgagccactgcagtggtaaaggagtgtttgtgtttgtcgcctatacgcctcaaggccctctttccccctctccgccttgactcactcacttggccactcttcttcctcctcatcaatccgctctccagcacttgttcggaagaaaaagaagctagaacacgctatcaagacaacatggatcatggggcgcgggcgcggccacctcctgctgacggcagcatccgcctgcctgtgggagctgtcatacccgctgctgctacgagcgacccctcaccgagctggcgccggccccggtcggctgctgaggttcagcctcagcaggcgtggaggcggactctaccaacgctcgctggcagtggccaaagtcgcaaaggcaccatgattcaggtcgactcgatccctcaggaggtgacgacgtccctctcgacgactacctcaacacccaatactatggggtcggcagcatccggccaccgccgcctatgttcaccatcttcttcgcacacgagagcctccaatcatatgggtccccccctcaagatgctacgttctcgattgcctgcaaccctgcaccatacatacgagtacggccttgttcaaacccgtacaacgcgggaaggctgaaacctgaaagaaaacccttcgggaacggcttcgatccccc

SEQ ID NO: 55473 - protein, 66 aa, Zea mays
  misc_feature: Ceres CLONE 1488293
MGRGRGHLLLTAASACLWELSYPLLLRATPHRAGAGPGRLLRFSLSRRGGGLYQRSLAVAKVAKAP

SEQ ID NO: 55474 - DNA, 682 bp, Zea mays
  misc_feature: Ceres CLONE 1488294
  misc_feature: Encodes the peptide sequence at SEQ ID NO. 55475
cgattgggtccgggccccccctcgagccctgcagtggtaaaggtgctttcttagaggtgggttggcttctcctccccctccggttcgggttcgggttcatgaggttctccggggttcggtttcctgggtgaccggatccagatgccggcgtcggatgttgagtaccgctgcttcgtctgcggcctcgcctgggccacggacgaccactccctccacaacgccttcggcacctacggcgaggtcctcgagtccaagatcatcctcgatcgggagacgcggaggtcccgcggcttcggcttcgtcaccttctccacggatgaggcgatgcgaaacgccatcgagggcatgaacggaagcgagctggacggccgcaacatcaccgtcaacgaggcccattccggcggcggccgtggaggcggcggcggtagatacggtggtgtccgtgaagtcggcgactacggcggtggcaggcgccgtgatggcgacggcggctacttccgtgacggccgcctctacggtggcgtcggccgcctacagtggtgttggtcggggctaacggtggcggaaacgtggctggggagctacggaaacttccaccggacactggaagacctgagccgtggggccccgcccggcccaatttaacctgtttcccttgccgtggttgtttacaccacaatcc

SEQ ID NO: 55475 - protein, 167 aa, Zea mays
  misc_feature: Ceres CLONE 1488294
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MPASDVEYRCFVCGLAWATDDHSLHNAFGTYGEVLESKIILDRETRRSRGFGFVTFSTDEAMRNAIEGMNGSELDGRNITVNEAHSGGGRGGGGGRYGGVREVGDYGGGRRRDGDGGYFRDGRLYGGVGRLQWCWSGLTVAETWLGSYGNFHRTLEDLSRGAPPGPI

SEQ ID NO: 55476 - DNA, 664 bp, Zea mays
  misc_feature: Ceres CLONE 1488295
  misc_feature (570)..(570): n is a, c, t, g, unknown, or other
cgattgggtaccgggccccccctcgagcctgcagtggtaaaggggcccccgccggcgccgctcttcgagcccggggagctcaagtcctgctccttctaccgcgccggcatcaccgaattcgtcaccgccttcctcttcctctacatctccatcctcaccgtcatggacgtctccaagtacacctccaagtgcgccaccgacggaatccaggggatcgcctggtccttcggcggcatgatcttcgccctcgtctactgcaccgccggcatctccggtgggcacatcaacccggcggtgacctgcgggatgctcctggcgaggaagttgtccctcaccaggacagtgttttacatcatcatagcagagcctgggcgccatctgcggcgcggtcgtcgtcaaggggttccagcatgtgctgtacatgcgcaacagcagtggctccgacgtcgtcacgccaggctacaccaaggtcaacagcctcggcgccgagatgcgtagcatcttcatcgtcgtctacacggtcttctacgccaccgacgacgagatgaacgccgcggactcccatgtgcngatcctcgccccactactatcggggttgacgtgttcctcgatcacgtgaccgacactcctatcatcagggccggtgtcaactcacgcgaggagg

SEQ ID NO: 55477 - DNA, 677 bp, Zea mays
  misc_feature: Ceres CLONE 1488297
  misc_feature: Encodes the peptide sequence at SEQ ID NO. 55478
  misc_feature (504)..(504): n is a, c, t, g, unknown, or other
  misc_feature (562)..(562): n is a, c, t, g, unknown, or other
cgattgggtccgggccccccctcgagccctgcagtggtaaagggaggaaaagcacgcgagagcttgtcggagggctctctgtctctgtgataaaccgatacgcagaggaagctgcggagaggtgtccctgctctgccggtgagctgcggccagcgggtgaagagaagtggaccggacggggacgaaggagagagagaagaagaaaaaggcgccgcgggggccatggctggacacgcgccggcgagggacaagaccaccaccggcttcgccgctacgtgcagcctgctgagccagtttctcaaggagaagaagggcggcctgcagggcctcggcggcctcgccatggcgccggcgccggcagctggagcaggggctttccggccgccgaccaccatgaacttgctgtccgcgctcgacgcggccaaggccaccgtcggggagccagaaggccatggccaacgcaccggcgggaatccaagggaggcagctggggaggaggcgcancagctgaccatcttctacggcggaaaagtggtcgtcttcgacaggttcccctccgccnaggtcaaggacctgctgcagatcgtgagcccgccgggggccgacgccgtggtggacggtgccggtgccggtgccgctgtccctacgcagaacctgccctagccttcacacgacag

SEQ ID NO: 55478 - protein, 146 aa, Zea mays
  misc_feature: Ceres CLONE 1488297
  misc_feature (94)..(94): Xaa is any aa, unknown, or other
  misc_feature (114)..(114): Xaa is any aa, unknown, or other
MAGHAPARDKTTTGFAATCSLLSQFLKEKKGGLQGLGGLAMAPAPAAGAGAFRPPTTMNLLSALDAAKATVGEPEGHGQRTGGNPREAAGEEAXQLTIFYGGKVVVFDRFPSAXVKDLLQIVSPPGADAVVDGAGAGAAVPTQNLP

SEQ ID NO: 55479 - DNA, 681 bp, Zea mays
  misc_feature: Ceres CLONE 1488299
  misc_feature: Encodes the peptide sequence at SEQ ID NO. 55480
  misc_feature (496)..(496): n is a, c, t, g, unknown, or other
  misc_feature (525)..(525): n is a, c, t, g, unknown, or other
  misc_feature (569)..(569): n is a, c, t, g, unknown, or other
  misc_feature (619)..(619): n is a, c, t, g, unknown, or other
  misc_feature (681)..(681): n is a, c, t, g, unknown, or other
cgattgggtaccgggccccccctcgagccactgcagtggtaaaggagagtattaagccaacggaaaaaaaaagaagagagctactacagcaatggccggaggagatgacctgaagctgctgggcctgtgggcgagcccgtacgtgctgcgggtgaagctcgcgctcagcctcaagggcctgagctacgagaacgtggaggaggatctgagggacaagagcgagctcctgctcaagtccaaccccgtgcaccagaaggtccccgtgctgatccacggcggcaagcccatctgcgagtcgcaggtcatcctgcagtacatcgacgaggccttcgccggcaccggcccgtccctcctccccgccgacccctacgagcgcgccgtcgctcgcttctgggccgcctacatcgacgacaagatgctgcccgcctggaaccagtcgacgatgggcaagacggaggaagagagggccgaggggaagaagcagtcggtcgtgacngtggagacgctggagggcgcgctgagggnactgcgcggccaagggaagcccttcttcggtggggacagcgtcnggtacgtcgacgtcgtgctcggcggccctgctcggtgggtgcgcgcgtcngaggagctgcacggcgtcaggccctttcgaccccgagcggactccgcttgctgcggcgtgtn

SEQ ID NO: 55480 - protein, 196 aa, Zea mays
  misc_feature: Ceres CLONE 1488299
  misc_feature (5)..(78): Pfam Name: GST_N Pfam Description: Glutathione S-transferase, N-terminal domain
  misc_feature: SWISSPROT Homolog: EC 4.4.1.5 Lactoylglutathione lyase
  misc_feature (145)..(145): Xaa is any aa, unknown, or other
  misc_feature (160)..(160): Xaa is any aa, unknown, or other
MAGGDDLKLLGLWASPYVLRVKLALSLKGLSYENVEEDLRDKSELLLKSNPVHQKVPVLIHGGKPICESQVILQYIDEAFAGTGPSLLPADPYERAVARFWAAYIDDKMLPAWNQSTMGKTEEERAEGKKQSVVTVETLEGALRXLRGQGKPFFGGDSVXYVDVVLGGPARWVRASEELHGVRPFRPRADSACCGV

SEQ ID NO: 55481 - DNA, 661 bp, Zea mays
  misc_feature: Ceres CLONE 1488303
  misc_feature: Encodes the peptide sequence at SEQ ID NO. 55482
  misc_feature (605)..(605): n is a, c, t, g, unknown, or other
  misc_feature (661)..(661): n is a, c, t, g, unknown, or other
cgggccccccctcgagcactgcagtggtaaaggcgtccggggccgtaacggtggccgcggcgccgatccccatggctctgccggtgcggccggcctcaccgtcgctctctaccgacgagcatgtcctctcctctaactccggatccgccgaggaccacccgcaggctgccgcttccggctccgtcagcgcgtcggcgtccggcgacacgggggaggaaaacgagcgcctccggcgggagaacgcgcggctgacccgcgagctcgggcagatgaagaagctctgcaacaacatcttgctcctcatgaccaagtacgcctcctcccagcagctagacgcctctgcagcgctctcctctgtcgtcaactgctccggcgagtcatcggaggccgtacccgcgcctccgcccctccccccggcgatcctcgaactaatgcccgcgtgcccgggtcttgccaccgcggccgcgggcctcgtcgccgaagcggatcctgaccaggcctcgaggctgttcggcgtctctatcggcatgaagcggatgcgcgacgacgacgacaccggcgaagaacaggcggaccacggcgccgcagcggatgtgaagacggangcgtcggatccgcagcatcgcatggagccgtcgccggagtcgccggaacagcatcn

SEQ ID NO: 55482 - protein, 219 aa, Zea mays
  misc_feature: Ceres CLONE 1488303
  misc_feature (201)..(201): Xaa is any aa, unknown, or other
GPPSSTAVVKASGAVTVAAAPIPMALPVRPASPSLSTDEHVLSSNSGSAEDHPQAAASGSVSASASGDTGEENERLRRENARLTRELGQMKKLCNNILLLMTKYASSQQLDASAALSSVVNCSGESSEAVPAPPPLPPAILELMPACPGLATAAAGLVAEADPDQASRLFGVSIGMKRMRDDDDTGEEQADHGAAADVKTXASDPQHRMEPSPESPEQH

SEQ ID NO: 55483 - DNA, 695 bp, Zea mays
  misc_feature: Ceres CLONE 1488308
  misc_feature: Encodes the peptide sequence at SEQ ID NO. 55484
  misc_feature (398)..(398): n is a, c, t, g, unknown, or other
  misc_feature (424)..(424): n is a, c, t, g, unknown, or other
  misc_feature (425)..(425): n is a, c, t, g, unknown, or other
cgattgggtaccgggccccccctcgagccactgcagtggtaaagggaacgaagcccattacatgcggtgacgggtgggcgtctcgtcttctccgacgagggagccccagccactagctaccaacccgtgaccctaaaaccaactaaagtccagaacagaggcagctctcttggcgtgctcacctgcttgctccaagatttacccctccctcggtgcctgatacctctatcctccgcatccgtctctaaagacaaggcagtcgtcaagaaagggagtttgaccaagagcctgtggtgtccgtcggctgccatccatggcaggggaagccaagaagctcttcttcgcatccgaggttactctccacgcctcccagaaggactgctgggtcgtcatcggcngcaaggtgtatgatgtgaccaagttnnctggaagacaccctgggggagaggtgtgctttctcatgcatcagcctctgggggatgcacggaaagcattcaaagaggggggaccaggaccttcaccggtcagattgatggaaagctacttgaattggaagcattcagggattaatgtcctcccaagggctccaaaggccacaatccttggaaagcctgaggtttccccaatttccggggaaatggaggggaaaaaaatcccccccaaacccaaaacctcccgggaattttttttcccct

SEQ ID NO: 55484 - protein, 127 aa, Zea mays
  misc_feature: Ceres CLONE 1488308
  misc_feature: SWISSPROT Homolog: EC 1.7.1.1 Nitrate reductase (NADH)
  misc_feature (29)..(29): Xaa is any aa, unknown, or other
  misc_feature (37)..(37): Xaa is any aa, unknown, or other
  misc_feature (38)..(38): Xaa is any aa, unknown, or other
MAGEAKKLFFASEVTLHASQKDCWVVIGXKVYDVTKXXGRHPGGEVCFLMHQPLGDARKAFKEGGPGPSPVRLMESYLNWKHSGINVLPRAPKATILGKPEVSPISGEMEGKKIPPKPKTSREFFFP

SEQ ID NO: 55485 - DNA, 694 bp, Zea mays
  misc_feature: Ceres CLONE 1488309
  misc_feature: Encodes the peptide sequence at SEQ ID NO. 55486
  misc_feature (384)..(384): n is a, c, t, g, unknown, or other
  misc_feature (424)..(424): n is a, c, t, g, unknown, or other
cgattgggtacgggccccccctcgagccactgcagtggtaaaggagacgcttccccttctcctcgccgatggagtcgcttgcctcgcaagcgaggccggcggcggtgctctggctcgccggcttcttccaggccgcgcgcctccaccgcgttgtctccttctgcgccagctcgagggcactatccatcaggattgcacagtgcttcctgctgaacgggcttatcttccttgggagcttgcttacacttacatcggtggtcattccaactctactgtggatactacctgagcgatgcaatcaaacagcaggacatctttgtgaacacagggcagccgtatctatctattcattcttgcgctccggcccttgtgagatttttatgnatttgggtttatccactttatgtcttcagcttcatataangtacgatttggtatatgacattccaaacatgcattggatgtttggaaaaaaaaaacctaattttgactcaatcactgaaggctccaaaaaaactgaaaaaaaaaacccctgaaagaattttaaggggttccctttggtttggggaaaaaaacaattaaattctttttttaacaattttttttttggagggtccgggggaggggcaaaaccctttattgggggagggaaaagaacccccccccccccgtttaaagggcccccccacccggt

SEQ ID NO: 55486 - protein, 155 aa, Zea mays
  misc_feature: Ceres CLONE 1488309
  misc_feature (106)..(106): Xaa is any aa, unknown, or other
  misc_feature (119)..(119): Xaa is any aa, unknown, or other
MESLASQARPAAVLWLAGFFQAARLHRVVSFCASSRALSIRIAQCFLLNGLIFLGSLLTLTSVVIPTLLWILPERCNQTAGHLCEHRAAVSIYSFLRSGPCEIFMXLGLSTLCLQLHIXYDLVYDIPNMHWMFGKKKPNFDSITEGSKKTEKKNP

SEQ ID NO: 55487 - DNA, 645 bp, Zea mays
  misc_feature: Ceres CLONE 1488317
  misc_feature (182)..(182): n is a, c, t, g, unknown, or other
  misc_feature (224)..(224): n is a, c, t, g, unknown, or other
cgattgggtaccgggccccccctcgagccacgcagtggtaaaggattcgtttgcttttcgtcttcgtcctctctttgcccagttgtcggtcgcccgcgccgtcgtctccgctccgccggccttcctgcgaaaccctagcgaggcgagcgagagagaaactagcggccatggttcggctacanggaagggctgaaccccgggaccctcggaggcccgggcggggntcccttcgcttgcctgtaccccggaatgacgaaagcccccaactggcgtggcggttgtcccaaaattacttattccaaccgtccaattgccataaagggcccggtttccccccttttttttttaaaagggggcgcccgcgtttcaaatttttgttctccccaaaaggggggggggacaaaaaattttttcccaaaaaaggggggttttttcccgggggggggggccccctgggagaagaaacccccaaaaaaaaaccggggaaaaaagggggggggggcgggcgctccccccccccccccccctattttttttgggcggggggggaaaggtttttttttttccccaaaagaaaaaaattttggggggggggggccctctccttctacccagggggggggggggggggacaacaaatcacca

SEQ ID NO: 55488 - DNA, 854 bp, Zea mays
  misc_feature: Ceres CLONE 1488320
  misc_feature: Translation starting site: 154
  misc_feature (1)..(1): n is a, c, t, g, unknown, or other
  misc_feature (27)..(27): n is a, c, t, g, unknown, or other
  misc_feature (29)..(29): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (469)..(469): n is a, c, t, g, unknown, or other
  misc_feature (504)..(504): n is a, c, t, g, unknown, or other
  misc_feature (505)..(505): n is a, c, t, g, unknown, or other
  misc_feature (568)..(568): n is a, c, t, g, unknown, or other
  misc_feature (583)..(583): n is a, c, t, g, unknown, or other
  misc_feature (584)..(584): n is a, c, t, g, unknown, or other
  misc_feature (599)..(599): n is a, c, t, g, unknown, or other
  misc_feature (670)..(670): n is a, c, t, g, unknown, or other
  misc_feature (695)..(695): n is a, c, t, g, unknown, or other
  misc_feature (752)..(752): n is a, c, t, g, unknown, or other
nttttttccccccgccctcacactccntnccccnnnnnccctcnnnnnnntcctattgggtaccgggccccccctcgagccctgcagtggtaaaggaagaagcacgacgacgaccaggagaagaagaagcagacggaggagctggcgaccggcatggagaaggtcacggtgtccgagcccgagaagcacgggcacaaggaggaggagcacgaggtcgtcggcgagaagaaggagggccttttcgccaagctgcaccgcaccagttccagctccagctccgtcgagcgacgaggaagaggaggcgatcgatgagaacggcgagattataaagaggaagaagaacaaggcgggcctcaaggaggaaaatcaagggataagctgcccgggcccaaagggacggccaccacacggcccgcactgttccccccccccccccccggggggggggggggggggggacttattgtcntttccctcaggtaggtttttgttttttttagggtnnaaaaaagaatatatcggtgttacccggtggtcttcgcctccggctcctcctgtatgaccagcncattgtctacctttnncaacataactaccgntttctttttttgtaccccctagaagtcgtccgggggatccgcgcgtggacaaggcgcataaatgagtctcnttttcctctcttgcttcactttatncctaggggaggaacacaaaggctgcgcgccggcggtatttgttattgtgtgcgttanaacatccccccccggggaggcacttacgccctggtaattccagtcacctgtcgcccccgccgctttactgactctttatgtcttgccgcccttacacctccc

SEQ ID NO: 55489 - DNA, 707 bp, Zea mays
  misc_feature: Ceres CLONE 1488322
  misc_feature: Encodes the peptide sequence at SEQ ID NO. 55490
  misc_feature (329)..(329): n is a, c, t, g, unknown, or other
  misc_feature (330)..(330): n is a, c, t, g, unknown, or other
  misc_feature (429)..(429): n is a, c, t, g, unknown, or other
  misc_feature (435)..(435): n is a, c, t, g, unknown, or other
  misc_feature (456)..(456): n is a, c, t, g, unknown, or other
  misc_feature (461)..(461): n is a, c, t, g, unknown, or other
  misc_feature (462)..(462): n is a, c, t, g, unknown, or other
  misc_feature (464)..(464): n is a, c, t, g, unknown, or other
cgattgggtaccgggccccccctcgagcactgcagtggtaaaggggtcgccgttagcgcgcggcacttggatgagaagggcagcggtggaggaggatgcggaaggcgtacagggactccatcaaggtgctcgaagctgacatccagcacgccaacaccctggcctccgagtttccccgggactatgatggtgcgtgcctgcagatgcggctgtcgtacagtcccgcagctcatatattcctcttcctggtgcagtggacggactgcagcctcgcaggggctcttggtctgctgagaatcctcatatacaaggtttatgtggatggcacnnacaccatgtcgactcatgagaggaaagccagcatcaaagaattctatgctgtgatatttcctttcttgctgcaactgcaaagggggatcactgatgtcnaggacnagaagcaaaaggccttatgcntgggnnangtcccaaaagaagatgaagatgggacgggaccctttacctaatattgatgtttaaaaggaaaaagaatgggggattttcctggaaaataaaccccaaatttggtttgcccaaatggccccggggtttttggttccaagtgttcccggatgggatttcaaaaatggggcccggccctttttggggggaaaacttaaaaaaaaaccgtcctgggggcccgggggtatttttttgagaaccccaaa

SEQ ID NO: 55490 - protein, 136 aa, Zea mays
  misc_feature: Ceres CLONE 1488322
  misc_feature (79)..(79): Xaa is any aa, unknown, or other
  misc_feature (112)..(112): Xaa is any aa, unknown, or other
  misc_feature (114)..(114): Xaa is any aa, unknown, or other
  misc_feature (121)..(121): Xaa is any aa, unknown, or other
  misc_feature (123)..(123): Xaa is any aa, unknown, or other
MRKAYRDSIKVLEADIQHANTLASEFPRDYDGACLQMRLSYSPAAHIFLFLVQWTDCSLAGALGLLRILIYKVYVDGTXTMSTHERKASIKEFYAVIFPFLLQLQRGITDVXDXKQKALCXGXVPKEDEDGTGPFT

SEQ ID NO: 55491 - DNA, 645 bp, Zea mays
  misc_feature: Ceres CLONE 1488328
  misc_feature: Encodes the peptide sequence at SEQ ID NO. 55492
tcgagccctgctttggtaaagggacgcaggcaccccagcagctcttgcggtcgtccctcagccgcgtcgcaccgcatcgcattctacgattcgaagctctctgctcgcaggggaccatggcgaagaactacccaaccgtgagcgccgagtacagcgaggccgtcgagaaggccaggcgcaagctccgcgccctcatcgccgagaagagctgcgcacccctcatgctccgcctcgcgtggcactccgcggggacgttcgacgtgtcgtcgaggaccggccgtcccttcggtactatgaagtgcccggcggaactggctcacggcgccaacgcggggctggacatcgcggtgcggctgctcgagcccatcaaggaggagttccccaccctctcctatgccgacttctaccagcttgccggagttgtggccgtcgaggtcaccggtgggcctgagatccccttccacccaggcagggaggacaagcctcagccgccacctgagggccgtcttcttgatgccaccaagggttctgaccaccctgagcaagtcctttggcaagccgatggtttttgagtgatcaggaacatctttgcccctcttctgatggcccccaccttggggaaagggggcccccaagagcgggtcg

SEQ ID NO: 55492 - protein, 151 aa, Zea mays
  misc_feature: Ceres CLONE 1488328
  misc_feature (19)..(150): Pfam Name: peroxidase Pfam Description: Peroxidase
  misc_feature: SWISSPROT Homolog: EC 1.11.1.11 L-ascorbate peroxidase
MAKNYPTVSAEYSEAVEKARRKLRALIAEKSCAPLMLRLAWHSAGTFDVSSRTGRPFGTMKCPAELAHGANAGLDIAVRLLEPIKEEFPTLSYADFYQLAGVVAVEVTGGPEIPFHPGREDKPQPPPEGRLLDATKGSDHPEQVLWQADGF

SEQ ID NO: 55493 - DNA, 659 bp, Zea mays
  misc_feature: Ceres CLONE 1488331
  misc_feature: Encodes the peptide sequence at SEQ ID NO. 55494
cgattgggtaccgggccccccctcgagccactgcagtggtaaaggacggctcagtcaccaacccactcatcactcctcactcactcactcaaaacgaaagccagctcagctcagctctgctcagctcatctgctcacacctcacacccacaggccggccgccacagcaccgcggatagcagagcggcagctaggtcggtcgtcgtcgtcgtcgtcagccatgagcaaggacaagcaccacaagcacgagcaccacctgcggcgttgctgcgggtgcatggcgtcgtgcctcctggcgctggtcctcatcgtggccttcgtctcgctggtggtgtacctggcgctgcgcccctcgaagccgtccttctacctgcaggacctgcagctgcgcaggcccatctcgctgggcgacccgtcgctgacggcgtcggcgcaggtgacgctggcctcccgcaaccccaacgaccgcgtgggcatcttctacaagcgcctggacgtgttcgtcacctaccgcgacgaggccgtgacggtgcccgtgtctctgccgccgcagtaccagggccaccgcgacttcaccgtctggtcccccgtgctgtcggccgagtccgtgcccgtggccgcctacgtcgccgacgccatgaagcaggacgtcgccgcggg

SEQ ID NO: 55494 - protein, 146 aa, Zea mays
  misc_feature: Ceres CLONE 1488331
  misc_feature (39)..(146): Pfam Name: Hin1 Pfam Description: Harpin-induced protein 1 (Hin1)
MSKDKHHKHEHHLRRCCGCMASCLLALVLIVAFVSLVVYLALRPSKPSFYLQDLQLRRPISLGDPSLTASAQVTLASRNPNDRVGIFYKRLDVFVTYRDEAVTVPVSLPPQYQGHRDFTVWSPVLSAESVPVAAYVADAMKQDVAA

SEQ ID NO: 55495 - DNA, 611 bp, Zea mays
  misc_feature: Ceres CLONE 1488336
  misc_feature: Encodes the peptide sequence at SEQ ID NO. 55496
cgaattgggtaaccgggccccccctcgagccactgcagtggtaaagggagccacaagcagcgccgcgaggcacagctagcacaccaccttgcaccgcacccgcaccgagacgaacagatcgaccatggctgggcgggcgcgacgaacacaccattcgcgcagggtcaccagcggcatcggaaggagcaacaagacgctggtcaggaccgagggccttttacaagtacttggttgaaaactttggggtttcccccccaaaccggaaaaattgcctaaacttcggcttggacccaccaaaaccaaaagggggggtttttggagaccctcccccggaaaaagggtcccctttgtggggagttgtaaaaaaaagagaggggggcccccccccccccggggggagggggggggttttagggtttatttttttttgttggcccccggttttgtttgcctcccccccccaaaagggtttttttctttttttttggggggggggggggaataataaaatagggggggggtctttttttggggggcccggggggggggggaaaatatttttttttttttggggcccccccccccccaaaaaaaaaaaaaaggacccctcc

SEQ ID NO: 55496 - protein, 36 aa, Zea mays
  misc_feature: Ceres CLONE 1488336
MAGRARRTHHSRRVTSGIGRSNKTLVRTEGLLQVLG

SEQ ID NO: 55497 - DNA, 753 bp, Zea mays
  misc_feature: Ceres CLONE 1488340
  misc_feature (1)..(1): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (36)..(36): n is a, c, t, g, unknown, or other
  misc_feature (37)..(37): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (139)..(139): n is a, c, t, g, unknown, or other
  misc_feature (222)..(222): n is a, c, t, g, unknown, or other
  misc_feature (254)..(254): n is a, c, t, g, unknown, or other
  misc_feature (268)..(268): n is a, c, t, g, unknown, or other
nccccctannnnnnnntttttctnnnttctctcttnngannnnnnnnnnnnnnnnnnnnnnnncccgattgggggtaccgggcccccccttcgagccactagcagtgggtaaaggggcgcacgtacggtcgaggtgccncgcggaaggcgagcgctggcaccacgtagtcacgcggcgccgggggcccggagcggtgggctgctccgcggtggtgcagcgcngtgggcggcgcccgcgagaggcggtgtggtcnggtggtgcggcggnttcgaccagccgcaggcgtacaagcggttcgtgcgcagctgcgcgctgctggcgggcgacggcggcgtgggcacgctccgcgaggtgcgcgtggtgtcgggcctgcccgcggcgtccagccgcgagcgcctggaggtgctggacgacgagagccacgtgctcagcttccgcgtggtcggcggcgagcaccggctccagaactacctctccgtgaccaccgtccacccgtccccggccgcgcccgacgccgccaccgtcgtcgtggagtcgtacgtggtggacgtgccgccgggcaacacccccgaagacacccgcgtgttcgtcgacaccatcgtcaagtgcaacctccagtcgctggccaccaccgcccgagaacctcgcactcgcagccgtgtaggcgtgactgcgtgaggaggggactcccatctccatgggtgatctattccaatagttttcgggggaagagggatcagggatgcttgaac

SEQ ID NO: 55498 - DNA, 674 bp, Zea mays
  misc_feature: Ceres CLONE 1488342
  misc_feature: Encodes the peptide sequence at SEQ ID NO. 55499
  misc_feature (465)..(465): n is a, c, t, g, unknown, or other
  misc_feature (472)..(472): n is a, c, t, g, unknown, or other
  misc_feature (502)..(502): n is a, c, t, g, unknown, or other
cgattgggtaccgggccccccctcgagccactgcagtggtaaaggagcggagcaagcagcctaaaaaaaccgtatcgtctcgcctgttcagtttccttctcctcttcccgcagcccggtttgccgaccaggttccaccgttccagagtagccaagcgaatcccgtgtctggttcgcgcgatggcggaggagcagtccaacccccagcaccagcaagcggaggagagggaggttatggtggagcagcagcagccgaggagggccccgaagctgaggtacctggacttcgtccaggtggcggctgcccaggccgcggtgtgcctcgctgggctctacggcctcgccaaggaccacgccggcccgctccgccccagcgttgacgccgtcgagtctgccgttaagggcgtcgttagccccgtctacgaccgcttcggcgggcctgcgctcgacgtcctcgccttcgtcngacgcanggtggaccgacacggtgcacgaggtggacnaagcacctcccgggcgcgcctgaaggcggcgtcggcccatgtcctacgcggtggttccgggccttgcccgaagtggccccccaaacttgccgcccaaagcccaccggtccggggcgtgaaggggcccaacccggtggggccctccccatgacggaacccgggggcccgggaa

SEQ ID NO: 55499 - protein, 157 aa, Zea mays
  misc_feature: Ceres CLONE 1488342
  misc_feature (19)..(127): Pfam Name: REF Pfam Description: Rubber elongation factor protein (REF)
  misc_feature (96)..(96): Xaa is any aa, unknown, or other
  misc_feature (98)..(98): Xaa is any aa, unknown, or other
  misc_feature (108)..(108): Xaa is any aa, unknown, or other
MAEEQSNPQHQQAEEREVMVEQQQPRRAPKLRYLDFVQVAAAQAAVCLAGLYGLAKDHAGPLRPSVDAVESAVKGVVSPVYDRFGGPALDVLAFVXRXVDRHGARGGXSTSRARLKAASAHVLRGGSGPCPKWPPKLAAQSPPVRGVKGPNPVGPSP

SEQ ID NO: 55500 - DNA, 665 bp, Zea mays
  misc_feature: Ceres CLONE 1488347
  misc_feature: Encodes the peptide sequence at SEQ ID NO. 55501
  misc_feature (448)..(448): n is a, c, t, g, unknown, or other
  misc_feature (452)..(452): n is a, c, t, g, unknown, or other
  misc_feature (478)..(478): n is a, c, t, g, unknown, or other
  misc_feature (574)..(574): n is a, c, t, g, unknown, or other
  misc_feature (665)..(665): n is a, c, t, g, unknown, or other
acgattgggtaccgggccccccctcgagccactgcagtggtaaaggagcgctagcatagcagcagctcgaactagctttagctactacgtgtgcaagtgcaagcagctcactcgttcgaccatggctgcgagagcggcgctcctccagctggctgtcagcctggttatccttgccgccgtggcgagcgcgagcgcgaccgactgcccaccgccaccgctgccgccggccccaaagccgccgacgcccggcggccaccacggccacgggtcgtgccccaggaacgcgctgaagctgggcgtgtgcgccaacgtgctgggcctggtgaaggccaaggtaggctcgccgccgtacgagccgtgctgctcgctgctggacgggctcgtcgacctggaggccgccgtctgcctctgcaccgccgtcaaggccaacatcctcggcatcaccttnaccntccccatcgacctcagcctcatcctncacaactgcggcaagaactgcccccacgacttccactgcgcgtagatcatcagtcagtcagttattgatcgtcgtccatcggcgggcgggcgtggntcatcgtcatcattcggttttgcttaattgttgatcgatcggcttccttctggtcagcccagcagcttatttattttaaaattgccctctn

SEQ ID NO: 55501 - protein, 133 aa, Zea mays
  misc_feature: Ceres CLONE 1488347
  misc_feature (51)..(132): Pfam Name: Tryp_alpha_amyl Pfam Description: Protease inhibitor/seed storage/LTP family
  misc_feature (109)..(109): Xaa is any aa, unknown, or other
  misc_feature (111)..(111): Xaa is any aa, unknown, or other
MAARAALLQLAVSLVILAAVASASATDCPPPPLPPAPKPPTPGGHHGHGSCPRNALKLGVCANVLGLVKAKVGSPPYEPCCSLLDGLVDLEAAVCLCTAVKANILGITXTXPIDLSLILHNCGKNCPHDFHCA

SEQ ID NO: 55502 - DNA, 666 bp, Zea mays
  misc_feature: Ceres CLONE 1488352
  misc_feature: Encodes the peptide sequence at SEQ ID NO. 55503
cgattgggtaccgggcccccctcgagccctgcagtggtaaaggcgtggccccggagaagaaggccgcgcccgagttcgtcgaggccgcggcggagtccggcgaggccgcccacggctgcagctgcggtggcaattgcaagtgcgacccctgcaactgctgatcacatcgatcgacgaccatggatatgattattatctatctagcttgtggtggtggttgaacaataataagcgaggccgagttggctgccatacataggtattgtgtggtgtgtgttgaaaaaaaagaaaaacaaagtcttcagtttggctatcctctctctgcatgtttggcgccagtctttgtgctcatgtacgtacttgtgtctacctgcatgttggttgatccaattgcttctgctgtaaccatatattaattggcccacgatgaattgattggatcctatatatatcctaaaaaaaaaaaaaaaaacccaaacttttggaattcctggcgcccggggggatcccctaatttttaaaacgggccccccccgcggggggaaactcccactttttgttcccctttaaggagaggttaaatttccaactttgggcgaaaacctggggcataaccctttttccccgggtgaaaaatttgtttaccccttcacaatttcccaaaaa

SEQ ID NO: 55503 - protein, 52 aa, Zea mays
  misc_feature: Ceres CLONE 1488352
  misc_feature (10)..(52): Pfam Name: Metallothio_2 Pfam Description: Metallothionein
IGYRAPLEPCSGKGVAPEKKAAPEFVEAAAESGEAAHGCSCGGNCKCDPCNC

SEQ ID NO: 55504 - DNA, 660 bp, Zea mays
  misc_feature: Ceres CLONE 1488353
  misc_feature: Encodes the peptide sequence at SEQ ID NO. 55505
  misc_feature (1)..(1): n is a, c, t, g, unknown, or other
  misc_feature (538)..(538): n is a, c, t, g, unknown, or other
  misc_feature (587)..(587): n is a, c, t, g, unknown, or other
  misc_feature (605)..(605): n is a, c, t, g, unknown, or other
  misc_feature (615)..(615): n is a, c, t, g, unknown, or other
ncgattgggtaccgggccccccctcgagccactgcagtggtaaaggatagtcttatagccacataccggccagccgcagcaagtgcccagaaggccagaaccagaaccaagcagctcgttgcaacctcatatcatcccctgccacgcacctccgtccgccgcgccatggaatcgaggaggagggccgtgcccaccgtgacggcggttgcggtggcgacgctgctgctgacgatgatgacgtcgtcgggcgtgggcggcgacttcgcggcggaccgggcggagtgctcggagcagttggcggggctggcgacgtgcctgacgtacgtgcaggagcaggcgacggcgacggcgccgacgcccgactgctgcgcgggcctcaaggcggtgctgcagagcagccgcaagtgcctgtgcgtgctggtcaaggaccgggacgaccccaatctaggcctcaagctcaacgtcgacaaggcgctcggcctcccccgcgtctggcacgcgcccgcaacatctccgactgccccaggctgctggaccntgcgggccggctccaagacgcacaggtgttcgagcagtacgcgaaacancaggctgcggcggcggcncaggcccgcncacccaccagtggacgcagcagcgcggcggcgaacacgaccgcgg

SEQ ID NO: 55505 - protein, 165 aa, Zea mays
  misc_feature: Ceres CLONE 1488353
  misc_feature (125)..(125): Xaa is any aa, unknown, or other
  misc_feature (141)..(141): Xaa is any aa, unknown, or other
  misc_feature (147)..(147): Xaa is any aa, unknown, or other
MESRRRAVPTVTAVAVATLLLTMMTSSGVGGDFAADRAECSEQLAGLATCLTYVQEQATATAPTPDCCAGLKAVLQSSRKCLCVLVKDRDDPNLGLKLNVDKALGLPRVWHAPATSPTAPGCWTXRAGSKTHRCSSSTRNXRLRRRXRPAHPPVDAAARRRTRPR

SEQ ID NO: 55506 - DNA, 642 bp, Zea mays
  misc_feature: Ceres CLONE 1488354
  misc_feature: Encodes the peptide sequence at SEQ ID NO. 55507
  misc_feature (318)..(318): n is a, c, t, g, unknown, or other
  misc_feature (343)..(343): n is a, c, t, g, unknown, or other
  misc_feature (353)..(353): n is a, c, t, g, unknown, or other
ccgattgggtaccgggccccccctcgagccactgcagtggtaaagggtacctcaccaacgatggcattgagcacctccgcagcttcctcaacctgccatcagaggttgtgcctaataccctcaagaagtcttccaagcccccgtctcgccccttcggctctggcccacctggtgaccgccccaggggccctcctcgttatgaaggtgacaggcctaggtttggtgatagggatggttacagaggaggtccacgtggcgctcccagtgactttggtggtgataagggtggtgctcctgcagatttccaacatcttttangggtagcagacctggctttggccgncgtggcggcngtgctttcggtgctggtggatcttccatggagtgatgtgtcaacatgagctagcataacattcgtctttgaactatgagaaacatgagattttgttttgttttaccgagctgttgccgtggtttgactggttttgtgatcgtttttgtttagatgaaattatgaaatcaagcagcgagttgaaaaaaaaaaaaaaaaaccagagctctgggatttctgcagcccgggggatccactagttctaaagcgcccgcaccgcggtgaacctcagcttttgttcccttaaggag

SEQ ID NO: 55507 - protein, 132 aa, Zea mays
  misc_feature: Ceres CLONE 1488354
  misc_feature (8)..(47): Pfam Name: S10_plectin Pfam Description: Plectin/S10 domain
  misc_feature (106)..(106): Xaa is any aa, unknown, or other
  misc_feature (114)..(114): Xaa is any aa, unknown, or other
DWVPGPPSSHCSGKGYLTNDGIEHLRSFLNLPSEVVPNTLKKSSKPPSRPFGSGPPGDRPRGPPRYEGDRPRFGDRDGYRGGPRGAPSDFGGDKGGAPADFQHLLXVADLALAXVAAVLSVLVDLPWSDVST

SEQ ID NO: 55508 - DNA, 683 bp, Zea mays
  misc_feature: Ceres CLONE 1488358
  misc_feature: Encodes the peptide sequence at SEQ ID NO. 55509
cgattgggtccgggcccccctcgagccctgcagtggtaaaggacgctacgagaagaggaggttcatttccgcgtcgtctccgccagcagccccacccaccacatggcagccatgccgggtggggcccacgccgccggcgccgcggaccagatgcaggtggaccagccgctccccgctgcggccgcacacggccccgcggacgccaagcatgctggttctatgattgaagggaatgatccagtcacgggtcatataatctcaacaaccattggagggaagaatggagagcctaaaaagactatcagctacatggcagagagagttgtgggaactggatcattcggaatcgtcttccaggcaaaatgtctggagactggtgagactgttgctatcaagaaggttttgcaggacaagcgctacaagaacagggagctgcaaatcatgcgatccatggatcactgcaatgctgtttccttgaagcattgtttcttctccaccacaagcagagatgaactttttcttaacttagtgatggagtttgttcctgagtcactacatcgtgtgctgaagcactacagcaatatgaaccagaggatgccgcttatttatgttaaattatatacctaccagatatttcgaggtttagcctatattcacacagtacctggtgtttgccacaggga

SEQ ID NO: 55509 - protein, 190 aa, Zea mays
  misc_feature: Ceres CLONE 1488358
  misc_feature: SWISSPROT Homolog: EC 2.7.11.1 Non-specific serine/threonine protein kinase
MPGGAHAAGAADQMQVDQPLPAAAAHGPADAKHAGSMIEGNDPVTGHIISTTIGGKNGEPKKTISYMAERVVGTGSFGIVFQAKCLETGETVAIKKVLQDKRYKNRELQIMRSMDHCNAVSLKHCFFSTTSRDELFLNLVMEFVPESLHRVLKHYSNMNQRMPLIYVKLYTYQIFRGLAYIHTVPGVCHR

SEQ ID NO: 55510 - DNA, 670 bp, Zea mays
  misc_feature: Ceres CLONE 1488360
  misc_feature: Encodes the peptide sequence at SEQ ID NO. 55511
  misc_feature (544)..(544): n is a, c, t, g, unknown, or other
  misc_feature (551)..(551): n is a, c, t, g, unknown, or other
cgattgggtccgggcccccctcgagccactgcagtggtaaagggaaaaaatgtcagaggccgccgtgcgtgtgatcggcctatggccgagcccgttcgtgatccgcgtcctgatcgccctgaagctgaagggcgtcgagttcgagttcgtggaggaggtggtgggcaggaagagcgagctgctgctgaggtcgaacccggtgcacaagaagatccccgtcctgctccaccacggcaagcccatctccgagtctctgatcgtcgtccagtacatcgacgaggtctggtcctccggcgcgccggccttcctccccgtcgacgctcacgcccgcgccgtccagcggttctgggcgcagtacgtcgacgacaagctgccttgggcgatccgcatactgaagggaacggacgacgggggcatggagcaggcggcggggcagctgtccgcggccctgcagctcctagaggaggctttcgcgcagctcagccaggggaagcgctacttcggcggggacagcgtcgggtacctggacatcgctctgggggcncatgtcngctgggtgaagggcgtgggaaaaaatccgcgggggtccccctgctggacaaggccaaggtccccaaacctgggggcgttgggctgatcgtctgtgtgcccccccgggccgtggtcgacg

SEQ ID NO: 55511 - protein, 195 aa, Zea mays
  misc_feature: Ceres CLONE 1488360
  misc_feature (4)..(77): Pfam Name: GST_N Pfam Description: Glutathione S-transferase, N-terminal domain
  misc_feature: SWISSPROT Homolog: EC 2.5.1.18 Glutathione transferase
  misc_feature (168)..(168): Xaa is any aa, unknown, or other
MSEAAVRVIGLWPSPFVIRVLIALKLKGVEFEFVEEVVGRKSELLLRSNPVHKKIPVLLHHGKPISESLIVVQYIDEVWSSGAPAFLPVDAHARAVQRFWAQYVDDKLPWAIRILKGTDDGGMEQAAGQLSAALQLLEEAFAQLSQGKRYFGGDSVGYLDIALGAHVXWVKGVGKNPRGSPCWTRPRSPNLGALG

SEQ ID NO: 55512 - DNA, 728 bp, Zea mays
  misc_feature: Ceres CLONE 1488365
  misc_feature: Encodes the peptide sequence at SEQ ID NO. 55513
  misc_feature (233)..(233): n is a, c, t, g, unknown, or other
  misc_feature (305)..(305): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (419)..(419): n is a, c, t, g, unknown, or other
tcgattgggtaccgggccccccctcgagccactgcagtggtaaaggaggtacaaggaagaacgaagagagatcagcgacttaacaacaataatggccaccgccatagttcccacggacgccgagctgctgcaggcgcaggccgacctgtggcgccacagcctctactacctgacatccatggcgctcaagtgcgcggtggagctccacatcccgaccgccatccacaacctangcgggtctgccacgctgccggacctcgtggccgcgctgtccctgccagcggccaagctcccgttcctcgggnggcgtgaatgcggctggctggtcannntcggggggtttttcccgttcttccaaaaaacgtgaaaataatcgggtgcccccccccccttttcgtggggggggggggttaaaaagnttttttaaaatccaaaaaaaacccccccctttacccaaaaaaacctttttggggtggggggaaccccctctccccccccccccctaaaaggggaaaggcccgcgcctttgttccccccttgggccaaaaactggtttttcccacaaaaagggggaggggagaaaaaaaagagaaaccctccaaatttgcggcccctccccccctatttaaaagaccccccttccacagggggggggcccccccctctcccccacaagaagaagacacccacatttcttgtttgtaaaaaaaaaaaaaatattttagaag

SEQ ID NO: 55513 - protein, 91 aa, Zea mays
  misc_feature: Ceres CLONE 1488365
  misc_feature (30)..(79): Pfam Name: Dimerisation Pfam Description: Dimerisation domain
  misc_feature: SWISSPROT Homolog: EC 2.1.1.150 Isoflavone 7-O-methyltransferase
  misc_feature (48)..(48): Xaa is any aa, unknown, or other
  misc_feature (72)..(72): Xaa is any aa, unknown, or other
  misc_feature (80)..(80): Xaa is any aa, unknown, or other
  misc_feature (81)..(81): Xaa is any aa, unknown, or other
MATAIVPTDAELLQAQADLWRHSLYYLTSMALKCAVELHIPTAIHNLXGSATLPDLVAALSLPAAKLPFLGXRECGWLVXXGGFFPFFQKT

SEQ ID NO: 55514 - DNA, 659 bp, Zea mays
  misc_feature: Ceres CLONE 1488367
  misc_feature: Encodes the peptide sequence at SEQ ID NO. 55515
  misc_feature (465)..(465): n is a, c, t, g, unknown, or other
  misc_feature (543)..(543): n is a, c, t, g, unknown, or other
  misc_feature (554)..(554): n is a, c, t, g, unknown, or other
  misc_feature (591)..(591): n is a, c, t, g, unknown, or other
cgattgggtaccgggccccccctcgagccactgcagtggtaaagggacatcccatatcgccaagtccccttcgtcgtccccttccctcgcctcgcgttaggtagcctgcttccgacccgcacatctccctccggttctcgccatgggcgccggcgccaacaaccacgaggagtcgagccccctcatcccagctgcggttgccgcccccgcggacgagaagcccccgcaggctccggcgccggaggccgccaattactatgccgacggggtcccggtcgtgatgggcgagcccgtgtcggcccacgccttcggcggcgtcccgcgggagagctggaactccgggatcctctcctgcctcggccgcaacgacgagttctgcagcagcgacgtcgaagtgtgtcttcttggaacggtagcaccatgtgtgctctatggtagcaatgttgagaggcttgctgctggacnaggcacatttgcaaacagctgtttgccttacactgggctgtatttgcttgggaactctctcttttggtggaactgccntgccccatggntctctcatcccactcgtactgctattcgacacgctancatctttgaggtagcttttgagctttccacaggcaatgtgggtgctgcggcaatctggtccaagacaa

SEQ ID NO: 55515 - protein, 172 aa, Zea mays
  misc_feature: Ceres CLONE 1488367
  misc_feature (64)..(168): Pfam Name: PLAC8 Pfam Description: PLAC8 family
  misc_feature (108)..(108): Xaa is any aa, unknown, or other
  misc_feature (134)..(134): Xaa is any aa, unknown, or other
  misc_feature (138)..(138): Xaa is any aa, unknown, or other
  misc_feature (150)..(150): Xaa is any aa, unknown, or other
MGAGANNHEESSPLIPAAVAAPADEKPPQAPAPEAANYYADGVPVVMGEPVSAHAFGGVPRESWNSGILSCLGRNDEFCSSDVEVCLLGTVAPCVLYGSNVERLAAGXGTFANSCLPYTGLYLLGNSLFWWNCXAPWXSHPTRTAIRHAXIFEVAFELSTGNVGAAAIWSKT

SEQ ID NO: 55516 - DNA, 665 bp, Zea mays
  misc_feature: Ceres CLONE 1488369
  misc_feature: Encodes the peptide sequence at SEQ ID NO. 55517
  misc_feature (665)..(665): n is a, c, t, g, unknown, or other
cgattgggtccgggccccccctcgagccctgcagtggtaaagggaagtcgcccgtccagataaccggcggcggtggcggcgacgtggtccacctggtgagatgggtgcagtcggttgtgcgggaggagtggaccgccgaggtgttcgacggcgagcttctgcggtaccccaacatcgaggaggagatggtagagatgctgcagatcgccatggcgtgcgtgtccaggacccccgagcggcgtcccaggatggcggacgtggtgaggaccatcgaggaggtgcgtcggagcggcagcgggaccgcgaccgggaccgggacgcggccgtccaccgaggcctccaccccggccaccgccgctgaagcggcccaaagcagggcggaagagggcggctcgtcggcggtggcgcagtgaccggacgcgacgcaggccgagctgcttgctcgtagctggaatgatcctgtgctttattttggcgggggctgtcccattcgttctttcctgttaccaaattcgaacagaatgtgtcccattccttccttccgggttacaaaatcctaacagaattgtccggtggacttgggacacgggggtcaaatttttttggagcaactggctcgctgctaacttttgattgaccctttgcaccagtggggacaggaagan

SEQ ID NO: 55517 - protein, 136 aa, Zea mays
  misc_feature: Ceres CLONE 1488369
  misc_feature: SWISSPROT Homolog: EC 2.7.11.1 Non-specific serine/threonine protein kinase
IGSGPPLEPCSGKGKSPVQITGGGGGDVVHLVRWVQSVVREEWTAEVFDGELLRYPNIEEEMVEMLQIAMACVSRTPERRPRMADVVRTIEEVRRSGSGTATGTGTRPSTEASTPATAAEAAQSRAEEGGSSAVAQ

SEQ ID NO: 55518 - DNA, 753 bp, Zea mays
  misc_feature: Ceres CLONE 1488370
  misc_feature: Encodes the peptide sequence at SEQ ID NO. 55519
  misc_feature (18)..(18): n is a, c, t, g, unknown, or other
  misc_feature (19)..(19): n is a, c, t, g, unknown, or other
  misc_feature (34)..(34): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (343)..(343): n is a, c, t, g, unknown, or other
  misc_feature (753)..(753): n is a, c, t, g, unknown, or other
cctccttttccttttttnncaaacttcgtataanaaaaaaattttttttnnnnccgattgggtaccgggccccccctcgagccactgcagtggtaaaggagtccagcccacataaccacaccaactctccccaatccagcagccctcgagtctggtcccccacccctcagcgcgacgaaggtaagatgttcctgcggaggatcctgaccggcgggggcggcctgtcggccctgagggcggcgcgcgccatgaaggagacaacggggatcgtgggccttgacgtggtgcctaacgcgcgagaggttctggtagggctctacgagcgcacgctcaaagagatcanggccgtccccgaagacgagggttaccgcaaggccattgaatccttcaccggtcaccgcctgcagatctgccaggaggaggaggactggaagcgcatcgaggacctgaatcggatgcgggctggtcgagcacctcatcgaggagggcgaagaccagctcgggctcatcgctaaaatgattgaatgggatccatgggggtgttccccaatgactacgaatggggaaggtgatttgaaaaataacccccccaaatttcctaaaccccccggggggaaaaccccccctttactatatttaataagcctttctccaccgggggaaaaccgccgggtaaaaaacaaaaggtttttccttttcttttttcagcaacaaaattaattcccttgtatgtaaaaaaagacccccgctcan

SEQ ID NO: 55519 - protein, 109 aa, Zea mays
  misc_feature: Ceres CLONE 1488370
  misc_feature (35)..(91): Pfam Name: ETC_C1_NDUFA5 Pfam Description: ETC complex I subunit conserved region
  misc_feature (53)..(53): Xaa is any aa, unknown, or other
MFLRRILTGGGGLSALRAARAMKETTGIVGLDVVPNAREVLVGLYERTLKEIXAVPEDEGYRKAIESFTGHRLQICQEEEDWKRIEDLNRMRAGRAPHRGGRRPARAHR

SEQ ID NO: 55520 - DNA, 688 bp, Zea mays
  misc_feature: Ceres CLONE 1488371
  misc_feature: Encodes the peptide sequence at SEQ ID NO. 55521
  misc_feature (688)..(688): n is a, c, t, g, unknown, or other
ccgaatgggtaccgggccccccctcgagccactgcagtggtaaaggccatggggtccggggactggttcaagacgatcatcagcaagaaaaaatcgaagcggggaaagtcaaagcacgcaaagctctctggccaagtaacaaatggaggcaaccagacaaatcagaagttagacggcccttcttcaagtagtgaggaccacgaagacaatgcagcactagaggaatgggctgctactcgcattcagaatgcgtttcggaaatacaaggcaaggaagaccctgcgttgtctcaagggagtcaaaagattgcgcgttgtgggtcaggcgaatccggtaagaagcagactgctgccacgctgaagtacatacagtcttgcaaacagttgcagtcggaaaatagaaaccgacgtgctttcatggcccacgaaaggacgcacaggaagaaagagccggaaaaccaaatgaaacttgaggcaaaactgcataatttgcagattgaatggaatggaggctcggatactatgggatgaaatctttgctaagataccaccaccgggaagaagccacattaaagcgtggagcgagccatgggggtacccctttcaaccattcagtggaaagcaaggtcctgcccaaagcctaggaaacttcacctttaaaattccggtaaggtgggcctggggctggn

SEQ ID NO: 55521 - protein, 103 aa, Zea mays
  misc_feature: Ceres CLONE 1488371
  misc_feature (59)..(79): Pfam Name: IQ Pfam Description: IQ calmodulin-binding motif
MGSGDWFKTIISKKKSKRGKSKHAKLSGQVTNGGNQTNQKLDGPSSSSEDHEDNAALEEWAATRIQNAFRKYKARKTLRCLKGVKRLRVVGQANPVRSRLLPR

SEQ ID NO: 55522 - DNA, 847 bp, Zea mays
  misc_feature: Ceres CLONE 1488372
  misc_feature (1)..(1): n is a, c, t, g, unknown, or other
  misc_feature (19)..(19): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (41)..(41): n is a, c, t, g, unknown, or other
  misc_feature (42)..(42): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
ncccccctctctttttttnccccattatgaatnnnnttccnntnnnnnccgattgggtacgggccccccctcgagccctgcagtggtaaaggagaacaagcaaccagcggagcggaggaggagagactgatccagacgcaaagggcatcgacagagaccgagcccaataataaatcttgctggatacatacaggaaacagcgcgagggaacgagaagttagtttccatggagaagaagcagaagaagcacgcacacgcgaggtcaaggagcttcaccggcggccggctggcctccttcctcaggcccaccgtctcctccttctcctccgccttcccgcccagcggaaggaggtcctccttcaaccaccgcaacggccttcttcgggccccatcgtcgtcttccatcttccccgcctgaaggcttcgcggcgccaggccggcaaggaagaaaccgctccggtgtaacattatttccccaaacccgtccatcccaccaagggtggccctgcattccggcctaaatccaagccgcaataaacttcccaggccgccaaaaaaaaaagggcctaacccgtccgtgccggacaagggggcgggcgggcgtccatggccccgcttccccgcccgaaggcccccccaagcggggaggggcaattaaaagattaaaacccctggcatatcggggccccaaccacccaacacgggggggcctcccctccgctagaagccggaaaaggcccccttcctttcccccccaaacaaccagggtcccccgacccctctccttctcaaagggagcggttgctccccgccccaacaacaataggactctccaccccttcccgac

SEQ ID NO: 55523 - DNA, 665 bp, Zea mays
  misc_feature: Ceres CLONE 1488375
  misc_feature: Pfam Name: Raffinose_syn Pfam Description: Raffinose synthase or seed imbibition protein Sip1
  misc_feature: SWISSPROT Homolog: EC 2.4.1.67 Galactinol--raffinose galactosyltransferase
  misc_feature (665)..(665): n is a, c, t, g, unknown, or other
tcgagccctgctgtggtaaaggggctgggcctggtgcacccgcgccgggtgcgggacttctacggcgagctccacgcgtacctcgcctcctgcggcgtcgacggcgtcaaggtggacgtgcagaacatcatcgagacgctgggcgccggccacggcggccgcgtcgccatcacccgcgcctaccaccgcgcgctcgaggcctccgtggcgcgcagcttcccagacaacggctgcatctcctgcatgtgccacaactccgacatgctgtacagcgccaggcagaccgccgtcgtgcgcgcctccgacgacttctacccgccgcgacccggcatcgcacaccgttcacgtccgctcggtcgagaacaacaccgtcttcctcggcgaagtcatgcagccccaatgggacatgttccataacttgcttccggggccggataaccccggcccggcaagggccctcggtggcttgcccaaattacgtccccgaaaaaggccgggaaaccacaacttttcaatctgtcctaggaacgcttggggctcccccaaagggtttccggggtataacgggggaaatttttccccgggggcggggccacaaaaacggggaaaaggggcgtctcttttttcctccaaaaacacgtggggggggccctccataacagttn

SEQ ID NO: 55524 - DNA, 657 bp, Zea mays
  misc_feature: Ceres CLONE 1488380
  misc_feature: Encodes the peptide sequence at SEQ ID NO. 55525
  misc_feature (492)..(492): n is a, c, t, g, unknown, or other
  misc_feature (493)..(493): n is a, c, t, g, unknown, or other
  misc_feature (502)..(502): n is a, c, t, g, unknown, or other
  misc_feature (508)..(508): n is a, c, t, g, unknown, or other
  misc_feature (526)..(526): n is a, c, t, g, unknown, or other
  misc_feature (592)..(592): n is a, c, t, g, unknown, or other
  misc_feature (593)..(593): n is a, c, t, g, unknown, or other
cgattgggaccgggccccccctcgagccctgcagtggtaaagggggaggcgcgacggcaccgtgtccatcaagcaggaggcgctggaccagatccccgcgcccaccatgaacttcacccaactcctccagtccttccagaacaagagcctcaacctcgccgacctcgtctggctctcaggggctcacacgatcggcatctcccaatgcaactccttcagcgagcgcctgtacaacttcacggggcgcggcgggcccgacgacgcggacccgtcgctggacccgctgtacgccgcgaagttgcggctcaagtgcaagacgctgacggacaacacgacgatcgtggagatggaccccggcagcttccgcaccttcgacctgagctactaccgcggcgtgctcaagcggcggggcctgttccagtccgacgccgcgctcatcaccgacgccgcctccaaggccgacatcctcagcgtgatcaacgcgccgcccgnnagtgtcttncaggtnctcgcgggctccatggtncagatgggcgccatcgaggtcaagaccggctccgagggcgagatcagggagcactgcgccctcgtnncacagcactaggcggcggaattcatgcgggagatggctccattgctcgcaaaaaatccttgtga

SEQ ID NO: 55525 - protein, 165 aa, Zea mays
  misc_feature: Ceres CLONE 1488380
  misc_feature (1)..(126): Pfam Name: peroxidase Pfam Description: Peroxidase
  misc_feature: SWISSPROT Homolog: EC 1.11.1.7 Peroxidase
  misc_feature (129)..(129): Xaa is any aa, unknown, or other
  misc_feature (132)..(132): Xaa is any aa, unknown, or other
  misc_feature (163)..(163): Xaa is any aa, unknown, or other
MNFTQLLQSFQNKSLNLADLVWLSGAHTIGISQCNSFSERLYNFTGRGGPDDADPSLDPLYAAKLRLKCKTLTDNTTIVEMDPGSFRTFDLSYYRGVLKRRGLFQSDAALITDAASKADILSVINAPPXSVXQVLAGSMVQMGAIEVKTGSEGEIREHCALVXQH

SEQ ID NO: 55526 - DNA, 663 bp, Zea mays
  misc_feature: Ceres CLONE 1488385
  misc_feature: Encodes the peptide sequence at SEQ ID NO. 55527
  misc_feature (424)..(424): n is a, c, t, g, unknown, or other
  misc_feature (663)..(663): n is a, c, t, g, unknown, or other
cgattgggtaccgggccccccctcgagccactgcagtggtaaaggtcaagctccccagtctccccctccctgctcggtccgtatagcggcttgacggcgaatcggatcttcctcggcctcctctccctgcgcccctctggtcgccatggagctcgcctagaggttttctcaaactcctcgccgccggttttctcaaattgtcaatttgagaaaaccgctagacccggatccgccgcttccttgaactcctcgccgtcggctctcctcagctctgccgactcgcttcgctctcctcgccccaggccccagcctcctcctgatcccagattcgcctcgccggccccaggcgctcgccacgagcgccgtcaagcgaagccgttcttccctggcgcacgcggctggcgtagctgccaggatccttccngccgagcacgtcgcgggcagctggtccggcgctcgtcttccacgtcgtcggggggaactcgtccccctcccgaagcaaaatccgcacgggctcggtgcattctccctttgcggaaggaaactcgctccaatgatactccgaggggtagtcccccctgggccttccgtttcaccctgccagcaattaatttcaaagtcctccagggaacgcgattttttcccctggcggggggaacaccn

SEQ ID NO: 55527 - protein, 36 aa, Zea mays
  misc_feature: Ceres CLONE 1488385
MILRGVVPPGPSVSPCQQLISKSSRERDFFPWRGEH

SEQ ID NO: 55528 - DNA, 669 bp, Zea mays
  misc_feature: Ceres CLONE 1488389
  misc_feature: Encodes the peptide sequence at SEQ ID NO. 55529
  misc_feature (439)..(439): n is a, c, t, g, unknown, or other
  misc_feature (539)..(539): n is a, c, t, g, unknown, or other
  misc_feature (592)..(592): n is a, c, t, g, unknown, or other
  misc_feature (614)..(614): n is a, c, t, g, unknown, or other
cgattgggtccgggccccccctcgagccctgcagtggtaaaggcgacgtggttgacgcccactacaaggcctgcctctacgccggcatcaacatcagcggcatcaacggcgaagtcatgcctggacagtgggagttccaagtggggccgtcagttgggatctctgccggcgacgagatatgggtcgcccgctacattctcgagaggatcaccgagatggccggaatcgtcctctccctcgacccgaagccgatcaagggcgactggaacggcgccggcgcccacaccaactacagcaccaagtcgatgagggaggccgggggatacgaagtcatcaaggcggcgatcgacaagctggggaagagcacaaggagcacatcgccgcgtacggcgagggcaacgagcgccgcctcacgggcccgcacgagaccgccgacatncacaccttcaaatgggggcgtggcgaaccgcggcgcgtccatccgcgtcggccgcgacaccgagagggagggcaggggctactttcgagaccgcaggccngcgtccaacatggacccctacgtcgtcaccggcatgatcgccgagaccaccantcttgtggaatggaaactgatncagcatgtgcattctcgagggagcctactgtttctcttctgcacaacgcatccgc

SEQ ID NO: 55529 - protein, 222 aa, Zea mays
  misc_feature: Ceres CLONE 1488389
  misc_feature (2)..(200): Pfam Name: Gln-synt_C Pfam Description: Glutamine synthetase, catalytic domain
  misc_feature: SWISSPROT Homolog: EC 6.3.1.2 Glutamate--ammonia ligase
  misc_feature (146)..(146): Xaa is any aa, unknown, or other
  misc_feature (197)..(197): Xaa is any aa, unknown, or other
  misc_feature (204)..(204): Xaa is any aa, unknown, or other
IGSGPPLEPCSGKGDVVDAHYKACLYAGINISGINGEVMPGQWEFQVGPSVGISAGDEIWVARYILERITEMAGIVLSLDPKPIKGDWNGAGAHTNYSTKSMREAGGYEVIKAAIDKLGKSTRSTSPRTARATSAASRARTRPPTXTPSNGGVANRGASIRVGRDTEREGRGYFRDRRPASNMDPYVVTGMIAETTXLVEWKLXQHVHSRGSLLFLFCTTHP

SEQ ID NO: 55530 - DNA, 705 bp, Zea mays
  misc_feature: Ceres CLONE 1488391
  misc_feature: Encodes the peptide sequence at SEQ ID NO. 55531
cgattgggtaccgggccccccctcgagccctgcagtggtaaaggtttttgctccccctccctcacccgcctccactcccccctcccaggcgctgcccaggtaagtcggcggcggcgatgacaacgcgcttcaagaagaccgcaagaagcgcgggcacgtgtccgccgggcacggccgcatcggcaagcacaggaagcaccccgggagtcgcgggtacgccggtggcatgcaccaccaccgtatcctcttcgacaagtaccatccgggctacttcggcaaggttggcatgctttacttccataagctccgcaacaagtcctactgccccgcggtcaaaatcgagcgcctctggtcgatggggccccccaacaaggggggggaggcgggcctcaacaaggccccacatatcaacgtcacgcagtttcgcttactttaaggtgctcgggaaagggggtgctccccccccaagcccatttggcgtaaaggccaagccccttctccaggggcccccaaaaaaaaaaatcaagggccgcgggggggggcccccccctgccccaccccccaaaggtttcagccccttggtccccccccctgggtttttgaaaatcttatatccgaaactggaggggggtttttcccggcccccaaccaattttggggggtaaacaaccaacccgcttattttataaaaaagatggggggggc

SEQ ID NO: 55531 - protein, 69 aa, Zea mays
  misc_feature: Ceres CLONE 1488391
MHHHRILFDKYHPGYFGKVGMLYFHKLRNKSYCPAVKIERLWSMGPPNKGGEAGLNKAPHINVTQFRLL

SEQ ID NO: 55532 - DNA, 1144 bp, Zea mays
  misc_feature: Ceres CLONE 1489756
  misc_feature: Encodes the peptide sequence at SEQ ID NO. 55533
gcggcagagctcgagcactcgacaccagcgtctaacgggatggcgagcctgaccatgccgccggtgccggcgtggccgcggcaggacgccatcgacctccacaaagcattcagagggttcggttgcgacagcacgacggtgaccaacatcctggcgcaccgcgacgcgacgcagcgctcgctgatccagcaggagtaccgggccgtgttcaaccaggacctggcccggcgcatcgcgtccgagctgagcggccaccacaagcgggcgatgctgctgtggatcctggacccggccacccgcgacgccaccatcctgaagcaggcgctcacgggcgacatcaccaacctgcgggcggccacggagatcgtctgctcccggacgccgtcgcagctgcagatcatgcgccagacgtaccgcgccaggttcggctgctacgtcgagcacgacgtcaccgaacgcacgtccggcgaccaccagcgcctcctgctcgcgtacctggccatcccgcgcgccgagggccacgaggtcgacccgtcgacggtgacgctggacgcgcgcgacctctacaaggccggcgagcggcggctgggcaccgacgagcgcgccttcatccgaatcttcagccagcggagctgggcgcacatggcggccgttgcccgggcgtaccaccacatgtacgaccgccccctggagcgcgccgtcaagagcgagacgtcgggcaacttcggtttcggtctcctcaccgtgctccgctgcgccgacagccccgccaggtacttcgccaaggagctgcacagggccatgaaggggctgggcaccagcgactcggtgctcatccgggtggtggtcaccagggcggagatcgacatgcagtacatcaaggcggagtaccacagcatgtacaagcgctcgctcgccgacgccatccacgccgagacgtccggcaactaccgcaccttcctcctctccctcgtcggccgcgaccgcacctagtgatgacgatgatcgctgtttcgtctctcatctatgcctctagtagcaacaacgtacgaggcgacactgggcgccattgccactcgcgtgtgcttgctattcctgttatctccatggaaatcttcctccttgtaaataaaaaaaaaaaaaa

SEQ ID NO: 55533 - protein, 317 aa, Zea mays
  misc_feature: Ceres CLONE 1489756
  misc_feature (246)..(311): Pfam Name: Annexin Pfam Description: Annexin
  misc_feature (170)..(236): Pfam Name: Annexin Pfam Description: Annexin
  misc_feature (15)..(80): Pfam Name: Annexin Pfam Description: Annexin
  misc_feature (87)..(152): Pfam Name: Annexin Pfam Description: Annexin
MASLTMPPVPAWPRQDAIDLHKAFRGFGCDSTTVTNILAHRDATQRSLIQQEYRAVFNQDLARRIASELSGHHKRAMLLWILDPATRDATILKQALTGDITNLRAATEIVCSRTPSQLQIMRQTYRARFGCYVEHDVTERTSGDHQRLLLAYLAIPRAEGHEVDPSTVTLDARDLYKAGERRLGTDERAFIRIFSQRSWAHMAAVARAYHHMYDRPLERAVKSETSGNFGFGLLTVLRCADSPARYFAKELHRAMKGLGTSDSVLIRVVVTRAEIDMQYIKAEYHSMYKRSLADAIHAETSGNYRTFLLSLVGRDRT

SEQ ID NO: 55534 - DNA, 570 bp, Zea mays
  misc_feature: Ceres CLONE 1489759
  misc_feature: Encodes the peptide sequence at SEQ ID NO. 55535
cgattgggtccgggccccccctcgagccctgcagtggtaaaggaagaagcctgcagaggagcccgcgacagagaaggcggagaaggctccggcggggaagaagcccaaggccgagaagcgcctcccggcgggcaagtccgccggtaaggagggcggcgagggcaagaaggggaaaaagaaagcgaagaagtccgtggagacctacaagatctacatcttcaaggtgctgaagcaggtgcaccccgacatcggcatctcgtccaaggccatgtccatcatgaactccttcatcaacgacatcttcgagaagctcgcggccgagtccgccaagctggcgcgctataacaagaagcccaccgtcacctccccgcgagatccagacctcggtgcgcctcgtcctccccggcgagcttgccaagcacgccgtctccgagggcacccagggcggtcaccaaagttcaccttcttccttaggtttcatagaactaaggctgggtgggtggttgggaaaacttgggcctcaaatttttctggggaagggggtagtggatgggaatagaaattgattcc

SEQ ID NO: 55535 - protein, 96 aa, Zea mays
  misc_feature: Ceres CLONE 1489759
MSIMNSFINDIFEKLAAESAKLARYNKKPTVTSPRDPDLGAPRPPRRACQARRLRGHPGRSPKFTFFLRFHRTKAGWVVGKTWASNFSGEGGSGWE

SEQ ID NO: 55536 - DNA, 648 bp, Zea mays
  misc_feature: Ceres CLONE 1489762
  misc_feature: Encodes the peptide sequence at SEQ ID NO. 55537
  misc_feature (630)..(630): n is a, c, t, g, unknown, or other
  misc_feature (648)..(648): n is a, c, t, g, unknown, or other
cgattgggtacgggccccccctcgagcctgcagtggtaaaggtgttcgtggaggccgacgccgcctgcgacgtcgtcgccgtcggagacctcaccaagccggactccgccgcgctcagacagatcatatactccgatccccggctccaaacacatcctcgagatgccccccatgaccgcgcacgtgacgaggttcaagtgtgggggcttcacgctcagcctgaccatgaaccactgcatgttcgacggcatcggcgccatggagatcgtcaactcgtgggcggagacggctcgcggcgtcgccgagctcaccgtgccggcgttcctggaccgaaccgtcctgaaggcgcgcgacacgcccgtgaccaccttcctccaccacgagttcgccgagatccccgacgtctccgacacggaggcgctctaccgcacgcaggagctgatgtaccactccttctgcttcgacccggatcggatggagcgcgtgcgcaggcttgcgctcgccgacggcgccctgcgccgctgctgcaccttcgaggagctgtcggatctggtgtggcgcgcgcgaacacagtactggggctgtccccgacagcacacaagctgctgttcacgtgcactgtgagcaccngtagagcgcctcatcacn

SEQ ID NO: 55537 - protein, 153 aa, Zea mays
  misc_feature: Ceres CLONE 1489762
  misc_feature: SWISSPROT Homolog: EC 2.3.1.162 Taxadien-5-alpha-ol O-acetyltransferase
MPPMTAHVTRFKCGGFTLSLTMNHCMFDGIGAMEIVNSWAETARGVAELTVPAFLDRTVLKARDTPVTTFLHHEFAEIPDVSDTEALYRTQELMYHSFCFDPDRMERVRRLALADGALRRCCTFEELSDLVWRARTQYWGCPRQHTSCCSRAL

SEQ ID NO: 55538 - DNA, 683 bp, Zea mays
  misc_feature: Ceres CLONE 1489768
  misc_feature (683)..(683): n is a, c, t, g, unknown, or other
cgattgggtccgggccccccctcgagccactgcagtggtaaagggtgctttcttctacgtgggttggcttctccctccccctccggttgggttccggtctcctgaggatctccggagctcgtggttgcgaggatgagcggatcaagatggatctcctccgagttgagtacgcgtgcattcgacggcggactcccctggcccacggactaccactccctccactacgcctttaccacctacggccaggtcctcccagtcctaggtccggtcccgtcccacatccatccatggcttcgtctgaatctgacctgcttctgacaacaccctcgccccgatctgtccctccttcccctctcccgctgcagatcatcctccatcgcgagacgctcatgtccctcggattccgtttctgcaccttctcgctgaagaggcgatgcctaacgacatcgagtgcatgagcttgaaagagctggacggccgcaacttcactgtcaactaggctcccttctcacctcactcgtagattcgacagcgttttgtactgtggtggacgtcgaatcttcagatactgatgtgtccttcctccccatggcatgtggccgctaccgcggagtgcgcgactactgtggtcgctcgccttaccgaggtagaggcttttgctactccagtgacttaccatgctn

SEQ ID NO: 55539 - DNA, 642 bp, Zea mays
  misc_feature: Ceres CLONE 1489772
  misc_feature: Encodes the peptide sequence at SEQ ID NO. 55540
  misc_feature (1)..(1): n is a, c, t, g, unknown, or other
ncgattgggtaccgggccccccctcgagccactgcagtggtaaaggtgaacctggtacctggatagcagtgcggcgaagcatcggaagaatatgaggagagtacacggtgggaagaggcatggcatcagcgcttcgaacccgtacgggaggaaggacaaaggcggtgccggcgataaacgactgttggcgagattctagaaaggaatgacgagcatgagcgtttcactattgttgtgttcgtaccagggctttgattgatgttacctggcattgagaaaaatcttgacaggccactaagattggctataaattttgggttgtcttgatatatttggtgtgtaacgcaatctgtctgctcgatgcgaaatttggattatacaacacaaagacaacctgagctctgggaatcctgcagcccgggggatctcatgttctagagcggcgccccgatgctgaactcaggctcatgttcgcttagtgagggtaatttcgagcgtggcgtagcatgccatagctgtatctgtctgaaattgtttcgggtcgaattcccgccacaacaaaccgcacccttagtttaaacccggggggcccaaggaatgactaactccctttatttgttcgggctacaggcccctttgcat

SEQ ID NO: 55540 - protein, 35 aa, Zea mays
  misc_feature: Ceres CLONE 1489772
MRRVHGGKRHGISASNPYGRKDKGGAGDKRLLARF

SEQ ID NO: 55541 - DNA, 641 bp, Zea mays
  misc_feature: Ceres CLONE 1489784
  misc_feature: Encodes the peptide sequence at SEQ ID NO. 55542
cgattgggtaccgggccccccctcgagccactgcagtggtaaagggttctcttctcacctccttcgtttcgcggagcagaacgagcagacggcaccggacctccagggagcgcaccgcggaggccagcgaagatgcccgggctcacggcaccgtccgactacgcggaggagccgccgcgtcacccggccctcaagatcaactccaaggagccattcaatgctgagcctcaccgatcagagctagtcgcatcttacatcaccccagtggatttcttctacaagaggaatcatggacccatccctaaagtcgaggacctctcaagatacactgtttccatttctggtctcgtcaacaagtccattcagctatcgatggctgacatttggtctcttccaaagtacaatgtcacagcaactttacagtgtgcaggaaacaggaggactgcgatgagtaacgtacggaaagtgagaggtgttgggtgggacatatctgctcttggaactgcaacttggggaggtgccaaattatctgatgtccttgagctagttggaataccaaaactcagttcagtcacgtctctaggagggaaacacgttgagtttgttagcgttgacaagtgtaaagaggaaaaaggtggtcc

SEQ ID NO: 55542 - protein, 169 aa, Zea mays
  misc_feature: Ceres CLONE 1489784
  misc_feature (49)..(169): Pfam Name: Oxidored_molyb Pfam Description: Oxidoreductase molybdopterin binding domain
  misc_feature: SWISSPROT Homolog: EC 1.8.3.1 Sulfite oxidase
MPGLTAPSDYAEEPPRHPALKINSKEPFNAEPHRSELVASYITPVDFFYKRNHGPIPKVEDLSRYTVSISGLVNKSIQLSMADIWSLPKYNVTATLQCAGNRRTAMSNVRKVRGVGWDISALGTATWGGAKLSDVLELVGIPKLSSVTSLGGKHVEFVSVDKCKEEKGG

SEQ ID NO: 55543 - DNA, 641 bp, Zea mays
  misc_feature: Ceres CLONE 1489786
  misc_feature: Encodes the peptide sequence at SEQ ID NO. 55544
cgattgggaccgggccccccctcgagccactgcagtggtaaagggtcggtcagcgggggctttcctattctccccttatttggtggcctctctcgtgaacgaagcgaagacggcagaaccgcagaagtgcagcagaacgatcggatctagcagaattctctcaacctcatcggcggcggcgaagagcgtgcggatcggagatggagacaagcgggtggaggaggagagcggcggcgcgggcctcctggagccccgccacggtgtacctgtggctcgcgctcgccgcagcagcactgacgctcgcccaggctaagaaggacctaacggaggttacccacaaggtctacttcgatgtcgagattgacggcaagcccgcaggtcggattgtcatggggctttttgggaagactgttcctaagacagcagagaacttccgagctctttgcacaggagagaaaggaattggcaagagtggcaaagctctccactacaagggaagtacattccacagaatcattcccagcttcatgctccaaggaggtgacttcactcttggggatgggaggggggtggtgaatctatctatggcatgaagtttgctgatgagaacttcaagatcaagcacactggaccaggccttc

SEQ ID NO: 55544 - protein, 130 aa, Zea mays
  misc_feature: Ceres CLONE 1489786
  misc_feature (47)..(129): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
METSGWRRRAAARASWSPATVYLWLALAAAALTLAQAKKDLTEVTHKVYFDVEIDGKPAGRIVMGLFGKTVPKTAENFRALCTGEKGIGKSGKALHYKGSTFHRIIPSFMLQGGDFTLGDGRGVVNLSMA

SEQ ID NO: 55545 - DNA, 610 bp, Zea mays
  misc_feature: Ceres CLONE 1489792
  misc_feature: Encodes the peptide sequence at SEQ ID NO. 55546
cgattgggtaccgggccccccctcgagccctgcagtggtaaaggagagggagagggggacccgagcccagtcatcacaagcaagcaaacgcgctcgcctcggtttatatacgaacacgtacgtgcgcataaggctggaatttttagttcgctggagctgcagaaccagcaaaacgtcggtttgatctctcgatggtcatgacgcttacgagagacgaagcggaggggagcaaggatatgcagggcgtccgggcgcacgccgaggagctgttcacgctgtcggcggcggcggcgggcaccgacggcacgccgcggccgccgtcctcgggcgccgcagcccgcagggccatggcggccgagggcgtgttcgagtgcaagacgtgcagcaagcgcttcccgtcgttccaggcgctcggcgggcaccgcaccagccacacgcggctgcaggcgcggacgatgctcagcgaccaggcggcggccgcggccgagagggacagggcgcgggcgcacgagtgcgccgtctgcggcctcgagttcgccatgggccaggcgctcggcggacacatgcgccgccacaggggcgaagcgctgccaccagccgcgcagccggc

SEQ ID NO: 55546 - protein, 139 aa, Zea mays
  misc_feature: Ceres CLONE 1489792
  misc_feature: The sequence is a functional homolog of SEQ ID NO 1292 in the 10/666,642 US patent application
  misc_feature: The sequence is a functional homolog of SEQ ID NO 626 in the 10/374,780 US patent application
MVMTLTRDEAEGSKDMQGVRAHAEELFTLSAAAAGTDGTPRPPSSGAAARRAMAAEGVFECKTCSKRFPSFQALGGHRTSHTRLQARTMLSDQAAAAAERDRARAHECAVCGLEFAMGQALGGHMRRHRGEALPPAAQP

SEQ ID NO: 55547 - DNA, 603 bp, Zea mays
  misc_feature: Ceres CLONE 1489799
  misc_feature: Encodes the peptide sequence at SEQ ID NO. 55548
  misc_feature (349)..(349): n is a, c, t, g, unknown, or other
  misc_feature (429)..(429): n is a, c, t, g, unknown, or other
tcgagcactgcagtggtaaaggtggttcaactcctaccactaccacagcaccagcgacggaccgggcaggcagagaaaaagcagaccagacgagacctctcgcgttccgtcctcctccctgcccctgctgccgttccccttcttcctcagttctcctgcccgctgctgccctccgtccgcgtccagatcccgccaccaaccgatccggcgccctccagcatggcgggggcgggagcggggacgaaggcggcgggagccctggctctggcgctcgtgctcgcgctcgcgggggccaactccgagggcgacgcgctctcggcgctgcgccggagcctcagggaccccggcngcgttctgcagagctgggacccccacgctcgtcaacccctgcaacctgtttccacgttacctggggacccgcaacaaccnggggtcaccccgccctagaatctttggaaattttgaaacttatctggtcatctgggtgccctgaactttggggaaaatgggagccatctttcagaaatctgggaaacttttataagaaaaacctttcaaaggaaaaatcccctttttaaacttgggcaacctttaaagaaacct

SEQ ID NO: 55548 - protein, 75 aa, Zea mays
  misc_feature: Ceres CLONE 1489799
  misc_feature: SWISSPROT Homolog: EC 2.7.11.1 Non-specific serine/threonine protein kinase
  misc_feature (44)..(44): Xaa is any aa, unknown, or other
MAGAGAGTKAAGALALALVLALAGANSEGDALSALRRSLRDPGXVLQSWDPHARQPLQPVSTLPGDPQQPGVTPP

SEQ ID NO: 55549 - DNA, 632 bp, Zea mays
  misc_feature: Ceres CLONE 1489809
  misc_feature: Encodes the peptide sequence at SEQ ID NO. 55550
  misc_feature (425)..(425): n is a, c, t, g, unknown, or other
caaagctggagctccccgcggtggcggccgctctagaactagtggatcccccgggctgcaggaattcgcacgagaccattacctagaacatcctaatcgaaaaagcgcgcgaaaacgcaggagcaacccgcccactcgccaccaccgcccgcgcgcacggcggcgaccgatggccccgctcgtgccgatgtcgcagccatgggtggagaaataccggccgaggcaggtcaaggatgtggctcaccaggaggaggtgattcgggtgctcaacaacaccctccagaccgccgacctgccgcacatgctgttctacggcccgccggggacgggaaagaccaccaccgcactagccatcgcctaccagctctacggtccagagctgtataagtcaaggggttttggagctcatgctagtgatgatcgtngaaattatgtgggtgagacgaaaatcaagaactttgctgctgttgctgttggtactgccacggaaagctggttatccctgcccaccttacaagatattattcttgacgaagccaaattcatgacgaaaaatgccccgaatgcttgaagcctaccacggaaaccttactccaagggacaagattcctttttttttgcaaccttttccc

SEQ ID NO: 55550 - protein, 133 aa, Zea mays
  misc_feature: Ceres CLONE 1489809
  misc_feature: SWISSPROT Homolog: EC 2.7.7.7 DNA-directed DNA polymerase
  misc_feature (86)..(86): Xaa is any aa, unknown, or other
MAPLVPMSQPWVEKYRPRQVKDVAHQEEVIRVLNNTLQTADLPHMLFYGPPGTGKTTTALAIAYQLYGPELYKSRGFGAHASDDRXNYVGETKIKNFAAVAVGTATESWLSLPTLQDIILDEAKFMTKNAPNA

SEQ ID NO: 55551 - DNA, 622 bp, Zea mays
  misc_feature: Ceres CLONE 1489810
  misc_feature: Encodes the peptide sequence at SEQ ID NO. 55552
atagctggagctccccgcggtggcggccgctctagaactagtggatcccccgggctgcaggaattcgcacgagaccattacctagaacatcctaatcgaaaaatcccaaagagcacgcagcgcagcactgaagcaccacttcctgcactcactgctagctgctcacaccgtgctagtaacagtccatcaccagtcaccaccaatggctcccaaggttgcgctcttccttgccctcggccttctcttcgctgccgccgcgaatggctgcgaaccctactgtcccggcccagtcgtcccaacgccgccagtcgtgccgacgccgtcgtcgcacagccacggccgctgcccgatcgacgcgctcaaactcaaggtgtgcgccaacgtgctaggcctcgtcaaggtcggcctgccccagcacgagcaatgctgcccactgctggaggggctggtggacctcgatgtcgcactgtgcctctgcaccgccatcaaggccaacgtcctcggcatccacctcaatatgccccttagcctcaacctcatcctcaacaactgcggcaagatttgcccggaggacttcacttgccccaactaattgagctgaatatggagataaaaccagcat

SEQ ID NO: 55552 - protein, 129 aa, Zea mays; identical to SEQ ID NO: 44760
  misc_feature: Ceres CLONE 1489810
  misc_feature (48)..(127): Pfam Name: Tryp_alpha_amyl Pfam Description: Protease inhibitor/seed storage/LTP family

SEQ ID NO: 55553 - DNA, 666 bp, Zea mays
  misc_feature: Ceres CLONE 1489827
  misc_feature: Encodes the peptide sequence at SEQ ID NO. 55554
catagctggagctccccgcggtggcggccgctctagaactagtggatcccccgggctgcaggaattcgcacgagaccattacctagaacatcctaatcgaaaaaattgaccctcccctcgccggcgtccggcgatcgccggcatccgagcgatggatcacccatccacgtgatggatccgacagctccttccccggccccccctgcgggcgatggggcacagccatcggaccagaaccggcagcgaccaaggtctgcactccgtggcgccctcggggtggccttccccatcgcggtatcgttcctcttctccttcctcgttgggctcgctgggctcgcgcttggtggcctctcgtccaccgcatcggtctccatgccctccacctgccgcatcctctccagtggcgttgaccttaggtcatcaaaagtttgcgagcttgggttattgaactatagagctaagcatgtctcctacccatcgagtaaaagaagattccgctgccatgatgactactactgggcctccagttttccgggttgaatacaccaaatttttttctggccaattatccttagcagtgcgccaaagcccccaaaaaaggcccttccctccaaattgggcggcctgaattttggggcccccagggccaaaaacctttaaagtcca

SEQ ID NO: 55554 - protein, 122 aa, Zea mays
  misc_feature: Ceres CLONE 1489827
MDPTAPSPAPPAGDGAQPSDQNRQRPRSALRGALGVAFPIAVSFLFSFLVGLAGLALGGLSSTASVSMPSTCRILSSGVDLRSSKVCELGLLNYRAKHVSYPSSKRRFRCHDDYYWASSFPG

SEQ ID NO: 55555 - DNA, 595 bp, Zea mays
  misc_feature: Ceres CLONE 1489836
  misc_feature: Encodes the peptide sequence at SEQ ID NO. 55556
  misc_feature (416)..(416): n is a, c, t, g, unknown, or other
atagctggagctcaccgcggtggcggccgctctagaactagtggatcccccgggctgcaggaattcgcacgagaccattacctggaacatcctaatcgaaaaaccaaactgctagcagcgccagcggcggtcagcgtcagcgtcagcgcccgaccaaatttcccccctcacctccccctctcccgtcgtcggcatggccaccgacgtgctgcgcgcgcgcaacgtcctcttgccggcgccgccgcagaggatccgggcggcggcggcggcgcgccgaaggggagctggtagcgacagccaccacccctgcgccaccggcaccaggaggaggtcgccgccggccgggacatcgtcccccgcggcggggcgaatacaccccggcggcggaagggctaggcctgctgtggaggtatacnccggcccatctttcgcgacgtcccccgacccgagctggctgccgctaccgcagttccctgccaggaacgccgtagccgaagccatgacgaccgccgtcgacggccgacgacgaccgcgacgcgcgacctcaggcttatccctgcggctggagtagccatcaggacacataagctcgtct

SEQ ID NO: 55556 - protein, 125 aa, Zea mays
  misc_feature: Ceres CLONE 1489836
  misc_feature (75)..(75): Xaa is any aa, unknown, or other
MATDVLRARNVLLPAPPQRIRAAAAARRRGAGSDSHHPCATGTRRRSPPAGTSSPAAGRIHPGGGRARPAVEVYXGPSFATSPDPSWLPLPQFPARNAVAEAMTTAVDGRRRPRRATSGLSLRLE

SEQ ID NO: 55557 - DNA, 640 bp, Zea mays
  misc_feature: Ceres CLONE 1489837
  misc_feature: Translation starting site: 210
gatagctggagctccccgcggtggcggccgctctagaactagtggatcccccgggctgcaggaattcgcacgagaccattacctagaacatcctaatcgaaaagagcgaacgatccagaagcagaagccaccgatcggcgtgccgcgtgcgtgaggcgatcggagcatcccgtcccgaggaggaagacaaccggcgacgcggggggaacatggggaagacgccggtgcggatgaaggcggtcgtgtacgcgctgtcgcccttccagcagaaggtaatgccggggctgtggaaggacatcaccaccatagatccaccacaaggtcaccgagaactggatctccgccacgctcctcctcacccccgtcgtcggcacctaccaatacgccatgtggtacaaggagcaggagaagctgtcccacagatattatatgcgctgcccttgacagacagcactcggagttttcatgatgggtttcataatcctcccatgatgatttaacattttgtttgatcaatttcaagtcaacgcctttttcatccgttcatatgcatttttggggatcgtggtctggcaaacttattttgaaggctgctaaattagaaccttttggccccggaaaggtgttaaataaaccaaat

SEQ ID NO: 55558 - DNA, 629 bp, Zea mays
  misc_feature: Ceres CLONE 1489843
atagctggagctccccgcggtggcggccgctctagaactagtggatcccccgggctgcaggaattcgcacgagaccattacctagaacatcctaatcgaaaaatacgcggccgctagaccgcctactctccccatccctcgccgcctcgcttcaccccacctatggtcgccgctgctcgcatcgccctgcggcccccacctctctctccctttctcctcgcaacgccgcccccgtttgtccaccaagtcaccacgcgcctgggagatggatcaaggggcgcgcagcagtccggtcaagacacgctcaacgaaagcttcaagatagcacgggagatggaagccccaccatcggctaggaatcgttgcatcacgtcatccgattcctctcccttccgttcctttgctttcgtggtggatgagaagaaagcggcgaagggcgcatcggaaaagagagcctggaggaggaggcacaccatccttcctcttgcacacggagtcctcaagctttctcctcaccttgctggaattccgggtgccatacatcatctctgtcggcaggcatgttgcccttctgcctcgctcgcagttcttccaagggctgcccgtctgtgtggtctggtttggtttgg

SEQ ID NO: 55559 - DNA, 633 bp, Zea mays
  misc_feature: Ceres CLONE 1489844
  misc_feature: Encodes the peptide sequence at SEQ ID NO. 55560
aaagctggagctcaccgcggtggcggccgctctagaactagtggatcccccgggctgcaggaattcgcacgagaccattacctagaacatcctaatcgaaaaatcatccctgcagttgtggatcagttcgtcctccgtctctctccacaagtctcctctaggcgccaagcaatgacaaggtcagcaccgccggcctctcctccggcgccgaagcccgtgctgcgcgggagccagctggagcagctccgcgagatcttccggcgcttcgacatggacggcgacggcagcctgacacagctggagctgggggcgctgctgcggtcgctgggcctgcgccccacgggggaggaggcccgcgcgctgctggcggccatggactccaacggcaacggcgcggtggagttcggcgagctggcggccgccatcgcgccgctgctcaccacgcagacgcacctcgtcgaccaggcccagctcctgggagtgttccgcgccctccaaccgcgacggcaaccgctacatcttcgccggccgagctggcgcgctcccatggcgcgcatcgggcaagccgctcacccttcgaagaactcacgcccaatgatgcccaaccccaaaccccaaacggggaacggcgtc

SEQ ID NO: 55560 - protein, 154 aa, Zea mays
  misc_feature: Ceres CLONE 1489844
  misc_feature (24)..(52): Pfam Name: efhand Pfam Description: EF hand
  misc_feature: SWISSPROT Homolog: EC 2.7.11.1 Non-specific serine/threonine protein kinase
MTRSAPPASPPAPKPVLRGSQLEQLREIFRRFDMDGDGSLTQLELGALLRSLGLRPTGEEARALLAAMDSNGNGAVEFGELAAAIAPLLTTQTHLVDQAQLLGVFRALQPRRQPLHLRRPSWRAPMARIGQAAHPSKNSRPMMPNPKPQTGNGV

SEQ ID NO: 55561 - DNA, 631 bp, Zea mays
  misc_feature: Ceres CLONE 1489845
  misc_feature: Encodes the peptide sequence at SEQ ID NO. 55562
atagctggagctccccgcggtggcggccgctctagaactagtggatcccccgggctgcaggaattcgcacgagaccattacctagaacatcctaatcgaaaaatgtttgcaaaattctcctacccaaaccaccggcgcgcacgccaagcggtgaagcagcatcggccatggaggagaccaagccagcgccagaggccatgctccgctgcgccagggccgcgctcctcctcgcctccctccgccggccacgcgcgccgacgccgacacaggatcgccgccggacctcctactctccctcctcggccgccgcagcggagctcgcgcggctccggtccgaggggctcctccgcagcgccgagatcgcagcggcgcggcgcgaggccgcggcccacgcgcgggtcgccggctccgagctgctcctcgtcctcgccgtggcgcccgccgtcctcctgctcctcctcctcgggcttctctaagccagcggcggcgtgggtagcgcgggggctggagtctggggccgcctctcctctccgtgagttcagttttggagtgcactaggtgttcgatgaaatgcatgtttgagtgtggtggcgagtatataagcatcagatttgtcccccttttgttttgg

SEQ ID NO: 55562 - protein, 102 aa, Zea mays
  misc_feature: Ceres CLONE 1489845
MEETKPAPEAMLRCARAALLLASLRRPRAPTPTQDRRRTSYSPSSAAAAELARLRSEGLLRSAEIAAARREAAAHARVAGSELLLVLAVAPAVLLLLLLGLL

SEQ ID NO: 55563 - DNA, 705 bp, Zea mays
  misc_feature: Ceres CLONE 1489855
  misc_feature: Encodes the peptide sequence at SEQ ID NO. 55564
  misc_feature (390)..(390): n is a, c, t, g, unknown, or other
aaactggagctccccgcggtggcggccgctctagaactagtggatcccccgggctgcaggaattcgcacgagaccattacctagaacatcctaatcgatgtggggtgcgaccgaatccaacagaagagccgaagaggaaaggggcggttgctttatattccttctcggctgcaatctgcgtccatctatccagccgtctcggggcgtcgtgtgcgcgtggatctctccgtagaagggatgaagatcacggcgctccttgtgctgaagccgtcgacctccggagccggtagctcctcgtccggcggccagtcgggcccggaggcggtcgtgctcgcgaacgcgacggacgtcagccacttcggctacttccagcgcagcgcccgccgcgangtcatcgtcttcgttgcccgcaccgtcgctcagcgcacccagcccagcccagcgcagtccgtccagcacgaagaaatataggttcactccccacaccagaaatgggcttttgtgcggtgggcatttatggatgatcactatcctggtacgaagtgcatttttctcttctgaatcaggttcttggatgaataccaaaaaggctttttggggacctcctgggatttctggctcctgccaaatggaactcaaacgggggggcttttctctgaaaaaaaccccttgggaaaaattttcaggagccctcgcggaaaattt

SEQ ID NO: 55564 - protein, 77 aa, Zea mays
  misc_feature: Ceres CLONE 1489855
  misc_feature (51)..(51): Xaa is any aa, unknown, or other
MKITALLVLKPSTSGAGSSSSGGQSGPEAVVLANATDVSHFGYFQRSARRXVIVFVARTVAQRTQPSPAQSVQHEEI

SEQ ID NO: 55565 - DNA, 671 bp, Zea mays
  misc_feature: Ceres CLONE 1489857
  misc_feature: Encodes the peptide sequence at SEQ ID NO. 55566
aaagctggagctccccgcggtggcggccgctctagaactagtggatcccccgggctgcaggaattcgcacgagaccattacctagaacatcctaatcgaaaaaaaaaaacccacacatccgacgccgaggaagtaggaagcacgaccagcatatgtcacagagggccagcgtcccacactcctcctgcatagccttcgcgctccattcccatctcctggtctccagtgagatgtgccccagctcctattggcagcaatagctattctccgccttcctttttttcttcttcttcttcctttcctcccgtctggatttcgtttccgtttgatcgagctggctctcagcttccgtttttagttttgttggcatctttgctctcggatccgtctctccctaactcctgaaacccaaaaggagagaagaaaccgggcaagcaagcgatgggtgtcaagggattcgtcgagggcggcatcgcctccatcgtggccggctgctccacccacccgctggacctcatcaaggtccgcatgcagctgcagggggaggcggcggccgccgtggcgccgcagccggcgctgcgcctggcgctcgccttccacgccgggggccacgccgtcgcgcttccgcaccaccacgacatcccggtgccgccgcggaagccctggccgct

SEQ ID NO: 55566 - protein, 76 aa, Zea mays
  misc_feature: Ceres CLONE 1489857
MGVKGFVEGGIASIVAGCSTHPLDLIKVRMQLQGEAAAAVAPQPALRLALAFHAGGHAVALPHHHDIPVPPRKPWP

SEQ ID NO: 55567 - DNA, 736 bp, Zea mays
  misc_feature: Ceres CLONE 1489861
ggggggaaagggaaatggggttattaaaaccgaaatgcgggcacgggccctttttttttaaaactggagctcaccgcggtggcggccgctctagactagtggatcccccgggctgcaggaattcgcacgagaccattacctagaacatcctaatcgaaaaaaggaaacagtcacgtctcccagatctaactgccccccgactcacgaatcccagagcctccgtggcgacgcaccgccactgcctcccactcctcctcctcgtggccgccgccctcgccgccgtccctgctcgcgcggcgctgggcggcgggcgcggcccgctgctgggcgggtggaaccccatgcctgacgtgagcgactcgcacatccagaagctaggagggtgagcactaagccaaactaagcacccaaagctggactccgacgggctgcggaaccgccgcgtagagtgggagggaatgggaggtcgaagtcaaaaaaaaccccccgaactatacggtttaaggtgcacgggcggcgggcagcgtggaccgtaaccgctaagggggggcgggaaaggtaaaaaggggggatatggggaccagggggaaaaaggggggtggggggcggtggaaacctgggggtccgcgggggccctacggggaaacaataacgcgccgcagggcggaaccaaaaagggaagaattgtccggggaaacaggaaggggagaagagcggggtgccgggggcaacggga

SEQ ID NO: 55568 - DNA, 641 bp, Zea mays
  misc_feature: Ceres CLONE 1489863
  misc_feature: Encodes the peptide sequence at SEQ ID NO. 55569
aaagctggagctccccgcggtggcggccgctctagaactagtggatcccccgggctgcaggaattcgcacgagaccattacctagaacatcctaatcgaaaaaacaagaagtaaaattgcaattggaggtcacaatgggagaatccaccgtcaagctcacaatcaaattcggaggaagatcgatacctctctcggtatcacctgacgctacaaccaaagaactaaagtctcttcttcaacccatcaccaacgttcttcctcgtggccagaaactcatcttcaaaggtaaggtcttggtagagacttcgactctgaagcaatctttggtgggagatggtgcgaagattatgttaatggcttctcaaggtcttcatcaaggggaagctagtacaaggccaatatctagaactgttgtggatcagaacaaacctggtcttgttgtagacaagaaccgtgctgatcggtggaaagctacaggggttattgctttagctcaagccaatttgaaggaaatacctgaagaagtgtgggaatgtggatctgcagctagagtgcttgacgttagtgagaacttcattcgagaagtacctgttcgaatcagctcttttgtctctatgcataaactgtttcttcaagggaat

SEQ ID NO: 55569 - protein, 169 aa, Zea mays
  misc_feature: Ceres CLONE 1489863
  misc_feature (8)..(78): Pfam Name: ubiquitin Pfam Description: Ubiquitin family
  misc_feature: SWISSPROT Homolog: EC 3.1.3.16 Phosphoprotein phosphatase
MGESTVKLTIKFGGRSIPLSVSPDATTKELKSLLQPITNVLPRGQKLIFKGKVLVETSTLKQSLVGDGAKIMLMASQGLHQGEASTRPISRTVVDQNKPGLVVDKNRADRWKATGVIALAQANLKEIPEEVWECGSAARVLDVSENFIREVPVRISSFVSMHKLFLQGN

SEQ ID NO: 55570 - DNA, 673 bp, Zea mays
  misc_feature: Ceres CLONE 1489873
  misc_feature: Encodes the peptide sequence at SEQ ID NO. 55571
aagctggagctccccgcggtggcggccgctctagaactagtggatcccccgggctgcaggaattcgcacgagaccattacctagaacatcctaatcgaaaatgaggctgtcacgtgggaggattacaatgtgctttgtgagcgctatccacatgcccctgcttggggtcaagcaggaattgcaggaggggcagatgtcacgcctgttggtgccaagggggaagatgaagccgaaggctgcagaggtgaacagggaagggaggccgtgtcggagtcgcccattgggccgtaagttgagtgagtaagtgtggttagtatgtaacggcccattactgcatttatataagggttgtaaagacttgtgaaaggatatgaaaaagaaatagaaagaaaattgccaccaacctgtcgttctgtccagttccttggcggcggcagctagctcacgtcccggcgaaccctcgtcggtggccaagggccgttacaggatgaaacaacaacaaaaaaggtgggtcgtcgatgtagccggggcaccaggcacgctctacaccggcgagacctacaaactgcaggtggatttctccgagcattatcccatggaggcacctcaggttatatttctgcatccagcaccgatgcatccacacatttacagtaatggacacatctgttta

SEQ ID NO: 55571 - protein, 67 aa, Zea mays
  misc_feature: Ceres CLONE 1489873
MRLSRGRITMCFVSAIHMPLLGVKQELQEGQMSRLLVPRGKMKPKAAEVNREGRPCRSRPLGRKLSE

SEQ ID NO: 55572 - DNA, 683 bp, Zea mays
  misc_feature: Ceres CLONE 1489881
  misc_feature: Encodes the peptide sequence at SEQ ID NO. 55573
  misc_feature (375)..(375): n is a, c, t, g, unknown, or other
  misc_feature (378)..(378): n is a, c, t, g, unknown, or other
  misc_feature (464)..(464): n is a, c, t, g, unknown, or other
  misc_feature (642)..(642): n is a, c, t, g, unknown, or other
aaagctggagctccccgcggtggcggccgctctagaactagtggatcccccgggctgcaggaattcgcacgagaccattacctagaacatcctaatcgaaaaacctgcgtccgcgcctttccatttccaccccgatcgcgttttccggccccgccgcctgtccctgcgctagtcgacactcgacaggctcggtttccgccctcccctcccaccgccgcgcaccgagaagatggggaagcggtggatcccgctggaggccaacccggacgtcctgaaccagttcatatgggggctgggagtccacgaggaggatgtgcagttctgcgacgtctacggccttgacgatgagctgctcgctatggtgccccagcccgnttnctcgcgtctcttcctctacccgctcacctccctggacgaagagaaagagaaatcagtgtttctgctgccacatcgactcagcgggnaaggatttgaccaagaagtatactttacaaaccaactgttgggtatgctttgggaacatttggggtttttcctgcaatggaaaacccacttcccaaaccagctttttaagggggcccttttttaaaaatttttaaacaaaccggaaaaaggaaccccccccggggtggctttttcttngaaaaaaataaaaggggaaaacccccttctccctccccccc

SEQ ID NO: 55573 - protein, 119 aa, Zea mays
  misc_feature: Ceres CLONE 1489881
  misc_feature (4)..(118): Pfam Name: Peptidase_C12 Pfam Description: Ubiquitin carboxyl-terminal hydrolase, family 1
  misc_feature: SWISSPROT Homolog: EC 3.4.19.12 Ubiquitinyl hydrolase 1
  misc_feature (49)..(49): Xaa is any aa, unknown, or other
  misc_feature (50)..(50): Xaa is any aa, unknown, or other
  misc_feature (79)..(79): Xaa is any aa, unknown, or other
MGKRWIPLEANPDVLNQFIWGLGVHEEDVQFCDVYGLDDELLAMVPQPXXSRLFLYPLTSLDEEKEKSVFLLPHRLSGXGFDQEVYFTNQLLGMLWEHLGFFLQWKTHFPNQLFKGALF

SEQ ID NO: 55574 - DNA, 660 bp, Zea mays
  misc_feature: Ceres CLONE 1489882
  misc_feature: Encodes the peptide sequence at SEQ ID NO. 55575
aagctggagctccccgcggtggcggccgctctagaactagtggatcccccgggctgcaggaattcgcacgagaccattacctagaacatcctaatcgaaaaaaggcgccctcagccagcgaagccgacgcgcccggcccggtcggcgacgccgccgccgccgacaccgcggccgctggaaggaccgtggcaggcggaatcatggcagcgggcgcgctggcgctgggcctcgtcggcctgctcgcctaggcacggcgcgcgcgagcgggtggcgctggcgcctgcacggcacagcatggatgccgcggctacgtgcgtgacgacgacataactcctacgcggaagatgcagccggtgcgccgcgcgcgctcaacgtccatggatgccgcggctgacggttgtactcttgtccgttttttaaccgggccgcccgggcctacgtgtatgtagtagtactagtgcagtcagtgccactcacgttttgggtgccggtgctacgtgcggacgtaccgccgccgcctcggactctttctactattctcttctttaatttcctctttaatttcctgtaccactgccacctcatcgagatgatttatttatatctttattccacccaaaaaaaaaaaaaaaagcttatcgataccgtcgacctcgaggg

SEQ ID NO: 55575 - protein, 81 aa, Zea mays
  misc_feature: Ceres CLONE 1489882
AGAPRGGGRSRTSGSPGLQEFARDHYLEHPNRKKAPSASEADAPGPVGDAAAADTAAAGRTVAGGIMAAGALALGLVGLLA

SEQ ID NO: 55576 - DNA, 696 bp, Zea mays
  misc_feature: Ceres CLONE 1489886
  misc_feature: Encodes the peptide sequence at SEQ ID NO. 55577
  misc_feature (359)..(359): n is a, c, t, g, unknown, or other
  misc_feature (365)..(365): n is a, c, t, g, unknown, or other
  misc_feature (390)..(390): n is a, c, t, g, unknown, or other
aaagctggagctccccgcggtggcggccgctctagaactagtggatcccccgggctgcaggaattcgcacgagaccattacctagaacatcctaatcgaaaaacaagctgtcacaaactcagcacacaatcacactgacacacacaccaccaccacggcaccgctagtgagaagcggagcgggaggacacgcggcgcggactgcgatggctcgtgcgctcggcgcttgcgtgctgctcgccgtcctgctcggtgccctggcgccggcggcggccgcgcgcgcccacgacgaccagggcagcggggccggcatacggcagccgagcggcgagtacccgcgggagaagggtgggggccagnaccgangtgcgggacctggaaggcgacggcnaaggtgcaggacctcggccggttccccgtccgccaagtacaaccgggaacctccaaaaaaggtggggggcggcgggcgaaaggctccaatttccgcagggtggggggcggccccacccccaggggggtccggggcctaaaatacacccccccccccccgggcccctgaaaaaaagaggggccccagaaaaacgggaaaaaaggtgttttaaaaccccctttttttttaaaaaccctggtttatatccgccccccctgtttttttttgtgcgggggggggggcccataaaaaaccggggctcccccc

SEQ ID NO: 55577 - protein, 107 aa, Zea mays
  misc_feature: Ceres CLONE 1489886
  misc_feature (52)..(52): Xaa is any aa, unknown, or other
  misc_feature (54)..(54): Xaa is any aa, unknown, or other
  misc_feature (62)..(62): Xaa is any aa, unknown, or other
MARALGACVLLAVLLGALAPAAAARAHDDQGSGAGIRQPSGEYPREKGGGQXRXAGPGRRRXRCRTSAGSPSAKYNREPPKKVGGGGRKAPISAGWGAAPPPGGSGA

SEQ ID NO: 55578 - DNA, 680 bp, Zea mays
  misc_feature: Ceres CLONE 1489889
  misc_feature: Encodes the peptide sequence at SEQ ID NO. 55579
aagctggagctccccgcggtggcggccgctctagaactagtggatcccccgggctgcaggaattcgcacgagaccattacctagaacatcctaatcgaaaaagccatcgatccagtgcaaacaagctcgctcgcaagcgcaacccacccacgtctacggtctaccacacgaagcatcgtagccagccagccagctaaacccacaccacacatggccgggatcgtggtggtgttcgacttcgacaagacgatcatcgacgtggacagcgacaactgggtggtggacagcctcggcctcaccgacctgttcgagcgcctcctccccaccacgccctggaacacgctcatggacacgatgatgggggagctgcacgcgcggggcaggacgctggccgaggtgaccgaggcgctcagggcggcgcccatcgacccgcgcgtgcccgccgccgccgctcgactgcaagctcgagtcccatgcccgtcgccgcgcaggacggtatgcccatcgtgccgctgggcgtcaagaactgatactgtctctggttcaaaattgaggtccccgggtagagctccaacaaattccgggccaagcaccgcgtaccgttaagaggcgtttcactaaattttggggcgtctggggggggagtccctcccggagcggaggcctggtggctgcggaat

SEQ ID NO: 55579 - protein, 131 aa, Zea mays
  misc_feature: Ceres CLONE 1489889
  misc_feature (4)..(121): Pfam Name: Put_Phosphatase Pfam Description: Putative Phosphatase
MAGIVVVFDFDKTIIDVDSDNWVVDSLGLTDLFERLLPTTPWNTLMDTMMGELHARGRTLAEVTEALRAAPIDPRVPAAAARLQARVPCPSPRRTVCPSCRWASRTDTVSGSKLRSPGRAPTNSGPSTAYR

SEQ ID NO: 55580 - DNA, 644 bp, Zea mays
  misc_feature: Ceres CLONE 1489890
  misc_feature: Encodes the peptide sequence at SEQ ID NO. 55581
aaagctggagctccccgcggtggcggccgctctagaactagtggatcccccgggctgcaggaattcgcacgagaccattacctagaacatcctaatcgaaaaatctcccgcaacgcaagcgcaacagaagcatactacgccgctacgcgctgggcggtgccgcacaggcacagctatagatactactccagcagtgttgcatagaaatggacagcggcagcagcctcgtggacgacaccagcggcggcggcgcgtgcacggacaagctaaggtctttggccgccgccgccgccgccgccgcctccgcctcggggccaccgccggagcgcatgggcagcggggccagcgcggtcgtggacgcggccgagccgggcgccgaggcggactccggctccgccccggcctccgtcgccgccgccgtcgcggcgggcgtgggcgggaagctgccgtcgtccaggtacaagggcgtggtgccgcagcccaacgggcggtggggcgcgcagatctacgagcgccacctgcgcgtgtggctcggcaccttcgcgggcgaggccgacgcggcgcgcgcctacgacgtcgcggcgcagcggttccgcggccacgacgcggccaccaacttccgcccgctcgcggacgccggcccg

SEQ ID NO: 55581 - protein, 146 aa, Zea mays
  misc_feature: Ceres CLONE 1489890
  misc_feature (83)..(132): Pfam Name: AP2 Pfam Description: AP2 domain
  misc_feature: The sequence is a functional homolog of SEQ ID NO 26 in the 10/838,616 US patent application
  misc_feature: The sequence is a functional homolog of SEQ ID NO 760 in the 11/435,388 US patent application
  misc_feature: The sequence is a functional homolog of SEQ ID NO 1183 in the 10/374,780 US patent application
  misc_feature: The sequence is a functional homolog of SEQ ID NO 22 in the 10/838,616 US patent application
  misc_feature: The sequence is a functional homolog of SEQ ID NO 756 in the 11/435,388 US patent application
MDSGSSLVDDTSGGGACTDKLRSLAAAAAAAASASGPPPERMGSGASAVVDAAEPGAEADSGSAPASVAAAVAAGVGGKLPSSRYKGVVPQPNGRWGAQIYERHLRVWLGTFAGEADAARAYDVAAQRFRGHDAATNFRPLADAGP

SEQ ID NO: 55582 - DNA, 643 bp, Zea mays
  misc_feature: Ceres CLONE 1489896
  misc_feature: Encodes the peptide sequence at SEQ ID NO. 55583
aaagctggagctccccgcggtggcggccgctctagaactagtggatcccccgggctgcaggaattcgcacgagaccattacctagaacatcctaatcgaaaaaagtggatccgatctagtcgccagtcgtcgtcgttaaaaccgagaagagaccaggccgaaggaaaacaatcctgaaaccaagccatgggtctgcaggaggaatttgaggagcatgctgagaaggcaaagaccttgcctgagaacacgagcaatgagaacaagctgatcctatacgggctctacaagcaagccacggttggagatgtgaataccgatcgtccgggcatattctaccaaaaggacagggccaagtgggatgcctggaaggctgttgaaggcaaatcgaaggatgaggcgatgaatgactacatcaccaaggtgaagcagctccaggaggaggctgccgcctcttaaaagtctcttaatagtgttgccaaacagctatttgtcagatgagctttgtgccatttcctcattagaagtatatcattcgatccattggggatctgtgaaccatgtacctgtttatgtaactggttaccagtgttatccatctatctatctatctgtgaagacttgagtcttctaaattatgatatct

SEQ ID NO: 55583 - protein, 89 aa, Zea mays; identical to SEQ ID NO: 54684
  misc_feature: Ceres CLONE 1489896
  misc_feature (3)..(87): Pfam Name: ACBP Pfam Description: Acyl CoA binding protein
  misc_feature: SWISSPROT Homolog: EC 5.3.3.8 Dodecenoyl-CoA isomerase

SEQ ID NO: 55584 - DNA, 641 bp, Zea mays
  misc_feature: Ceres CLONE 1489900
  misc_feature: Encodes the peptide sequence at SEQ ID NO. 55585
  misc_feature (495)..(495): n is a, c, t, g, unknown, or other
  misc_feature (557)..(557): n is a, c, t, g, unknown, or other
  misc_feature (624)..(624): n is a, c, t, g, unknown, or other
ctccccgcggtggcggccgctctagaactagtggatcccccgggctgcaggaattcgcacgagaccattacctagaacatcctaatcgaaaaatcttccggtcttccccatgtcggacgcgtataggaaagccaagcctggccgcctcgtcttcaagggcggcgaaaccgcctccatccgcaagccgaacaagctcaagaacattaagaagcccgcgtcggacgccctcgcctacggcgacctccaggccgcggccgcatccgcggagggtgctgaaagcggcggaagtgcgggcaggggctgtggcgatgacttccccattcgagccgcgaagaagatgatgtacgaggaactcttccctgcggagcccaagaaattcgggtatgaactcgacaatggttgtttttgtgtccccccccaaccctcccccccccaggcttccctcggaagaaggcgttacccaagaaagccaacccgcctactggcaatgacctnacactcaaacggcccattcgacgatccgtaagacagttgccgtagctcccagagattccatnatataaccctactccccgcccaatatagttagcttcttcatggacacataatacaaaaaaaaaaaanatatttatcccaaccca

SEQ ID NO: 55585 - protein, 138 aa, Zea mays
  misc_feature: Ceres CLONE 1489900
  misc_feature (129)..(129): Xaa is any aa, unknown, or other
MSDAYRKAKPGRLVFKGGETASIRKPNKLKNIKKPASDALAYGDLQAAAASAEGAESGGSAGRGCGDDFPIRAAKKMMYEELFPAEPKKFGYELDNGCFCVPPQPSPPQASLGRRRYPRKPTRLLAMTXHSNGPFDDP

SEQ ID NO: 55586 - DNA, 774 bp, Zea mays
  misc_feature: Ceres CLONE 1489901
  misc_feature: Encodes the peptide sequence at SEQ ID NO. 55587
ctcaccgcggtggcggccgctctagaactagtggatcccccgggctgcaggaattcgcacgagaccattacctagaacatcctaatcgaaaaacttagcggcgataaagagaagaaaaaatcggtgaagttcttgaagcagaacaagggcgtgatccttcttcaaggccggtacgccggaaagaaagcggtggatctcccccccttcgccgacggaaaccgtgaccgcccctacggactccgcctccggggtggactccacaaactacgccgaagacaggccataccgacaggtgttttgccatcacagacggcaaaaaatatgccccacacccaacggcccctcccctccgtccgggtgccccgccccgcctccctgggctgcgtaccgtgttggcaccctccgagccgcctgtaattctccgggggtaaggtgtggtatttctcgccgccccgcctctttcttgttttcattcgcgcacaaatcaaatcaggctgccctgccatccccgggtggacggcttaaaacatcgtaaacccacgcagtcggctcccttaacttccggctctctaccaccacagcgacctgtgccatatcctaatcaccctgcaccacctagggttacctaaacgccgcgacttgcccgcgcttcgggcgttctcaacaaatcaagagccttggtaatatcagaacacagcgaggcgtgattcgcgcctcggtcgctcctgtgcgctgtcgccgcgcccgagttctcgagggcttagtacctcccct

SEQ ID NO: 55587 - protein, 31 aa, Zea mays
  misc_feature: Ceres CLONE 1489901
MPHTQRPLPSVRVPRPASLGCVPCWHPPSRL

SEQ ID NO: 55588 - DNA, 664 bp, Zea mays
  misc_feature: Ceres CLONE 1489905
  misc_feature (394)..(394): n is a, c, t, g, unknown, or other
  misc_feature (395)..(395): n is a, c, t, g, unknown, or other
  misc_feature (409)..(409): n is a, c, t, g, unknown, or other
aagctggagctccccgcggtggcggccgctctagaactagtggatcccccgggctgcaggaattcgcacgagaccattacctagaacatcctaatcgataactagctcatttctgttctcctccccagccgccagaatagtatccagccgccaggaagcatggccgacggcgcccttctcatcctttctctgtttctgttcttgcactgccaggccgtgccctttcccactggtgatggcgagtagctcaactggcccttaccgccaacgagtgcgtccccatgtgagggtgcgcggtcgtcggtcggtggccggtgagagctcggctagcccaaaaaaaaacaaaaatatgtcggccatcgccttttgaaccttgcccgacgaacaaaaccgnncgctctcctctctngtcatgctctttctaatctctgtttctaagttccagacggttcacccaagaaccggtcgccacgagcttggcccaacaaacaaacctttccccccggccccttttgcccgtcccccccttcccctcctggggccccgtttttttattcctttcaagactaacccccaagaacccccccccaatcgggttttttttaattccggggccaaaaaacggggggttttttccccccccttgggggggggggtttttttt

SEQ ID NO: 55589 - DNA, 640 bp, Zea mays
  misc_feature: Ceres CLONE 1489907
  misc_feature: Encodes the peptide sequence at SEQ ID NO. 55590
  misc_feature (640)..(640): n is a, c, t, g, unknown, or other
atagctggagctccccgcggtggcggccgctctagaactagtggatcccccgggctgcaggaattcgcacgagaccattacctagaacatcctaatcgaaaaaaaacggccgtccctatctatcggattgcttccagttccagctcgagcactggggcttcgcaggcgagatgaagaggctgcttgctcgtggcaagtccggttgcccctcccggagtttggttggcagaatccctgccctgcctgtactttgcaacaacgttcttcccggccataggtactattcagccgagaaacacgatgacgacaccacgctaggtgagatcggggacaaggcaaggtcgacagccgaggagttcctgagggtggccaaggagaagaccgacgacgtcgcggagggcgcgaaggagacgctgcacgagaccaaggaagcggtggtcggggagtcggacgacgagaaggagaagtcaaaaagagggtggagggaggggaagtaccatcatccgaagaaataagtggcttgtgttctcttggctgcgtatgcaagtcatggcttggattactatacatactcgataggccttgtagtttgtagaagtttactctttgcatccagacgtgtcgatgtcctgtagaatan

SEQ ID NO: 55590 - protein, 114 aa, Zea mays
  misc_feature: Ceres CLONE 1489907
MKRLLARGKSGCPSRSLVGRIPALPVLCNNVLPGHRYYSAEKHDDDTTLGEIGDKARSTAEEFLRVAKEKTDDVAEGAKETLHETKEAVVGESDDEKEKSKRGWREGKYHHPKK

SEQ ID NO: 55591 - DNA, 686 bp, Zea mays
  misc_feature: Ceres CLONE 1489910
  misc_feature: Translation starting site: 110
  misc_feature: SWISSPROT Homolog: EC 5.2.1.8 Peptidylprolyl isomerase
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (382)..(382): n is a, c, t, g, unknown, or other
  misc_feature (686)..(686): n is a, c, t, g, unknown, or other
ggcggccgctctagaactagtggatcccccgggctgcaggaattcgcacgagaccattacctagaacatcctaatcgaaaaaacaatattatctcaaagctaaccaacaatggcgttcccaaaggtgttcttcgacataaacatcaacggccaggcagcgggaaggatcgtgatggagttgtatacggataagacgccgaagacggctgaaaattccgagctctgtgcactggagagaagggagtggggcttaagggaaactctttccacttcaagggagcgtccttccaccgagtgattttttttttcatgtgcccgggaagcgatagaacnnnttttttttttcccccccccgggggggaaagaaggggggnnnnncccnccacccccactccccccatttaatacaaaaaaaaaaaaacaacctccccggggggggggggcggaggccgaaccaagacgatatcctccttttcttattgcgccgcaaaaccccgcgagggcgcccgccgccaaaaaatacccgtttccctcgccccccgtccacccccaccactttttcccctttacgcgattcctaacgccattattcgcagctccctcctataaagccccccccccccccccgatcccccccccttcttcccccgtatattttccgcttcgccccgcgcccccataccctn

SEQ ID NO: 55592 - DNA, 716 bp, Zea mays
  misc_feature: Ceres CLONE 1489911
  misc_feature: Encodes the peptide sequence at SEQ ID NO. 55593
  misc_feature (378)..(378): n is a, c, t, g, unknown, or other
  misc_feature (379)..(379): n is a, c, t, g, unknown, or other
  misc_feature (387)..(387): n is a, c, t, g, unknown, or other
  misc_feature (393)..(393): n is a, c, t, g, unknown, or other
  misc_feature (396)..(396): n is a, c, t, g, unknown, or other
aagctggagctccccgcggtggcggccgctctagaactagtggatcccccgggctgcaggaattcgcacgagaccattacctagaacatcctaatcgaaaagtcattttcctcgcaaaaggaagccggtgagccggagagattcccgtcgtttcgacgcaccggatcgcgggacctctcgcctcccctccctttccttcccttccctgcgccgcccacggcagaatggcgggagccgacggggcgcagcaacaccatccttgcagcatctgcatggagcccatggcgccctccgcggcccaccgcggcggcgccgcctgcacgcacgcattctgcggcgcgtgcctgtccggtcacgtccgcgccaagctagagtgcnngcggcgcngccccntgntgcggtgccccgacgcgtcctgcgctgccacgctcgaccccgagctctgcccgcggcgcgctcccctccgaagtcttcaagcgctggtgggccaaggctctgcgagttcctggtccctcgaaggggcccgaccttaagcccccttccccggaattgttttaaaaaaatggtggcccaaaaacaaccggaaaaaaaggggggaccccatccccagaggcccggggggcccgggcggttttttttccccccggggccccggtgccctggccacccccgttttttcactccccaaaaaattcccccctctcttaaagggggga

SEQ ID NO: 55593 - protein, 102 aa, Zea mays
  misc_feature: Ceres CLONE 1489911
  misc_feature (52)..(52): Xaa is any aa, unknown, or other
  misc_feature (55)..(55): Xaa is any aa, unknown, or other
  misc_feature (57)..(57): Xaa is any aa, unknown, or other
  misc_feature (58)..(58): Xaa is any aa, unknown, or other
MAGADGAQQHHPCSICMEPMAPSAAHRGGAACTHAFCGACLSGHVRAKLECXRRXPXXRCPDASCAATLDPELCPRRAPLRSLQALVGQGSASSWSLEGARP

SEQ ID NO: 55594 - DNA, 642 bp, Zea mays
  misc_feature: Ceres CLONE 1489912
  misc_feature: Encodes the peptide sequence at SEQ ID NO. 55595
aaagctggagctccccgcggtggcggccgctctagaactagtggatcccccgggctgcaggaattcgcacgagaccattacctagaacatcctaatcgaaaaacccacccacgccgacgagcaaaccctagcgagcgagagagcccggagccgagagaccagccagccatggcgctgcgtgccctgtacaacgagatccggagcatgaaggtccgcgacgtgccggcttacctgaagccgcgcttgacctgggacaacgtcaagaagagcgccgaccaggccgtcgaccgctacatcgagaagtacatcgacacgagctcgccggaccctctctaccacgtctgcatcggagggatgatcttctcctacttcgtcaatccttccctgagagcgcgcccacctcgcccacctcgaggagatggagaggaccggtgggaacacctaatccgccgcccccgtccctcgccggcagcgcgggaggacgggtgactttcatgggggcccattcaagcctgaaggccttccgtttccctccgctggttgaaccaccggaaccctggttcctttgggccgtgggttttggaccccccaccaagcaaaaaacgggccccgccttttttgttcttggttccccccccctcg

SEQ ID NO: 55595 - protein, 106 aa, Zea mays
  misc_feature: Ceres CLONE 1489912
MALRALYNEIRSMKVRDVPAYLKPRLTWDNVKKSADQAVDRYIEKYIDTSSPDPLYHVCIGGMIFSYFVNPSLRARPPRPPRGDGEDRWEHLIRRPRPSPAAREDG

SEQ ID NO: 55596 - DNA, 554 bp, Zea mays
  misc_feature: Ceres CLONE 1489924
  misc_feature: Encodes the peptide sequence at SEQ ID NO. 55597
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (415)..(415): n is a, c, t, g, unknown, or other
  misc_feature (532)..(532): n is a, c, t, g, unknown, or other
aaagctggagctccccgcggtggcggccgctctagaactagtggatcccccgggctgcaggaattcgcacgagaccattacctagaacatcctaatcgaaaaaaaaccatctgctattctgctcgacggctcagctctagcctccactccaggcaccggagtccgagagcccgcctacagtgatggcgcccaagcacctcaacctcttcgccgcggcgctgctcctcctcctgcctcnnnccctccggctccagcgccaccgccgtcgagtactgcaaaaaggggtgggactacccagtgaaagagtgagcagccgtggaagtcgttccccgatccccgtcgtcaggggaacagcggccaccttcaagattccgccccccccgaataaaacccccctgaagggaaaacccaacgntgtggggggggggaaattttttttttcccccggcccccccgggaaaaaccaaaaaccccccggggggaaaaaaaaatcttcgccccccccaaaaaaaaggggaaatttttttggggntcttcttgagacaaaaacaaaa

SEQ ID NO: 55597 - protein, 124 aa, Zea mays
  misc_feature: Ceres CLONE 1489924
  misc_feature (19)..(19): Xaa is any aa, unknown, or other
  misc_feature (20)..(20): Xaa is any aa, unknown, or other
  misc_feature (78)..(78): Xaa is any aa, unknown, or other
  misc_feature (117)..(117): Xaa is any aa, unknown, or other
MAPKHLNLFAAALLLLLPXXLRLQRHRRRVLQKGVGLPSERVSSRGSRSPIPVVRGTAATFKIPPPPNKTPLKGKPNXVGGGKFFFSPGPPGKNQKPPGGKKKSSPPPKKRGNFFGXLLETKTK

SEQ ID NO: 55598 - DNA, 733 bp, Zea mays
  misc_feature: Ceres CLONE 1489925
  misc_feature: Encodes the peptide sequence at SEQ ID NO. 55599
  misc_feature (390)..(390): n is a, c, t, g, unknown, or other
  misc_feature (431)..(431): n is a, c, t, g, unknown, or other
  misc_feature (462)..(462): n is a, c, t, g, unknown, or other
  misc_feature (495)..(495): n is a, c, t, g, unknown, or other
  misc_feature (521)..(521): n is a, c, t, g, unknown, or other
  misc_feature (581)..(581): n is a, c, t, g, unknown, or other
  misc_feature (682)..(682): n is a, c, t, g, unknown, or other
  misc_feature (713)..(713): n is a, c, t, g, unknown, or other
ccatgctggagctcaccgcggtggcggccgctctagaactagtggatgccccgggctgcaggaattcgcacgagaccattacctagaacatcctaatcgaaaaaaccaatctcctcgtctcccactcggctacccacatcccccggagctccacaaaaatctccgctcccaggctcccacccgcgcggagggggcaagcagccagcagccgcgcggcgccactgccttgccctcaacccctcacccaaacgcctcgctttggccgccccccacaaggccactcacccaaaaaatctccactcctcgaccgcaccgagcagaggatcacatgggatccggcgtttcgcttgtcatctggcccacgggcctggtccagcggggacggcgcangccggcttcctcggcgttcctgtttggtggggacccgcgtnaaacgccccccaaaaaaaaaacccccgcaancggcctccgggggcgcccgcgcggcgggcgccnggccgagaaaaaacgacaaccagcanggggcccgtgggaggggggccccaagcggccgtcgagggaccagcgggtgtggcgaaaanaaataacgccgtatcccttgcggcgggctaagaagagccgggggggccatacatacctctcaccaccaacgctcttcccacactaacttgggggcggcaanagagactccaaacacgcggtcaggcacccancacgacgcgggctggacgaa

SEQ ID NO: 55599 - protein, 221 aa, Zea mays
  misc_feature: Ceres CLONE 1489925
  misc_feature (130)..(130): Xaa is any aa, unknown, or other
  misc_feature (144)..(144): Xaa is any aa, unknown, or other
  misc_feature (154)..(154): Xaa is any aa, unknown, or other
  misc_feature (165)..(165): Xaa is any aa, unknown, or other
  misc_feature (174)..(174): Xaa is any aa, unknown, or other
  misc_feature (194)..(194): Xaa is any aa, unknown, or other
HAGAHRGGGRSRTSGCPGLQEFARDHYLEHPNRKNQSPRLPLGYPHPPELHKNLRSQAPTRAEGASSQQPRGATALPSTPHPNASLWPPPTRPLTQKISTPRPHRAEDHMGSGVSLVIWPTGLVQRGRRXPASSAFLFGGDPRXTPPKKKTPAXGLRGRPRGGRXAEKKRQPAXGPWEGGPKRPSRDQRVWRKXITPYPLRRAKKSRGGHTYLSPPTLFPH

SEQ ID NO: 55600 - DNA, 585 bp, Zea mays
  misc_feature: Ceres CLONE 1489928
  misc_feature: Encodes the peptide sequence at SEQ ID NO. 55601
  misc_feature (314)..(314): n is a, c, t, g, unknown, or other
aagctggagctccccgcggtggcggccgctctagaactagtggatcccccgggctgcaggaattcgcacgagaccattacctagaacatcctaatcgaaaacactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccnaggggcacgccgaagggcgggtttcgaggcggcccgcccgaaccttaaaaagggggggggaaagggggggggaaattcccatgggaacccccccgaattggggaaaagacaattgggctcccccccagggcggccgggaaaaccttcttttttaaacctttaaaaaataacccccccccctttggtttttccaaaaaccacaaaaatttgggccccggggggctttttaatttaaaaaaaaaaaaaaggggttggggggccccgctctccc

SEQ ID NO: 55601 - protein, 99 aa, Zea mays
  misc_feature: Ceres CLONE 1489928
  misc_feature (1)..(69): Pfam Name: Metallothio_2 Pfam Description: Metallothionein
  misc_feature (49)..(49): Xaa is any aa, unknown, or other
MSCCGGNCGCGSGCKCGNGCGGCSKMYPDMAEQVTTTTQALIMGVAPSXGHAEGRVSRRPARTLKRGGERGGEIPMGTPPNWGKDNWAPPQGGRENLLF

SEQ ID NO: 55602 - DNA, 517 bp, Zea mays
  misc_feature: Ceres CLONE 1489932
  misc_feature: Encodes the peptide sequence at SEQ ID NO. 55603
  misc_feature (228)..(228): n is a, c, t, g, unknown, or other
ctccccgcggtggcggccgctctagaactagtggatcccccgggctgcaggaattcgcacgagaccattacctagaacatcctaatcgaaaatccctacccctacgggtcctgtggccactgcctcttgccgcaggcagccctcttctctctcttccgccgtctcgcctcctcacgccattaaaccccacccgcgcgcgcggcggccggcggcgagccctcacccatnccgagcaaaagcccgtggaggaagcgagcgcgcgaaaaagtatcaggaggaagcatgggtaccctggggcgcgcgatcctcacggggggcaagtggatcccggggacgggggagggcatgaaccgcctcggaacccccaaccaaggggggcctccgcgtcgaggaaaacggtttcaagggatcccaacaaccatgaaaattttttgaaaaaaaagcccaagggaccctaaaaaaataggttttggtttgcccccccaggggcagaaagcgcttttgggggaatggttgt

SEQ ID NO: 55603 - protein, 50 aa, Zea mays
  misc_feature: Ceres CLONE 1489932
MGTLGRAILTGGKWIPGTGEGMNRLGTPNQGGPPRRGKRFQGIPTTMKIF

SEQ ID NO: 55604 - DNA, 638 bp, Zea mays
  misc_feature: Ceres CLONE 1489935
  misc_feature: Encodes the peptide sequence at SEQ ID NO. 55605
aaagctggagctccccgcggtggcggccgctctagaactagtggatcccccgggctgcaggaattcgcacgagaccattacctagaacatcctaatcgaaaaacttattactcgcgttcggcacgcgggcgacggcggcggcgctcaggctctcagcgacggcgcacaggctctggctctcagcgacggcgtcaacggcttcccctcccgcctctcgccagtcgcctcgctccctcgcctccggtcctccgcacaccgtccgttgatcctgcctcttctggttagatagatggaggtgccaatgaactctacgcaatctggtcctcacttccctgtgcagcatcggtccctctcattagacatcaagggaaataaaacagatattgttatcagtaaatatgaagatacctttctggtgattgtggcacaaatcggctgcatgggaaccatactagctgccaagaaagacgaaagtgttttctcagacccaacctacaatgtgtctgttctttttgggaagagaaatgagccactcctacaagcttgcgcacgtcaacttattgagcacataagtggcagtggctcagctcggtcattggttatttctctgggtctgaaagatcattctcagcaatttt

SEQ ID NO: 55605 - protein, 116 aa, Zea mays
  misc_feature: Ceres CLONE 1489935
MEVPMNSTQSGPHFPVQHRSLSLDIKGNKTDIVISKYEDTFLVIVAQIGCMGTILAAKKDESVFSDPTYNVSVLFGKRNEPLLQACARQLIEHISGSGSARSLVISLGLKDHSQQF

SEQ ID NO: 55606 - DNA, 634 bp, Zea mays
  misc_feature: Ceres CLONE 1489937
  misc_feature: Encodes the peptide sequence at SEQ ID NO. 55607
atagctggagctccccgcggtggcggccgctctagaactagtggatcccccgggctgcaggaattcgcacgagaccattacctagaacatcctaatcgaaaagttttgttcttccgaccttgcctcgccgcatctgctcctccagacacagcgcacccgccttcctcatcctgattccgtggccggcggccgcctaacctcagccccctcacccccaccgacgccgccggagcccttgaagtagcggacccgggctctcgcgcccatccgcgtcaggagttcgatgtccgtttgcgcctgatggatccgcaccggctgaccggccccgccgcgtccgacgccgacgatgccgatgactgggataatgatgactttgtgatcccaagttttagtgttgaagaatctgatatcggtgactgggaagcttcacgggctaccgatcctcaaccacctccaaagcccagcaaagatacagagaacatatatcttggaccacacggagcaccgccatctcgagcgaagaaagcagaagaatactggggctacggcttggttaccgggagaagaaccacaagcggagggaagctgaacaaaaggcctttggaactgggcggaacagccaaggggggcaacc

SEQ ID NO: 55607 - protein, 111 aa, Zea mays
  misc_feature: Ceres CLONE 1489937
MDPHRLTGPAASDADDADDWDNDDFVIPSFSVEESDIGDWEASRATDPQPPPKPSKDTENIYLGPHGAPPSRAKKAEEYWGYGLVTGRRTTSGGKLNKRPLELGGTAKGGN

SEQ ID NO: 55608 - DNA, 649 bp, Zea mays
  misc_feature: Ceres CLONE 1489938
  misc_feature: Encodes the peptide sequence at SEQ ID NO. 55609
aaagctggagctccccgcggtggcggccgctctagaactagtggatcccccgggctgcaggaattcgcacgagaccattacctagaacatcctaatcgaaaagaatcgggcgttctgggctcctctgtttcctttcgtcaccgtcctcgccgttgtgttcctctctcagtctcggggcttcttctcgcgggcacctccggctgcttcctttgccaccgcagcaccagcgctgtccatggagcccccgccgctctcctcgttgcaggaggagggggaggaggggcctaccgtcgaggactcgtccgtcttctccgccgccgttgtgccgcctcgccccgccacgcacagccactcgctccacaagtacgcgcctctggactggtccgcctacttcgacgaggagcgccgcgtagccatccccgacaccgacaacgttttcaatgcgtacacgaccggatcggaggggcccgtcgtgttctgcctgcacggaggcggttattcggggctttcatttgctctagcagcaagtcaaatgaaagacaaggctcgtgttgttgccatggatctaagggggcatggaaaatcaacacgaatgatgatcctgatttgcccttgaaacctctaccaatgaagcaaagctgttatacct

SEQ ID NO: 55609 - protein, 126 aa, Zea mays
  misc_feature: Ceres CLONE 1489938
  misc_feature: SWISSPROT Homolog: EC 3.8.1.3 Haloacetate dehalogenase
MEPPPLSSLQEEGEEGPTVEDSSVFSAAVVPPRPATHSHSLHKYAPLDWSAYFDEERRVAIPDTDNVFNAYTTGSEGPVVFCLHGGGYSGLSFALAASQMKDKARVVAMDLRGHGKSTRMMILICP

SEQ ID NO: 55610 - DNA, 652 bp, Zea mays
  misc_feature: Ceres CLONE 1489951
  misc_feature: Encodes the peptide sequence at SEQ ID NO. 55611
ggagctccccgcggtggcggccgctctagaactagtggatcccccgggctgcaggaattcgcacgagaccattacctagaacatcctaatcgaaaactcttcgcttgatcgcttctaactccgctgggccaccagctttgaccgccgcctcccttcccctccgctactgctcctccccaccccactcccccgcaggagcggcggcggcggcggcggcggcgaggtcgtaccccacatcggcgagcggcggcggcaccgccggaggcaaaggcaagatgttcgggcgcgcgccgaagaagagcgacaacaccaagtactacgagatcctcggggtgcccaagtcggcgtcccaggacgacctcaagaaggcctaccgcaaggctgctatcaagaaccaccccgacaagggcggtgaccccgagaagttcaaggagctcgcacaagcctatgaggttttgagtgatccagagaaacgtgagatttatgatcagtatggtgaagatgcccttaaggaaggaatgggcggtggaggatcccatgttgatccatttgacatcttctcatcattttttggaccctcttttggaggaggtggtggaagcagcaggggaagaaggcaaagaggggagaagatgtagtccacccacttaaa

SEQ ID NO: 55611 - protein, 120 aa, Zea mays
  misc_feature: Ceres CLONE 1489951
  misc_feature (13)..(71): Pfam Name: DnaJ Pfam Description: DnaJ domain
MFGRAPKKSDNTKYYEILGVPKSASQDDLKKAYRKAAIKNHPDKGGDPEKFKELAQAYEVLSDPEKREIYDQYGEDALKEGMGGGGSHVDPFDIFSSFFGPSFGGGGGSSRGRRQRGEKM

SEQ ID NO: 55612 - DNA, 678 bp, Zea mays
  misc_feature: Ceres CLONE 1489954
  misc_feature: Encodes the peptide sequence at SEQ ID NO. 55613
aaagctggagctccccgcggtggcggccgctctagaactagtggatcccccgggctgcaggaattcgcacgagaccattacctagaacatcctaatcgaaaaattctcgaagtcgctgcggcacgcgtcccgcttctggtttgcttgcctgttgcctcccagatcttgccaactaattggaggcagccgagctgatctcccattctcccatcccgcaacgcgccgtctcgacggcggatcggtttcttctgcttctactgcgtgatctttgggcaagaagataagacacgtccaagcgtcgccacagtcaagggcggcttggttgcaggcaagatggggaaggacggagaatctgccaagctgaaggaggagaaggagtccaaggaagagatccatgtgaaggtcaagagcaagggcgagcggtccggcgaggaagacggcaaggaggaggtcgaggtagagattgaggccaagtttgttgagaaggaagaggtcaaagactcgggtgacggtgcgggaggaaagggtaccaagaagaaggatacaaagaagaaagacaagaaaaagaacgaaggtggtgacgattcatggaaggcagaggaagacaagaaggataaagcgaaggattcagagggcaaggaccaagtgaagaaggaaaagaaggatggttggtgggga

SEQ ID NO: 55613 - protein, 115 aa, Zea mays
  misc_feature: Ceres CLONE 1489954
MGKDGESAKLKEEKESKEEIHVKVKSKGERSGEEDGKEEVEVEIEAKFVEKEEVKDSGDGAGGKGTKKKDTKKKDKKKNEGGDDSWKAEEDKKDKAKDSEGKDQVKKEKKDGWWG

SEQ ID NO: 55614 - DNA, 669 bp, Zea mays
  misc_feature: Ceres CLONE 1489957
  misc_feature: Encodes the peptide sequence at SEQ ID NO. 55615
  misc_feature (622)..(622): n is a, c, t, g, unknown, or other
aagctggagctccccgcggtggcggccgctctagaactagtggatcccccgggctgcaggaattcgcacgagaccattacctagaacatcctaatcgaaaaaaaaagatgttttccgagctgcaccagaggcccagcccacggtcagtgtcacctctgctatttcttcacccgtccgttcacctgcgttcatccggcctacgttaaaatctctccatcccggcgacgactggcgacagccgctgccggcctactccaggtccccaggtctacgtcggacccttcgccgcggcgagcaccaccagagatctgtcactgattttgcagtcctcttgtcagatggcgagcacggggcggtcgatgctgctgtcactgctcctcttcgcagtgacgctgtcgctgctggagatgtacagggccaagttcgcctcgtcggagctcatgaccatcgccggtggattcgtctgctccctcctattcctgctactcctcacctttattggaaactatcaagaagctagtggagatagaactgggtggggtgcagcttcctgttttccgctggactcctttacgaggttgacaagctctctggcatgatccttgcgaggagtgagtctaangtgaggcggcactaagcacagaagcagcacagagagatgatacattg

SEQ ID NO: 55615 - protein, 86 aa, Zea mays
  misc_feature: Ceres CLONE 1489957
MASTGRSMLLSLLLFAVTLSLLEMYRAKFASSELMTIAGGFVCSLLFLLLLTFIGNYQEASGDRTGWGAASCFPLDSFTRLTSSLA

SEQ ID NO: 55616 - DNA, 663 bp, Zea mays
  misc_feature: Ceres CLONE 1489968
  misc_feature: Encodes the peptide sequence at SEQ ID NO. 55617
aaactggagctccccgcggtggcggccgctctagaactagtggatcccccgggctgcaggaattcgcacgagaccattacctagaacatcctaatcgaaaaataatcacaaataactctatactcgctgtaggcaggcacctccgctcctgtcctcttctctcgtcgcttcctccgtctctcggcgtcaaatctcctccagccaccgcgcacactctactcgacgcccggtggaaggagttctccgggatttgagctgattctgccctcacctccgctgggccggcgtcgagtggggatccaatcgaaaatcgaactgacttcatcttctgttgcatccccatcaggataagccatgtcaggagtgatcacaaagttcgcggatacatccatggtgatgtggatggccccggttgcgatcgtttatgggttctactaccaggcatttccaggtgtgagtcggatgtcatcctcgacgcatacactcgccagcgggttcctggctgtcatatcagttaatctggtgatcggcttgtacatattcatggcgatgaaggagactcgacaccaggagccacagccagacccgaccttcctggcaaacgccaaagcgagtatcaaccagccaacatcctctcaaccgagtgatggttccaaggggaag

SEQ ID NO: 55617 - protein, 103 aa, Zea mays
  misc_feature: Ceres CLONE 1489968
MSGVITKFADTSMVMWMAPVAIVYGFYYQAFPGVSRMSSSTHTLASGFLAVISVNLVIGLYIFMAMKETRHQEPQPDPTFLANAKASINQPTSSQPSDGSKGK

SEQ ID NO: 55618 - DNA, 671 bp, Zea mays
  misc_feature: Ceres CLONE 1489969
  misc_feature: Encodes the peptide sequence at SEQ ID NO. 55619
aaagctggagctccccgcggtggcggccgctctagaactagtggatcccccgggctgcaggaattcgcacgagaccattacctagaacatcctaatcgaaaaagaggtaggaactactagcatcacattcccctccccgcgccgcccggacaggacagcgcaaaaggccacctttccttttcctccgacgaggccggccggagctttgggacttgggagtgattgattccatatcattgcgcattaggtgcgcgatctccgtcaacctccttgcctccactccacagcccacgcatccccctgccgctgcctgcgcctacatatctgacaaacgacctccgctctgcaccgtgccgagactgccgactaccgacagacacggtggtctgccactgccagtctgccactgccaggcgccgtcctgcagagatggcagcggcgctgaggccgaggctgctcgtgctgctcgcggtggcggccgcggcgaccgggccgtcgtgcgccggcgccggccgcgtcgacctgtggccaatgccggcgtcggtcgcccgcggcgcgcagacgctcctcgtcagcaaggacctcaggctgtccacggccgggagcagctaccccgacggcaagggcatcctcacggaggcgttccggcggatggtggccgtcgtggagct

SEQ ID NO: 55619 - protein, 80 aa, Zea mays
  misc_feature: Ceres CLONE 1489969
MAAALRPRLLVLLAVAAAATGPSCAGAGRVDLWPMPASVARGAQTLLVSKDLRLSTAGSSYPDGKGILTEAFRRMVAVVE

SEQ ID NO: 55620 - DNA, 667 bp, Zea mays
  misc_feature: Ceres CLONE 1489971
  misc_feature: Encodes the peptide sequence at SEQ ID NO. 55621
  misc_feature (667)..(667): n is a, c, t, g, unknown, or other
aagctggagctccccgcggtggcggccgctctagaactagtggatcccccgggctgcaggaattcgcacgagaccattacctagaacatcctaatcgaaaaacccatctgcccggtcgccgaaacctagctcctctcaaagtctcgattctcctcgctcctcggccctcgcccacctctcgctagtcgctccccacttcccagtctctgtggccggacgccgcggcgagatggcctcgacctgcttccgcgccgccgcccgcgtggcctccgccgccagtcgctcggcggcggcctaccgctccgctccctccgcggcacgcgccgtggcaactgccgcccaccgcatatcgtgcttctccagggtgccggtggagctcgggtgctgcgcgggattgtcactgctgccgctgcacagtgcggtggcgtcagccaggctgacgtcgcggctgagcacggcgtcgagctgccgtgctctctctcagcagatgggtcaatccgttcgaaggtgataaatggtcaaatggatggacgacctgctcatgtcatgctatcggactgaaatgatttatgtagagtagttatcgaattgaacatctggagcatgacttttcattacccgatctacaatcatggattttttttttcaaggtttgagttcgtgcctn

SEQ ID NO: 55621 - protein, 93 aa, Zea mays
  misc_feature: Ceres CLONE 1489971
MASTCFRAAARVASAASRSAAAYRSAPSAARAVATAAHRISCFSRVPVELGCCAGLSLLPLHSAVASARLTSRLSTASSCRALSQQMGQSVRR

SEQ ID NO: 55622 - DNA, 660 bp, Zea mays
  misc_feature: Ceres CLONE 1489972
  misc_feature: Encodes the peptide sequence at SEQ ID NO. 55623
aaagctggagctccccgcggtggcggccgctctagaactagtggatcccccgggctgcaggaattcgcacgagaccattacctagaacatcctaatcgaaaactctcgcgcactcgcgcttgcctgcacgctccagggcttcaggctcccctcccacctcgccgcggcagccatggcgatcacggcgccaactcccgacatccgcggcgagcgtcagtccggccaggacgtccggcacgcagaacgtgatggcatgcggcgcgttgtccaacatcgtaaaatcctcgatcggccccgtcggtctcgacaagatgctagaggacgatatcggggatgttacaatcactaatgatggtgcaaccatacttaagatgttggaagctgagcacccagctgccaaggttcttgttgagttggctgaactccaagaccgtgaggtaggagatggaacaacttccgttgtcatcatagcggcggagctgctcaagagagccaacaatcttgtgaagaataagatccatccaacctctataatcagtggctacaggcttgctatgcgtgaagcctgcgaatatgttgaggagaaattggcagtcacggttgacaaacttggaaaagactcccttatcaactctgcataaactagcatcgtcttctaag

SEQ ID NO: 55623 - protein, 130 aa, Zea mays
  misc_feature: Ceres CLONE 1489972
MACGALSNIVKSSIGPVGLDKMLEDDIGDVTITNDGATILKMLEAEHPAAKVLVELAELQDREVGDGTTSVVIIAAELLKRANNLVKNKIHPTSIISGYRLAMREACEYVEEKLAVTVDKLGKDSLINSA

SEQ ID NO: 55624 - DNA, 701 bp, Zea mays
  misc_feature: Ceres CLONE 1489978
  misc_feature: Encodes the peptide sequence at SEQ ID NO. 55625
ggagctccccgcggtggcggccgctctagaactagtggatcccccgggctgcaggaattcgcacgagaccattacctagaacatcctaatcgaaaaaaggaaaacccaaagccagcagctgtctgcgtcgccgtcggcttcctatcctactgcgtgcgtggacctcgctatgctcacgcggcgaccggtggctcctcctattgctacaactacttgtactcgcgcccgtcccttgcgcacgcaacgcaagcgcagacacgagcgatccgatccgatccggaactgtgccggccagccatggcgactagggttttgctcaccgccctcctcctcgccttcctcctcgtcgccacccctttcaccgcccgagttgctagagctgattcggaggaagatgctgctgcagctgaggttgttgaaggggttgatctaggtattgtgggcgatgatacccaggtttccagtgactggacctttaatgccctgctcccgggggtatagaccctaccttgttttcccccaaaaaatgcttgccaaaactggaccatgccatgcgaagtaacctgaaattatttagttgggccccgggccaacttaaggggggaattcgacctctatattggttggggtgccccgttccattccaacctcctcccatttttcccttcgttgacccccccccatttgtattcggctcccag

SEQ ID NO: 55625 - protein, 67 aa, Zea mays
  misc_feature: Ceres CLONE 1489978
MATRVLLTALLLAFLLVATPFTARVARADSEEDAAAAEVVEGVDLGIVGDDTQVSSDWTFNALLPGV

SEQ ID NO: 55626 - DNA, 1024 bp, Zea mays
  misc_feature: Ceres CLONE 1489983-R
  misc_feature: SWISSPROT Homolog: EC 4.4.1.5 Lactoylglutathione lyase
aatgtggtccgggccccccctcgaagtcgacggtatcgataagcttttttttttttttttttggtggaaaatattttttctgacacgtttcatagttcagctcacaaagataaaaggaacaaaggcagagaaacacgacacacactgtaacatcttatttagattaattactaagtcttccctcgacttcataagatcacatgttattattatggtttcggctgggatctcgaccatcatcatcatcactcgtcctcattccagttccttcagaaaatcttcattgtatacaaggactgttttccacccatctggatcgaggaaagagacaatcttggtgccgagtccaggaagtggtccggcttctctggtgatctgtcctcctagctcttggggggccaccatcactactttcgcgccttttgtacacatcatccagggcctattgcagatcctgggcaaaatgcgttggccccttttggggaactcacgctacgccgttattttattagggtgagggtcccaaaactaatgggacgtcataattgccttccagcaataatccgcaatgcaagccgctatgtggagttaactgtggtagtttcaagggactttcccaaaatccccttcctacaaagagagatctcaatttcgcgagagggggcccctttatttcataaggaaaacctttggatggggcacacgggtcccaaaagatctatctccaacaccgtaaagcttatgtgaacgcttgtacaagaaaaagaggtgtccgagggaggggtggggtcctccctcctggggattgaaccttctacaaaatgttgaaagctctagcgggtggggccccctgttaataaagtggcattgtgaaaaatgtgggccacccacccctttataaaacggagaaccacgagtttctatatggagggacattttctccacacatttgtggggacggggaacgggcattcaacaccaggttttggaagaaaaaattcgcgggggtgttaaataagccgga

SEQ ID NO: 55627 - DNA, 678 bp, Zea mays
  misc_feature: Ceres CLONE 1489985
  misc_feature: Encodes the peptide sequence at SEQ ID NO. 55628
aaagctggagctccccgcggtggcggccgctctagaactagtggatcccccgggctgcaggaattcgcacgagaccattacctagaacatcctaatcgaaaactcccttcttcatctcttctcctcacaaggcttcctcccaccacctccagtcctccaccggaccaccacctccagtcctccaccggaccaccacctccaccactcctctctcagaacacgcgcaaaccgctcgaaccctatctggtggcgggaggcggaggtggctccgggatgacgcagcggtgctcgcactgcagccacaacgggcacaactcgcggacgtgccccaaccgcggggtcaagatcttcggggagcacctcaccgatggctcggtcatctgcaagagcgcgagcatggggaagctctgcatcatctacgcgggatcagcagcggcagcgcgtcccccgtcgacgggccggacatcccgaacgacgccgaggcttacgcctcgacgacttcatcagggtcgtcctccccatccgcaattaaaagaaagggttccttgactgaaaaaaaaaccgaaggtttttgcggggataaaaaaccccggaaaggggatttgccaagaaaattcccgaaattttgggggcccaaaaaccccatcccgtgggcgggcctgcctcaaaaattttttc

SEQ ID NO: 55628 - protein, 91 aa, Zea mays
  misc_feature: Ceres CLONE 1489985
MTQRCSHCSHNGHNSRTCPNRGVKIFGEHLTDGSVICKSASMGKLCIIYAGSAAAARPPSTGRTSRTTPRLTPRRLHQGRPPHPQLKERVP

SEQ ID NO: 55629 - DNA, 332 bp, Zea mays
  misc_feature: Ceres CLONE 1490049
cccccgggcggcgctctagactagtggatcccccgggctgcagaattcgcacgagaccattacctagaacatcctaatcgaaaactctgctaacgccgctcgcgcatcctattgccctcgcgccaccgtcgccgccgctgcagcgagccaccgccctggccgtcgcctgaaggtagacacccaagcccacccgcccatgggggcggtatggcaccaagcccccggggaaaaagggaatcctcctttccatccgggcgccttgcccgttaccaagaaagggaactccccttccccaaaatcttggggctttcaaaaagaaaaaaagctttacc

SEQ ID NO: 55630 - DNA, 681 bp, Zea mays
  misc_feature: Ceres CLONE 1490069
  misc_feature: Encodes the peptide sequence at SEQ ID NO. 55631
ggagctccccgcggtggcggccgctctagaactagtggatcccccgggctgcaggaattcgcacgagaccattacctagaacatcctaatcgaaaattggttggttcagatgttcaaggctaataaggcagggaacaagatctcatggggcatgtctggaaaagaggcagatcctgctgctttattcagactgtacataaactatggacgccacgcagaagccaccaacctgctggtggagtatctagagtcgttcgcatcgtcgaggccagtggacgtcctccaccgcaagaagatgtccgccgtttggttcccctacaccgccgtcgagaagctctggtgccagcttggtgagatgcaacgggcagggcacagcgtggatcagtgcgaccggctcaagaagctgctgccacgagccttgatgagcccactgcagcaggtcgtggtcgactccgatgatgtgctgtcgttccttgggatatggcagggaatggaggaccaaacagctgagttctaaaaaatcggtttttgcatttgtaaaaaaccaattgccccccccggaaaccggaatggaaattttttgggggcaacccaacccaaaataacccccggtctttttttaaaaattttttttaaaaaaaaaaaaaaggggggggggggcccttttttaagaggaaaaga

SEQ ID NO: 55631 - protein, 135 aa, Zea mays
  misc_feature: Ceres CLONE 1490069
MFKANKAGNKISWGMSGKEADPAALFRLYINYGRHAEATNLLVEYLESFASSRPVDVLHRKKMSAVWFPYTAVEKLWCQLGEMQRAGHSVDQCDRLKKLLPRALMSPLQQVVVDSDDVLSFLGIWQGMEDQTAEF

SEQ ID NO: 55632 - DNA, 703 bp, Zea mays
  misc_feature: Ceres CLONE 1490084
aaagctggagctccccgcggtggcggccgctctagaactagtggatcccccgggctgcaggaattcgcacgagaccattacctagaacatcctaatcgaaaactcacacttcgaataagaacatctaagaaactgaaatcgaacaggggaatttccctttctgctgctgcaaaactgagatcaaccaaggagtgtatgagtcacgagtacgcccaagtaaaagctatggcgggcgacacgggcggcctaatctgaaacccattgccatcggagctatcaaggaatccgaagagggacctggctctcccctcctcaccccgcgtcccacgtcggttcccctaatctgcgtcctccgactcatatgagaccgttctgtaattgctgatcggcgtgatgaattttatgccaatacttcatatcatcatccagatcgtgctcattgtcacatcacactacgagcggaagctgcctattggtgaggctgaggcgaatccaacagctacagcaacgaaggcacacgctcttgtgaaggtacgatgctgataaatacaaagtactattgggggcgagagaaaaaacattctccaaccttaatggggcttcattcagaatccttcaactttcctgctcctcgcaaatttcccggggcaagtaacccagtttattgcttctaaaacacgccctcaaagcccacaagggcaaa

SEQ ID NO: 55633 - DNA, 673 bp, Zea mays
  misc_feature: Ceres CLONE 1490090
  misc_feature: Encodes the peptide sequence at SEQ ID NO. 55634
aaagctggagctccccgcggtggcggccgctctagaactagtggatcccccgggctgcaggaattcgcacgagaccattacctagaacatcctaatcgaaaaaaccaacttgccgaccgcaggaatccagccgacccagcacttccccggttcctcccagcagagtcttcttctctgcatccgttccgttccccggcctctcgcacatccaccgccaccgagccgcgtgcgtcttccatgaaggacccgttcgaggcggacgtcgaggagcaggactcgccgccggagtcgccggcgccgcccgaggatgaacccggcgccgcgggccctgcggaggaccccgaggactacgacggcggcccgcccccgcgccagccgtctgccccggcgtctcacgcagccggtgccaaggccaaggcccgtgtccatagggagcagcaggaggatgacgacgaggacgaggaccagattgaggtcgacctcgagaagcttcccagcagcactggcgacccagacaagctcgctaagatgaatgctatactgtcccaatttacacaacagcagatgaaccgttatgagtcattccgaagatctggatttcagaaatctaacatgaaaaggctgttggcaagcatcactggaagtcagaagatttctatccctacttcaattg

SEQ ID NO: 55634 - protein, 145 aa, Zea mays
  misc_feature: Ceres CLONE 1490090
  misc_feature (98)..(144): Pfam Name: TAFII28 Pfam Description: hTAFII28-like protein conserved region
MKDPFEADVEEQDSPPESPAPPEDEPGAAGPAEDPEDYDGGPPPRQPSAPASHAAGAKAKARVHREQQEDDDEDEDQIEVDLEKLPSSTGDPDKLAKMNAILSQFTQQQMNRYESFRRSGFQKSNMKRLLASITGSQKISIPTSI

SEQ ID NO: 55635 - DNA, 669 bp, Zea mays
  misc_feature: Ceres CLONE 1490094
  misc_feature: Encodes the peptide sequence at SEQ ID NO. 55636
tggagctccccgcggtggcggccgctctagaactagtggatcccccgggctgcaggaattcgcacgagaccattacctagaacatcctaatcgaaaaaaaaacaggcaatgggcaacgcataggcatagcttggctcgcacggtgtcgctggctcccctccccttccctccccactgttacatccagcgagctgttcacggccgtgccgagctcagtgaggaagcgtttgcgagtccggaacgagaggagcagctgtcgacatgcggagggtccgcaacgagataaagccgatcgagaaccccacgcagcgacagtccaccttctacaagcgcacggacggcctcttcaagaaggctaggcagctctccattctgtgcgacgtggacctgctgctgctccacttctccacctccagcaagctctaccactacctctcgcccaccgtcccctccgtcaaggacctggtcgagacgtacgaggccactacgcacaccaagatctggaccgacatccgccaggagcggcgcgcggagctggataaagcggaacacatgtgcgagctgatggaaaaggagctgcggctcatgaacgtggaccaccgggagcaatacaaaaggccacccctggagctgcctgaacacatcctgtaagccgcctttacccaagtt

SEQ ID NO: 55636 - protein, 129 aa, Zea mays
  misc_feature: Ceres CLONE 1490094
  misc_feature (9)..(59): Pfam Name: SRF-TF Pfam Description: SRF-type transcription factor (DNA-binding and dimerisation domain)
MRRVRNEIKPIENPTQRQSTFYKRTDGLFKKARQLSILCDVDLLLLHFSTSSKLYHYLSPTVPSVKDLVETYEATTHTKIWTDIRQERRAELDKAEHMCELMEKELRLMNVDHREQYKRPPLELPEHIL

SEQ ID NO: 55637 - DNA, 994 bp, Zea mays
  misc_feature: Ceres CLONE 1490097-R
  misc_feature (62)..(62): n is a, c, t, g, unknown, or other
  misc_feature (65)..(65): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (99)..(99): n is a, c, t, g, unknown, or other
attaaagagtcccctccttcagaggaaaagggcagataaaaaaaaagggagactcataaccnccncnnnnnnnnccgaatgggtacgggccccccctcnagtcgacggtatcgataagcttttttttttttttttttcgacaaaacacggatgcatggtacatttaacagacagaattgcgaaaccaaaaatggtttatgggattctccaagtaaacatagaaaaagttgaggctcctggtccagctaaccagctccagacagaacaagaattacgtaaatccatatctaaaacaagctcagaggtggtaaagaccaagccatcggaggatatcacttgggccaccagagggcacgccgtaaatgactcggacttccaggtgggtgggagcttcttggtacgcttgtagatagcgggcaaggcagtggatcctgctcccaacaagaatgagtctgaatttggagtccttgaccttcctgttgctcaccaaatgcttcctaatcgacaccggactacttaatgaggaagaagagatcctccgggatctccggcgccaacccatgggccctgaggatggggacgatcttgctcccggtgacgcctcttgacacgagcggatgccatgacgggtcgcggcagccggaacaaataattctgtggacggcgataaaggagccgtgcttcataatgccttcgggtaaaacattctcccccccctcttccgggggggaagcccgggtctaggagcccgggatacccagagggaccctctcctaaggacccggcgttcccccgagggcaatcccaataccctggtcctcccccgccgtattggaaatcccgccccacaagtccagggggaggcccgaaaccccttgaggtcaatgaacaaacggcctcccgcgcggtttagccccttatatcaaatcgttatgtgcgcgaacgggtagtaaaagaagcggtgttaatttcgccgtatttagtgggggcggga

SEQ ID NO: 55638 - DNA, 630 bp, Zea mays
  misc_feature: Ceres CLONE 1490097
  misc_feature: Encodes the peptide sequence at SEQ ID NO. 55639
ccccgcggtggcggccgctctagaactagtggatcccccgggctgcaggaattcgcacgagaccattacctagaacatcctaatcgaaaactctgctaacgccgctcgggcatccgtattgccctcgggccagcgtcaccgtcgctgcagatagccagcgccctgccgccgcctgtaggtatacaccaagccaccgccatgaggtgtatgcacactcactcgaaagggatctcttcatcgtctctgccgaccaaaatgactcctccgatctggctaccgacagctaccaccaaggttgaggatattattaccaacgctgcacacaacggccacacgccgtcgcaaataggagctctgctccgtgagcagcacggcctcccgcctgtcaagaccgtgactgctagaaagaccctccacatcctctaagcccaagggatgccatctgagatcccggaagatcactacttcctcattaaaaacgtggtgacaattacaaactacttgaacaggaacagaaacgacaaggactccgctttcagactcattcttgttgagaacatgatcaaccaccttgccctcctctttaagcgatcctcgaatctccccaccacctgttaattgaaacccaat

SEQ ID NO: 55639 - protein, 60 aa, Zea mays
  misc_feature: Ceres CLONE 1490097
MPSEIPEDHYFLIKNVVTITNYLNRNRNDKDSAFRLILVENMINHLALLFKRSSNLPTTC

SEQ ID NO: 55640 - DNA, 1113 bp, Zea mays
  misc_feature: Ceres CLONE 1490097-R2
  misc_feature (73)..(73): n is a, c, t, g, unknown, or other
  misc_feature (76)..(76): n is a, c, t, g, unknown, or other
  misc_feature (77)..(77): n is a, c, t, g, unknown, or other
tgcaacaaagtaattgtaaaaactacaaaaaaattgaagaaataaaaaaaattttctttgtgatgagagaaanccnncccctggatgctgtgacgtttaaagaaattaattgtaaaccaaaatggtttatgggattctccaagtaaacatagaaaaagttgaggttccttgtccttctaaccggctccagacataacaagaattacataaatccatatctagaacaagctcataggtgctaaagaccaagccatcggaggatatcacttaggccaccaaagtgctcgccgtagttgactcgtacttccaggtgggtgggagcttcttggtacgcttgtaatagcaggcaaggcagtggatcctgctctcaacaagaatgagtctgaatttggagtccttgtacttcttgttcttctccaaatgcttcctaatcgatactgactacttaataaggaagtagagatcctcctggatcttctgcgccaacccatgggccttaaggatggcggagaattcttgttaccagtgacgcctcttgacaataggggatgcctttgctggttcacatgagcataacaccctattcttcgtatggcaatataggacctttatccttccagtccctttgagaaaaataattcacctcgcacaccacgggggggaagcctgagactatagaaccgccgattcgggaagaagagttcttaatgggtattcggagaagccgcgaataagaaaaagtaagaaatatcactgtgtacaacgaacaggatttgtgctgataagatgttatctctaagatggcacattgagaagtattgggaaagccccccatacattttaagggtatatacgcatttgagtggaatagagaatgaattatacgtggtgttaaatattaggttaagcgcaatactggtcaggtagagcgaacagatggtcagagagttgtataatgttctatcattcacgttacgtattttatactacacaatacgagttacttatctctatactcacatagtcattaaagtagcgtctgcaaattacgactctaaattgttcatgttgtcggatgacatcttattttggcgcttggaggcatatgaatgg

SEQ ID NO: 55641 - DNA, 655 bp, Zea mays
  misc_feature: Ceres CLONE 1490108
  misc_feature: Encodes the peptide sequence at SEQ ID NO. 55642
aaactggagctccccgcggtggcggccgctctagaactagtggatcccccgggctgcaggaattcgcacgagaccattacctagaacatcctaatcgaaaacttcccaattcgttctgactccaccgtaagtccgtaacaccgcctaatcaagcaaagagtctacttcggacggctcggcgaatggagattatcacacgggccgccttgtgctgaatccagaggcagcgagacaccggatcccgtccgcccccggaccaagaatcccaacctcacagcgatggcagcatcccgcagcgaggaacgtgatcagaatcagccagtggtgcttgtgacggggtgctcggagggcggcatcggccacgcgatggcgcgcgccttcgctgcggccgggtgcgccgtcgtggccacggcgcggtcacgcggttccatgcgcggtctcgacggcgacccgcggttcctgctgctggagctcgacgtgcgctccgacgagagcgcgcgcgccgccgtggcgggtgcgctgcgggagcacggccgcatcgacgtgctcgtcaacaacgctggggttcacctcgtcgcaccactcgccgaggtgcccatggagtccttccaccaggttttcgacaccaatgtctatggtaggatttttttaaaaa

SEQ ID NO: 55642 - protein, 125 aa, Zea mays
  misc_feature: Ceres CLONE 1490108
  misc_feature (14)..(125): Pfam Name: adh_short Pfam Description: short chain dehydrogenase
  misc_feature: SWISSPROT Homolog: EC 1.1.1.36 Acetoacetyl-CoA reductase
MAASRSEERDQNQPVVLVTGCSEGGIGHAMARAFAAAGCAVVATARSRGSMRGLDGDPRFLLLELDVRSDESARAAVAGALREHGRIDVLVNNAGVHLVAPLAEVPMESFHQVFDTNVYGRIFLK

SEQ ID NO: 55643 - DNA, 658 bp, Zea mays
  misc_feature: Ceres CLONE 1490110
  misc_feature: Encodes the peptide sequence at SEQ ID NO. 55644
  misc_feature (635)..(635): n is a, c, t, g, unknown, or other
aagctggagctccccgcggtggcggccgctctagaactagtggatcccccgggctgcaggaattcgcacgagaccattacctagaacatcctaatcgaaaaataaaaactaccgctctacttggcctttccgcgatggctgagactagggtttcagtggcgacggttgcacgacatgagggagcgcagcgaagccagcacaaccgcggtggacaagcgtccccatagacgagatccatggcggagcgctggaagagcgtcttctccgtgccgaaggccgagaacgcgcggccgacgggacgatggccggcggcgaagcccaaggcgtcggacctgctcgcccgcagccttgactgcagcctcgaccgcaaggactccatcctcgccgccatccacctcttccgccgctctatggccttcgactccacgacatctctctcgtcgtcggacccagccgctccagacctctacgcgtcctctgacaccgacatcgtctcctctggtagcaactcggtagccagtgatccgccgcgtcagggcatcagcgtgccggcgaggttctggcagaaaacaatagccgcatgctacatgcaagctcaagaatgcaataagcggtaggtctgattttggaagcangagtcgttacatcacattggatg

SEQ ID NO: 55644 - protein, 126 aa, Zea mays
  misc_feature: Ceres CLONE 1490110
MAERWKSVFSVPKAENARPTGRWPAAKPKASDLLARSLDCSLDRKDSILAAIHLFRRSMAFDSTTSLSSSDPAAPDLYASSDTDIVSSGSNSVASDPPRQGISVPARFWQKTIAACYMQAQECNKR

SEQ ID NO: 55645 - DNA, 634 bp, Zea mays
  misc_feature: Ceres CLONE 1490112
  misc_feature: Encodes the peptide sequence at SEQ ID NO. 55646
aaagctggagctccccgcggtggcggccgctctagaactagtggatcccccgggctgcaggaattcgcacgagaccattacctagaacatcctaatcgaaaagcccaataccatacagtccacaagtcgcgcgcgggccgcggggtagaacgcaagcggaggcgtccctggcaacaaaggcagcaatggcgacggggtggctcgcagggtctctccccctccgctccgcatccacagccccgtcggcggccagggcacagcctctcccctccgccgccgcgccacgccgcatcccagcgcgactttcggttgccacgggcgggggcgagcagcagctcgtcaccgcgcaggaaccggcgcacgcagaacctgattatggagttgtaagcattcaccatgtcgggatcctgtgcgagaatcttgagaggtcactggcgttctacaaggacctactgggtctgagggtgaatccagctcggccaaacgacaagctcccgtacaggggcgcttggctctgggtgggttctgagatgatccacctgatggagctgccgaatcctgatccgttgaccggacgccccgagcacggcggacgtgatcggcatacctgtataacgattagagatgttctgaa

SEQ ID NO: 55646 - protein, 149 aa, Zea mays
  misc_feature: Ceres CLONE 1490112
  misc_feature: SWISSPROT Homolog: EC 5.1.99.1 Methylmalonyl-CoA epimerase
MATGWLAGSLPLRSASTAPSAARAQPLPSAAAPRRIPARLSVATGGGEQQLVTAQEPAHAEPDYGVVSIHHVGILCENLERSLAFYKDLLGLRVNPARPNDKLPYRGAWLWVGSEMIHLMELPNPDPLTGRPEHGGRDRHTCITIRDVL

SEQ ID NO: 55647 - DNA, 646 bp, Zea mays
  misc_feature: Ceres CLONE 1490114
  misc_feature: Encodes the peptide sequence at SEQ ID NO. 55648
  misc_feature (459)..(459): n is a, c, t, g, unknown, or other
  misc_feature (460)..(460): n is a, c, t, g, unknown, or other
ggagctccccgcggtggcggccgctctagaactagtggatcccccgggctgcaggaattcgcacgagaccattacctagaacatcctaatcgaaaaaaaccaatcagatagagagagcatagtcgatcatgaagggtggcaagaaggaagtggccggtgcggtggtggccatactgctggttctgcagctcatggcagctccaccgacggccatggccgcccgctcgccgcacggagccgtccggatggctccctcgccacgacgcccaaggtgacgatgctgtcggccacgctgtgctacacgggggagacatgcaaatacattggctgcctcactcctgcttgctccctgcactatagtgatcgtctatgctacatcatatttactccctgtgctttgagccattccgcgaaagccacactctcacatgcatgcgacgacgctgcctcgtgagcttnnctgtcagtgatgcatgtttcaaggcatccatccatggatgcttaatgtttatgcctattaattacccctgtttcagggaaacgggccaaaggggggcctgttttatttccgtctctgggggaccaataaagggaaatacctgtttggatgtttgcaaaaaaaaaaaaaaaaccttatccgatcccc

SEQ ID NO: 55648 - protein, 48 aa, Zea mays
  misc_feature: Ceres CLONE 1490114
MKGGKKEVAGAVVAILLVLQLMAAPPTAMAARSPHGAVRMAPSPRRPR

SEQ ID NO: 55649 - DNA, 634 bp, Zea mays
  misc_feature: Ceres CLONE 1490159
  misc_feature (1)..(1): n is a, c, t, g, unknown, or other
  misc_feature (13)..(13): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (89)..(89): n is a, c, t, g, unknown, or other
naaaatttttttntttttttaccattcccccccnnnnnnnnnnnnaaannnnnnnggggcgggggtgcaaactggagctccaccgcggntggcggcccgctctagaactagtggatcccccgggctgcaggaattcgcacgagaccattacctagaacatcctaatcgaaaaacctagaaaatcctaatcgaaaaaccacacccaaggcagccagtgagccagaaagaagaagaggccattcgtagctgccacgcacgccacgcggaaaccattcgagtccacgaggacgaggagcagcagcagaagaaagggcaaggaacatcctccggtggccgccgccatggccggctgctgcgtgttcctccggggccgtcggcctcgccgtcgcgcatcggctaccgctcctcgtccacacggcgggcgacgacgggccccgccgtcaacggtgaccggcctggtccgggaaagaaccggcgggccttcgggggggccccccccccgggtttggattccctacccggtccggggtgcccctggaaaacgggggcccccaaaggaaggaaaccccagggcccgggggggcgggccccccccccccccgggaaaggcggaaaccccctccccctctctcaa

SEQ ID NO: 55650 - DNA, 654 bp, Zea mays
  misc_feature: Ceres CLONE 1490160
  misc_feature: Encodes the peptide sequence at SEQ ID NO. 55651
  misc_feature (415)..(415): n is a, c, t, g, unknown, or other
ctggagctccccgcggtggcggccgctctagaactagtggatcccccgggctgcaggaattcgcacgagaccattacctagaacatcctaatcgaaaaaattcccttccttcgcctggccgcgaccagtaccacccaccgctcgctctcgctcccaggcctcctgccgcccggcccgcgccgcgccatggaagagccgccgccggggagcagcaaggccgccgcggcgcgcgcgccccgggtggtgggcgtgctggcggggctgctggagcgcgcggcggagcgcggcgacacggcgacgccgacgctggcggactcggcgttccggggccgcgcgctgccggggatccccgtgcggcggtacgcggagcggatataccggtacgccgggtgcagcccggcctgctacgtcgtcncctacgtctacctcgaccgcctcgcgcggggccaatgcgacgccggcgccggcgaggacgaggacgaggacgaggcggcggttgtcggcatcgactcgtacaccgtccaccgcctcctcatcacctccgtcttggtcgccgccaagttcatggacgacaggcaccacaacaacgcctacttcgcgcgggtgggcggcgtggaggtggcggagatgaacgcgctggagctgcgcctcctc

SEQ ID NO: 55651 - protein, 156 aa, Zea mays
  misc_feature: Ceres CLONE 1490160
  misc_feature (17)..(155): Pfam Name: Cyclin Pfam Description: Cyclin
  misc_feature (77)..(77): Xaa is any aa, unknown, or other
MEEPPPGSSKAAAARAPRVVGVLAGLLERAAERGDTATPTLADSAFRGRALPGIPVRRYAERIYRYAGCSPACYVVXYVYLDRLARGQCDAGAGEDEDEDEAAVVGIDSYTVHRLLITSVLVAAKFMDDRHHNNAYFARVGGVEVAEMNALELRLL

SEQ ID NO: 55652 - DNA, 661 bp, Zea mays
  misc_feature: Ceres CLONE 1490161
  misc_feature: Encodes the peptide sequence at SEQ ID NO. 55653
atagctggagctccccgcggtggcggccgctctagaactagtggatcccccgggctgcaggaattcgcacgagaccattacctagaacatcctaatcgaaaaacgcgaccacactcggagagtcggcgaccatcgaaaaaacctctccggtctccgctcccggacaggcggacagcggcaagctggccaccgcgtcaccgcctctactgctctacagccccaggttccactgctaaacgccggtaatggcccaggctccggggcgcgccgcttccgccgtacgtctcttcgacgcgcactgccacctgcaagacccccgcatcgcgtccgtcgcccctgcccttatacgagccgccggcgcatccggcgtcgcacgcttcgctgtcaacggcacctccgagaaggactggcacctggtcaaccacatggccgaggatgacccagccgtcgtcccctgcttcggactgcacccatggtgtgtacccgagaggtcgccagattggatgaatttgctccggcggttcttctccgaaaccccggaggcagctgttggggagattggtctggacaaaggttcacatggaaaaaccatcaacttcggagaacaagttgaagtgttccagcgacaactcgaactagctaaagaattggcgagacctgg

SEQ ID NO: 55653 - protein, 138 aa, Zea mays
  misc_feature: Ceres CLONE 1490161
  misc_feature (15)..(137): Pfam Name: TatD_DNase Pfam Description: TatD related DNase
MAQAPGRAASAVRLFDAHCHLQDPRIASVAPALIRAAGASGVARFAVNGTSEKDWHLVNHMAEDDPAVVPCFGLHPWCVPERSPDWMNLLRRFFSETPEAAVGEIGLDKGSHGKTINFGEQVEVFQRQLELAKELARP

SEQ ID NO: 55654 - DNA, 807 bp, Zea mays
  misc_feature: Ceres CLONE 1490171
  misc_feature: Encodes the peptide sequence at SEQ ID NO. 55655
ttatttgtttgtggggtggggggggatggtgggtggcggggggggggggtggtggccaaagctggactccccgcggtggcggccgctctagaactagtggatcccccgggctgcaggaattcgcacgagaccattacctagaacatcctaatcgaaaaaagcatactattagacataccggtatatattattgttcttagtcatcgcacaagactcttgtcaacaagaccaacaacaggatgaggactgccgtgcatgctgcgctttgcattgtgcttgtgataatgtcttcaacactgtcatcttgtgaggacgatgagaaggtatctatcgcatgtgacacaggatgcaatgccgcgatctcccgtctgaaatgcttcctgatggcctattctgaagggaaagtgttggtcatcagctactgcgaaaatggcgacgatggggcggccggcgtgttccccgccacaagacgggaatggcaacccttattgtcctggcccacggttgggcaacctaaagaagggattattcgaatggccagcaccgtggaattttcgttgggtttggaaataaacattatggcgcgtataggaagttagtttactgggttatctaaagcgaacgaaaaatattcgatgtaaggggtatgtctattcaggggtgaatgagttccccgcgggtggttgatggggttatatgataaacgtgtaaatttggtatttttggcccgccgaaaatagtaaaaatcggtggttacgaattccccacactaaattattcgccgaaaccctttttataataagtggg

SEQ ID NO: 55655 - protein, 46 aa, Zea mays
  misc_feature: Ceres CLONE 1490171
LFVCGVGGDGGWRGGGVVAKAGLPAVAAALELVDPPGCRNSHETIT

SEQ ID NO: 55656 - DNA, 696 bp, Zea mays
  misc_feature: Ceres CLONE 1490200
  misc_feature: Encodes the peptide sequence at SEQ ID NO. 55657
  misc_feature (212)..(212): n is a, c, t, g, unknown, or other
  misc_feature (467)..(467): n is a, c, t, g, unknown, or other
aaagctggagctcaccgcggtggcggccgctctagactagtggatcccccgggctgcaggaattcgcacgagaccattacctagaacatcctaatcgaaaaaatcgagcatcgcagagataggcgtcttcgtactcgcctacctccgcggctcaaacctttcccccttctcccaattccctccgtcggccgccgctccatcccgtacgacgnacaccatgagggagtgcatttcgatccacatcggccaggccggtatccaggtcggaaacgcgtgctgggagctgtactgccttgagcatggcattcaggctgacggtcagatgccccggtgacaagaccattgggggaggtgatgatgctttcaacacctttcttcagtgagactggtgctgggaagcacgtgcccccgtgctggtttttggtgaccttgaaccccactgtcattgaatgaagtggaggactggnaaccttaccggcagctctttccaacctgaaccacttcatccagggggaaaggaggatgcaacccaaaaacctttggggcgggggccccaaaacccattgggcaaaggaaaatggttgaacctattgccctgggagcccattaaagagagggttggcccaaaaaatggaaatgggggcccccggggggtttccctctgtcctttaaaacacttttttggggggaaagaaa

SEQ ID NO: 55657 - protein, 38 aa, Zea mays
  misc_feature: Ceres CLONE 1490200
MRECISIHIGQAGIQVGNACWELYCLEHGIQADGQMPR

SEQ ID NO: 55658 - DNA, 678 bp, Zea mays
  misc_feature: Ceres CLONE 1490208
catagctggagctccccgcggtggcggccgctctagaactagtggatcccccgggctgcaggaattcgcacgagaccattacctagaacatcctaatcgaaaaatcgcacgcactcctcatcttatcccccgcctcctccggtcctcccgccgctgttgctcacttctgagtcccgacgcacgagctcccaagagctagccatggcgtccaccaccctctcctccgccttcaccctcctatcccgcccctccacctccccgtgccccgccgcctcgctcccgaggtcctcccacgccgcgccccacatccgccggggccgccgcgccgtcgccgtcgcgtgcaccgccaccgagtcccccaagatcctggagctcggggacgccatcgccgggctcactctcgaggaggcccgcagtctcgtcgaccaacctccaggagcggctcggcgtcaccgccgcggccttcgcgccggccgccgtcgtcgcggcgccccgggcggtcggcggggccgcgggcgaagaagaggtcccccgtcgagaagacggagttcgaccggatgaaccaagaagggcccaaccaacgcgcgaatccgccacctatcaaaggggggggggcgagcctcaacaagcacttcgcggcttaaggaagggccaaaggaacccttattcgagggggtc

SEQ ID NO: 55659 - DNA, 667 bp, Zea mays
  misc_feature: Ceres CLONE 1490213
  misc_feature: Encodes the peptide sequence at SEQ ID NO. 55660
tccccgcggtggcggccgctctagaactagtggatcccccgggctgcaggaattcgcacgagaccattacctagaacatcctaatcgaaaaccactctctctccaggcaccccgagccgccaaaaccctaccgccgccgcgaatcccgcacgaccccaaccatgaccgtgctgagccgccctaccccgggcacggcccagtgcttcgggcggaagaagaccgccgtcgcggtcgcgtacactaagccggggcgcggcctgatcaaggtgaacggcgtcccgattgagctgatccgaccggagatgctccgcctcaaggccttcgagcccatcctgctggcggggcggtcccggttcaaggacatcgacatgcggatccgcgtccgcggcggcgggaagacgtcgcatatctacaccatccgccaggacgtcgccaaggggctcgtcgcctactaccagaagtacgtcgacgagggccgccaagaaggagatcaaggacatctttacccgcttcgatcgcatccttcctcgtcgctgacccccggcgtctgcgagtcgaagaagtttccgcgggaattggtggcccggcgccagggtttccaaaaatccgttcccgtttaaaccggcttgccctggctcccattcttcaatttttttcaggattccgt

SEQ ID NO: 55660 - protein, 152 aa, Zea mays
  misc_feature: Ceres CLONE 1490213
  misc_feature (16)..(151): Pfam Name: Ribosomal_S9 Pfam Description: Ribosomal protein S9/S16
MTVLSRPTPGTAQCFGRKKTAVAVAYTKPGRGLIKVNGVPIELIRPEMLRLKAFEPILLAGRSRFKDIDMRIRVRGGGKTSHIYTIRQDVAKGLVAYYQKYVDEGRQEGDQGHLYPLRSHPSSSLTPGVCESKKFPRELVARRQGFQKSVPV

SEQ ID NO: 55661 - DNA, 667 bp, Zea mays
  misc_feature: Ceres CLONE 1490218
  misc_feature: Encodes the peptide sequence at SEQ ID NO. 55662
atagctggagctccccgcggtggcggccgctctagaactagtggatcccccgggctgcaggaattcgcacgagaccattacctagaacatcctaatcgaaaaaagatctgctgaaagctaaccgcactggaaaaccgaagcagcaagcgaagccgaggaagataaccacatgtgcccacctcgacgccactcccccgacttgctccgacgacggcgcccccgccgcaggccgtatcgcagctcggcgcccggggaacacgacgcagccgagaagtgctgcgcctgcgcctccgcctgcgcgcgcggggcgtccggttcgacgacggcggcggcgtgcacacggtagacgtagagcagaccggagagctgacgttccacaagcaggtcgggatctagtcgcatgggaccccagatgatgtaccaactgcctaggggcggatgaagctaaattaccatccagacgtgtacggctccggcgacgcggtccagtacacgcgcagcttcatcgaagagcatgaggccgacgagacgctctccgacccaagccgccgctcctgctacgaccgagctctctgcccgcggcgtctgacggctgcccttctcctggggccgttaccaatcgcaagacgtctactacgaccaccaggagcaaggagacagatctggc

SEQ ID NO: 55662 - protein, 76 aa, Zea mays
  misc_feature: Ceres CLONE 1490218
MKLNYHPDVYGSGDAVQYTRSFIEEHEADETLSDPSRRSCYDRALCPRRLTAALLLGPLPIARRLLRPPGARRQIW

SEQ ID NO: 55663 - DNA, 679 bp, Zea mays
  misc_feature: Ceres CLONE 1490222
  misc_feature: Encodes the peptide sequence at SEQ ID NO. 55664
atagctggagctccccgcggtggcggccgctctagaactagtggatcccccgggctgcaggaattcgcacgagaccattacctagaacatcctaatcgaaaagtttgttagaggtacgccgattcgaaccatccagtctccgtgtccagtcgagtctcagcaaggaagatgtgggggaaaggaaagaagcgtttcggcggtggcggcagcggtgagcccgcggccaagcgccaggccgcgagggacgatggcccctccgaatccgctgaagacggtaccgtcgtagccgagatatcgaagaacaagaaggtgtccgttaggagctggaaaggcagggtcttcgtcgacttacgcgagttctacttcaaggacggcaagactctccccacccggcaaagtatatccctccaattagatcaccggaagattctggaagacaacctcaacccttaatgagggcatccgaaaaaatcctgatggggaccccccaagagttcccgtgacgggggaactttttgccctttccctgtttaaggcctgattacaggaaaattttttgttgcccaattgcggcccggggtgtttttcccatttaaacccctcgtttgtttggggcccctaggcccaaaagtttggtttctcccccccgcccctttataaatttaaaaccgggaggggg

SEQ ID NO: 55664 - protein, 94 aa, Zea mays
  misc_feature: Ceres CLONE 1490222
  misc_feature (1)..(92): Pfam Name: PC4 Pfam Description: Transcriptional Coactivator p15 (PC4)
MWGKGKKRFGGGGSGEPAAKRQAARDDGPSESAEDGTVVAEISKNKKVSVRSWKGRVFVDLREFYFKDGKTLPTRQSISLQLDHRKILEDNLNP

SEQ ID NO: 55665 - DNA, 706 bp, Zea mays
  misc_feature: Ceres CLONE 1490223
  misc_feature (431)..(431): n is a, c, t, g, unknown, or other
  misc_feature (706)..(706): n is a, c, t, g, unknown, or other
atagctggagctcaccgcggtggcggccgctctagaactagtggatcccccgggctgcaggaattcgcacgagaccattacctagaacatcctaatcgaaaagtcttggatgcccttgcgctcctcttctctctcgccgccccgagacccccacgcttccctctccgcccccgaactgtggcgcctccccccgccgccgcagcgatgccactcgcggcagagcccgacgaccctcttgaggaaagggagaatcatcagctgccaagcccgactaagggagggcccgggcctgagggagtggtggcagtgagcttgtgcctcgatgaggtagtgcagggcgggggcaaagagtgggagaatcgcctaggtgctcaagtccctcgaaaccaacgtgcgcgagaccccaccagaccaagactacgcatccaatnaataggaacacttcatttgggaggtgcatgaaggatctcctcttcaactggttacgcttcgcaagcgtccatgccgcaagcggcctatgctctgccagacgcgtactccctgcccccaagggcctctaccaaaaatccaacaacactgtgaaacattccccccaccagagagatcccggcggggagcgcccgctgcccttgaggagttattggcctccgggagctgtcccccctggaagaattgccccataagcggttcgccccatttcaaggtn

SEQ ID NO: 55666 - DNA, 752 bp, Zea mays
  misc_feature: Ceres CLONE 1490226
  misc_feature: Encodes the peptide sequence at SEQ ID NO. 55667
  misc_feature (1)..(1): n is a, c, t, g, unknown, or other
  misc_feature (21)..(21): n is a, c, t, g, unknown, or other
  misc_feature (37)..(37): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
ngggggtggggggccgcgccnctcgcctgtggcgaanannnnnnnntgagggtaaacaccaaactgggactccccgcggtggcggccgctctatttctagtggatcccccgggctgcaggaattcgcacgagaccattacctagaacatcctaatcgaaaatcgcacgagaccattacctagaacatcctaatcgaaaaatctaaatcaaagtccaagtccaagtccaagaaggacaaatcaaagcctgatgctccaaaccaagagaacctcttcccagagctcattgctgagccaactgacgctcgctcgatgtcctttgttggcactcatgagtacctggccccagaaatgataaaaggggagggccatggaagggctggggattgggggacctttggcatatgcttgaacgagctggttggttgggaagaacacattcaaagggccacgcaaccgggctacactgttctacaaaacccccccggggggtgagggtcccagagggcgcccaagagtgtactcctctgcgagggacacgaaaaggacattgccaggcaaggacccggcctacccgactggtgcatgagcgggggtgcgcccgaggatgagcgagcaccgcttgggttcgaaggcgggggagggggcgtgcgggtaagagggggggaaggcgcctggggaagaatagcagaaacgcctgctcgcggaccaaatatggcatccccatagagcaaggtggccgtgtgcgcgcag

SEQ ID NO: 55667 - protein, 60 aa, Zea mays
  misc_feature: Ceres CLONE 1490226
  misc_feature: SWISSPROT Homolog: EC 2.7.11.1 Non-specific serine/threonine protein kinase
MSFVGTHEYLAPEMIKGEGHGRAGDWGTFGICLNELVGWEEHIQRATQPGYTVLQNPPGG

SEQ ID NO: 55668 - DNA, 662 bp, Zea mays
  misc_feature: Ceres CLONE 1490235
  misc_feature: Encodes the peptide sequence at SEQ ID NO. 55669
atagctggagctccccgcggtggcggccgctctagactagtggatcccccgggctgcaggaattcgcacgagaccattacctagaacatcctaatcgaaaatctacggtgttctgaaccagaagagaggtcatgtctttgaggagatgcagaggccgggtaccccgctctacaacatcaaggctttcctccctgtcatcgagtcctttggtttctccagccaactgagggccgcaacctctggtcaggcgttcccccagtgtgtctttgaccattgggacatgatgggctcagatcctttggaggccggctcccaagctgctcagctggtgctggatatccccaagaggaagggtctcagggaacaaaatacccccccctttcggagtttgaggacaaaccccctaaaattttttggccggctggtagaaactgtttccctcccggccggtttaaaccatcaatttccccccccgggaaatacccgccaaacttcaaaatatttttattttggttttaaagtgggcaaaaagcacccccgttttttaaaaaaaattttttgaaattgtaaggcccccccccccccccttaagggtcttaaaaaatttttttgtttccccgcgcggaaaaggttcccaagagaaaaaaaaaatttggtttctt

SEQ ID NO: 55669 - protein, 138 aa, Zea mays
  misc_feature: Ceres CLONE 1490235
  misc_feature (2)..(54): Pfam Name: EFG_C Pfam Description: Elongation factor G C-terminus
MQRPGTPLYNIKAFLPVIESFGFSSQLRAATSGQAFPQCVFDHWDMMGSDPLEAGSQAAQLVLDIPKRKGLREQNTPPFRSLRTNPLKFFGRLVETVSLPAGLNHQFPPPGNTRQTSKYFYFGFKVGKKHPRFLKKIF

SEQ ID NO: 55670 - DNA, 695 bp, Zea mays
  misc_feature: Ceres CLONE 1490239
  misc_feature: Encodes the peptide sequence at SEQ ID NO. 55671
tcccccgggctgcaggaattcgcacgagaccattacctagaacatcctaatcgaaaactctctgtcgcatttcccgtcctgtccttcccttacccggcggcttaaaccctagttctcactcccatcgccgcttcagctccgccgcagcagatggagttctggggtctcaaggtcaagcctggttccactgttaagtgtgagcctggatatggctttgtgctgcacctttcccaagctgctcttggggaatcgaacaagagtgataattgccttgatgtatggtcaaaattgatgatcagaaaacttgccattggaaacccttctctgtttaccaaaaacctcactcatttctgattttgggcctgggtttttctattaaattagttatccaccttggtgggggctttttttataaaatttacccaatcgaggaggggctttatactgggtttaccctaggttttgtaagccagccctgtttccggaggtaagaatgataatttgggcttcttttgtattcctcgaaaaaaagaaaacatcatatagaatgcgtgggattgtttccctctttacttctacagggaaaattgggccctagattcttaattgggatatataacacggataaatatctaagagataaggggcgattttcgcggtgtaatccatacaacaaattaaatatccgtgttatg

SEQ ID NO: 55671 - protein, 67 aa, Zea mays
  misc_feature: Ceres CLONE 1490239
MEFWGLKVKPGSTVKCEPGYGFVLHLSQAALGESNKSDNCLDVWSKLMIRKLAIGNPSLFTKNLTHF

SEQ ID NO: 55672 - DNA, 710 bp, Zea mays
  misc_feature: Ceres CLONE 1490242
  misc_feature: Encodes the peptide sequence at SEQ ID NO. 55673
aaagctggagctccccgcggtggcggccgctctagaactagtggatcccccgggctgcaggaattcgcacgagaccattacctagaacatcctaatcgaaaaaagcctcgagccagtgtggtgtggggtcgcgtgctctcttctatcttgctctgctagtgccaggattccgccctatccatcccatcaacctcagctaaggtccccagcggcggcgaggccatggcagctcctgtgacggtgtacggaccgatgctctcaccagctgtagcccgcgtggcggcctgcctcctggagaaagacgtgccactccagatggagacgggggacatgtcaaagggcgagcactagtcgaccgtcctatcctaaaactccaaccccttaggacagggctcctgccatacaaagaaccacctcacaaccccccttatgagtagaagggcctaatctgccggatacaaaccgcaaaccaggaaagcaaaaaatctgggtaaaaaaaggcccctaacttcggcaaagaaattaaataaagacgcagacttgagcacaaaacagccaggggtaaaagttcgcaaaatatgtcataaaaacgcctaaaaacgtgtaaaaccgcgaaataataggccaatttaaaatgccatgtttaaaaacctggcaccgggtgtaaagtgacctgaaacccataaacacataacttatgcattaaaaca

SEQ ID NO: 55673 - protein, 42 aa, Zea mays
  misc_feature: Ceres CLONE 1490242
  misc_feature: SWISSPROT Homolog: EC 2.5.1.18 Glutathione transferase
MAAPVTVYGPMLSPAVARVAACLLEKDVPLQMETGDMSKGEH

SEQ ID NO: 55674 - DNA, 646 bp, Zea mays
  misc_feature: Ceres CLONE 1490244
  misc_feature: Encodes the peptide sequence at SEQ ID NO. 55675
  misc_feature (33)..(33): n is a, c, t, g, unknown, or other
aaagctggagctccccgcggtggcggccgctcnataactagtggatcccccgggctgcaggaattcgcacgagaccattacctagaacatcctaatcgaaaagcaccagatatgctccctccaccaagcccccgactccccgaggccccgacctgcgcacccacgggatccctacctatccggccgtcacccctccccctgcccctcccgagttggattgttcgcggaattggcggaggggcagccggatatgtcgtcgtcggttgggggcggcagcgcgggcggcggcggagtggacatggtcagcctgctggagaaggccaaggatttggaccagctaaagaaggaacaggacgaaatcgttgccgatatcaacaagattcacaagaagctcctcgcatccccagagatggttgataaaccagttgacaccattttgctcaagcttcgtggtttatatgcacgtgcaaaggagctctctgagaatgaaatcagtgcctcaaatgctttgattggattattagatggtttgttgcaatctggagcttcaactgcacaaaagaaaaagatagaagttggtgagcagaaaaagaagaggatcaagtctgatacagattctgcacgattttctgctgcttctatgagg

SEQ ID NO: 55675 - protein, 132 aa, Zea mays
  misc_feature: Ceres CLONE 1490244
MSSSVGGGSAGGGGVDMVSLLEKAKDLDQLKKEQDEIVADINKIHKKLLASPEMVDKPVDTILLKLRGLYARAKELSENEISASNALIGLLDGLLQSGASTAQKKKIEVGEQKKKRIKSDTDSARFSAASMR

SEQ ID NO: 55676 - DNA, 675 bp, Zea mays
  misc_feature: Ceres CLONE 1490251
  misc_feature: Encodes the peptide sequence at SEQ ID NO. 55677
aaagctggagctccccgcggtggcggccgctctagaactagtggatcccccgggctgcaggaattcgcacgagaccattacctagaacatcctaatcgaaaagccactccgccgctcctctccgcttccaagatgtcgaagcgaggacgtggaggttctgctggtaacaagttccggatgtcactgggtctaccagtggcagccactgtgaactgtgctgataacactggagccaagaacctttacatcatttctgtgaagggaatcaaggggcgccttaacaggcttccttctgcctgtgttggtgacatggttatggcaactgtgaagaagggaaagcctgaccttaggaagaaggtgatgccagctgtcattgtgaggcagcgcaagccatggcgcccaaaggatggtgtctacatggtactttgaaacaatgctggagtgattgtgaacccaaagggagagatgaaaggctctgccatcactggacccatcggaaaggagtgtgctgatctggggcctaggattgccagccccgcaaatgcgattggctagggggaatcacgttgatcgaaatttaccttcaaataacattttgtttggtgtttcggaattggggaagagagtttttatagttggacgaagctttttggattgggccttaaaagaattttt

SEQ ID NO: 55677 - protein, 98 aa, Zea mays
  misc_feature: Ceres CLONE 1490251
  misc_feature (19)..(98): Pfam Name: Ribosomal_L14 Pfam Description: Ribosomal protein L14p/L23e
MSKRGRGGSAGNKFRMSLGLPVAATVNCADNTGAKNLYIISVKGIKGRLNRLPSACVGDMVMATVKKGKPDLRKKVMPAVIVRQRKPWRPKDGVYMVL

SEQ ID NO: 55678 - DNA, 663 bp, Zea mays
  misc_feature: Ceres CLONE 1490253
  misc_feature: Encodes the peptide sequence at SEQ ID NO. 55679
aaagctggagctccccgcggtggcggccgctctagaactagtggatcccccgggctgcaggaattcgcacgagaccattacctagaacatcctaatcgaaaaaaacgcacgcaaacgctgtcacagtttgtcacggcagcggcaagtcggcaacgctgccgcggcacgtctcctccctctcttttccggttcgggtagtcgggtgtaccgccattcgtgatcgaaccacactcgagagggagaggaggagggagtccgaggggagagacccaattagctgcagggattggtcgggttcggctccgccttcggagagtcccaagagatgggtggcgcggcggcgggtaccaagtggatccaccacatccagcgcctcagcgcggccaaggtgtcggcggaggcggtggagcggggccagaaccacatcatcgacgcctccctcaccctaattcgcgagcgcgcaaagctcaaggcagagttgctgcgtgctctgggtggcgtgaaagcttcagcgtcactcttaggggtccctattggtcacaactcatcctttttttacaggccctgcattttgctcctccacgcatacggggaagccattttggcgtgggaaccacaaatctcttagcccagaaggaaggcaaagaaattgaatgtaccctc

SEQ ID NO: 55679 - protein, 100 aa, Zea mays
  misc_feature: Ceres CLONE 1490253
  misc_feature: SWISSPROT Homolog: EC 3.5.3.1 Arginase
MGGAAAGTKWIHHIQRLSAAKVSAEAVERGQNHIIDASLTLIRERAKLKAELLRALGGVKASASLLGVPIGHNSSFFYRPCILLLHAYGEAILAWEPQIS

SEQ ID NO: 55680 - DNA, 637 bp, Zea mays
  misc_feature: Ceres CLONE 1490259
  misc_feature: Encodes the peptide sequence at SEQ ID NO. 55681
aaagctggagctccccgcggtggcggccgctctagaactagtggatcccccgggctgcaggaattcgcacgagaccattacctagaacatcctaatcgaaaaaattcccctctgttcccctcccaagaaaccccacatttgcatgggcaagcacctacctgccgccgccaccgccgccgccgccgccgcggttcgctcgtacgcccgcagccttcgcgtcccatccgataccgccgcatccgccgggagggcagataagacgccgtctgccccgctggatacgcccaggaaatccgctgccgccgctgccgcggccagctccgggcgggccgaggtgcgggatttggcggcggcgtgcgggctagaggcggacgagagggttccgctcgcggaggtggtgtcggactgcacgaggcggtggttccaggacgcactccaggaggcgcgcgccggcgacatcaccatggaggtgctcgtcggccagatgtcccgcagcgggaacggtggcaacaagaaccagcaccaggcaagaattttggatggaaaaaggcctcaagatttccggcctacagtatgggaaagtaaccaataaccgccccggggacaatggccaggggaccccggaccccgggcccaa

SEQ ID NO: 55681 - protein, 149 aa, Zea mays
  misc_feature: Ceres CLONE 1490259
MGKHLPAAATAAAAAAVRSYARSLRVPSDTAASAGRADKTPSAPLDTPRKSAAAAAAASSGRAEVRDLAAACGLEADERVPLAEVVSDCTRRWFQDALQEARAGDITMEVLVGQMSRSGNGGNKNQHQARILDGKRPQDFRPTVWESNQ

SEQ ID NO: 55682 - DNA, 669 bp, Zea mays
  misc_feature: Ceres CLONE 1490260
  misc_feature: Encodes the peptide sequence at SEQ ID NO. 55683
atagctggagctccccgcggtggcggccgctctagaactagtggatcccccgggctgcaggaattcgcacgagaccattacctagaacatcctaatcgaaaaatcgccgtgctccgtcgtcgtctccgcccccagagtgatggagcccactgaccactgtacctggcccccgagcctcagctcgtgagcccggcaccgcgcctcgacatggccatggtgcagccggcggacaccgccgtcaaggccaacgagatcctggcgcggttccggtccttcgcgcccaagacaacaatggcagcaaccgccacagcggccgccgctgcgcccgcggtgcatgccgcggccgatggcctcctgcccgcgaagcgcgtgctctgacatctgcagagaaggccgtgccgcgcgcgctagagcggcccccccaccgtcgtgccaatgtcgccgacggcgggcgcacatacgcccgcaaagcggagaagagcctctacaccgtaccagcctctccggtgcgtggcggcgaccacgaggacgcatgcgaccccgctcgctccgggcagtgcccgtctcccaccggcgaagtgcgggggccaaatacatccccaaggcatcggataccgtcgatctcgtaggggggccgcgggacccattatccccctatgatgaggaccc

SEQ ID NO: 55683 - protein, 56 aa, Zea mays
  misc_feature: Ceres CLONE 1490260
MAMVQPADTAVKANEILARFRSFAPKTTMAATATAAAAAPAVHAAADGLLPAKRVL

SEQ ID NO: 55684 - DNA, 656 bp, Zea mays
  misc_feature: Ceres CLONE 1490263
  misc_feature: Encodes the peptide sequence at SEQ ID NO. 55685
ctggagctccccgcggtggcggccgctctagaactagtggatcccccgggctgcaggaattcgcacgagaccattacctagaacatcctaatcgaaaagattgcttgagcccatcggacggccgcgtggctcccaggagccctatatcaccatccttgcccaccgcctcccctcatcaccagcgtccgccaccgccgccgcctttcgtaccgcggcccctaaacccctttcctcgttcccctccgtctctcagttaggcacaatgatgctagctaataagcttggtggtctgctcaagaatgctacgagttcaaatatgtctgtctaccaagcaatcagatgcatgtcatcatccaagctttttgttggagggctttcttatggaaccgatgatcacagtctcagagacgagtttgccaaatatggacaagttattgaagctaagattatccttgatcgtgagtctgggaggtccagaggttttggctttataacttacacgtcttctgaggaggcttcggctgccatcactgccatggatggaaagactctggatggacggaacatacgggttaatcatgctaacgagaggacaggtggcttccgcagcagcggtggttatggtggtggcggctatggtggtggtggtggtggct

SEQ ID NO: 55685 - protein, 131 aa, Zea mays
  misc_feature: Ceres CLONE 1490263
  misc_feature (33)..(104): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MMLANKLGGLLKNATSSNMSVYQAIRCMSSSKLFVGGLSYGTDDHSLRDEFAKYGQVIEAKIILDRESGRSRGFGFITYTSSEEASAAITAMDGKTLDGRNIRVNHANERTGGFRSSGGYGGGGYGGGGGG

SEQ ID NO: 55686 - DNA, 710 bp, Zea mays
  misc_feature: Ceres CLONE 1490266
caaagctggagctcaccgcggtggcggccgctctagaactagtggatcccccgggctgcaggaattcgcacgagaccattacctagaacatcctaatcgaaaaattcccacccgtccatccatcctccgaagctcctcggcagacaagcagcagcgagagaaagcaagcaaggcagaggcagttgtgttgctggtcggtccgtccatggcagcccaagagaccagtgttcggtctgcggcgggcggcggagcagccgaaggttgcgctggcgttgcgtaaaccgggcgtggggggcccggtcactcccaggggggggttttaatattttccccctgctcaacccccgcgtgttatgtttttgctcgtacggtgggataggtgtgcccagagggcggtggcctggtggaggagcggtgggcgggacgtcgaagagacgggacgtggttcgtggcggggagagtggtcggacgacgggttgtggtagcgttttgggaggcggaagcagggtaggaataagtgggggacgttgcggggtggggggggtgcgggggtggggggaggcgagatgattctgagtgcccggtgtcgggccgctggggggcgtcggcttgtcgtgggtccgcggtcctgggtggttgtatatgtgttgtgggggattcgtatgttgttggacgcgagccgtggtaactttgcgcgcggggggggggcg

SEQ ID NO: 55687 - DNA, 661 bp, Zea mays
  misc_feature: Ceres CLONE 1490269
  misc_feature: Encodes the peptide sequence at SEQ ID NO. 55688
aaagctggagctccccgcggtggcggccgctcttcaactagtggatcccccgggctgcaggaattcgcacgagaccattacctagaacatcctaatcgaaaaagtcagacccgagcttgatcgacaccagttgagctacacccgatgcgactctacttcagattatcttgttctctgactgctgatccactcttgtcattgtgtttgagccagtttagtgctactccttcctacctgggagatggcatccaaccaggaccaggcgagcttccgcgccggcgaggccgacgtccacacccccgacaacgctggacaggtgatgggcgcagtcaaggtcaaggcgtacgaggactaggaccgtgctgcggacctggcggggcacgagtccgggcgcgggcaatgtgccacggaggacaccaaccacaacgtcggtgtactcactgacagggcgttccacacagctcatgtcactccagacaggactgccagggcggagaatcgtcgagcttgttctcaccgacgaaaccgccctcgatgccattgataaggccagccggctactactcacgcggtcaactgaccgctccggccagtgcgaaggaccacatgcggctgcttccctcaagagaaaatacgtgagattgccaaattctaaggcggg

SEQ ID NO: 55688 - protein, 37 aa, Zea mays
  misc_feature: Ceres CLONE 1490269
MASNQDQASFRAGEADVHTPDNAGQVMGAVKVKAYED

SEQ ID NO: 55689 - DNA, 661 bp, Zea mays
  misc_feature: Ceres CLONE 1490271
  misc_feature: Translation starting site: 198
  misc_feature: SWISSPROT Homolog: EC 5.2.1.8 Peptidylprolyl isomerase
aaagctggagctccccgcggtggcggccgctctagaactagtggatcccccgggctgcaggaattcgcacgagaccattacctagaacatcctaatcgaaaagaagacagcagaaccgcagaagtgcagcagaacgatcggatctagcagaattctctcaacctcatcggcggcggcgaagagcgtgcggatcggagatggcgacaagcgggtggaggaggagagcggcggcgcgggcctcctggcgccccgccacggtgtacctgtggctcgcgctcgccgcagcagcactgacgctcgcccaggctaagaaggacctaacggaggttacccacaaggtctacttcgatgtcgagattgacggcaagcccgcaggtcggattgtcatggggctttttgggaagactgttcctaagacagcagagaacttccgagctctttgcacaggagagaaaggaattggcaagagtggcaaagctctccactacaagggaagtacattccacagaatcattcccagcttcatgctccaaggaggtgacttcactcttggggatggggaggggtggtgaatctatctatggcatgaagtttgctgatgagaacttcaagatcaagcacactggaccaggccttctgtccatggccaatgctggtagag

SEQ ID NO: 55690 - DNA, 569 bp, Zea mays
  misc_feature: Ceres CLONE 1490276
aaagctggagctccccgcggtggcggccgctctagaactagtggatcccccgggctgcaggaattcgcacgagaccattacctagaacatcctaatcgaaaactcgctcggcaccgcaaacaaacagaatccacaagggaggcagaggcagacccgacccgaatcaccgccgtcgtcgtcgttgagaagagacaaagtggaggagtaggccatgtccaacgtgcccacctccctccgcgattcctccctcaccgtcttccgcctcgccatctccagctccgacccctggcccttctcttcctgcctgtaaccaccatcagcccccgggcggccggcttcttcgtcctccgtcctgatcgagcaacaccacaagcaagcaaaagaacacgagctccttcctggtgacatcatgcccgcaagcattattcttctcagaaacagcagcagctggcggcgggtggcgccaaggggggcgtgaacggccccctggggcctggaagggccaggaaaaaaccccgggtttcccggccccgctggggcccccttaagggacccgtttttttgggggg

SEQ ID NO: 55691 - DNA, 664 bp, Zea mays
  misc_feature: Ceres CLONE 1490281
  misc_feature: Encodes the peptide sequence at SEQ ID NO. 55692
aaagctggagctccccgcggtggcggccgctctagaactagtggatcccccgggctgcaggaattcgcacgagaccattacctagaacatcctagtcgaaaaacggcgcacacgcgcaacttctctgcgcgacgccagccccgcttctccccacggcgcgccgccatccccgcgcaccttcctgcgcgccgccagccccgcgcttccctgcgcgccgccagccgtcagcccgcacctgcgcgccgccagcccgtcaccgcttggagacgcgcgcagccgcgcttccctgcgcaccgccactccagccgacagccgcgcttccgtggccgcgtccaccgccgccagctctgtggtcgcgccgtcagccaacccatctgccgtcgtgaggtactgaggttgcctatattttcttccccttcttgaaaatggatcatagttctgacgaagatacagaaatcagtgattctgagattgatgattatgaaggaaaaatttatgcaagactgatgtcaggagatttaaaattaaataagaatggagaaaattacatttgtcccttctgtagcagcaagaagaagaatcacagtaaaagtagcctggttcaacatgcctcaggagtcagtgcagcacctaatcgggaagcaaaagaaaagcagtccatcgc

SEQ ID NO: 55692 - protein, 79 aa, Zea mays
  misc_feature: Ceres CLONE 1490281
  misc_feature (43)..(79): Pfam Name: zf-XS Pfam Description: XS zinc finger domain
MDHSSDEDTEISDSEIDDYEGKIYARLMSGDLKLNKNGENYICPFCSSKKKNHSKSSLVQHASGVSAAPNREAKEKQSI

SEQ ID NO: 55693 - DNA, 635 bp, Zea mays
  misc_feature: Ceres CLONE 1490293
  misc_feature: Encodes the peptide sequence at SEQ ID NO. 55694
  misc_feature (635)..(635): n is a, c, t, g, unknown, or other
tggagctccccgcggtggcggccgctctagaactagtggatcccccgggctgcaggaattcgcacgagaccattacctagaacatcctaatcgaaaaaaaatcgaccttgtcgacccggatccgagctaggcacccgcacgaccacccgcctcctgccggtcaccgggacctagcatcgccgggcggcggcgggggaggggaaggtaggcgatgaggaaacgtgagcgggagaacccgtgcgggatctgcgggcactaccacaagtacgaggagggggaggtatgcggggtgtgcggccaccgctggaaaccgtcggacggggagggcgccccgtcgaggcacgagtccgccttccccacagaggtgctcaaggactttctcttcctcgggagctacaacaacgctcacgctccgaagtcctcagaacgctcagtatctccacccatcttaaaactggccctaatggccacatcctggacaaaaatcctttccattttcaaagtcttccacggggaaaggccctttggattttttataggcgaaacccattttctaagaaatgggaaaaaaaaaaatccggggtccttggtctcttgcagaaggggaaaaaaaaaggtcctccccaattttttgn

SEQ ID NO: 55694 - protein, 141 aa, Zea mays
  misc_feature: Ceres CLONE 1490293
MRKRERENPCGICGHYHKYEEGEVCGVCGHRWKPSDGEGAPSRHESAFPTEVLKDFLFLGSYNNAHAPKSSERSVSPPILKLALMATSWTKILSIFKVFHGERPFGFFIGETHFLRNGKKKNPGSLVSCRRGKKKVLPNFL

SEQ ID NO: 55695 - DNA, 648 bp, Zea mays
  misc_feature: Ceres CLONE 1490311
  misc_feature: Encodes the peptide sequence at SEQ ID NO. 55696
  misc_feature (497)..(497): n is a, c, t, g, unknown, or other
aaagctggagctccccgcggtggcggccgctctagaactagtggatcccccgggctgcaggaattcgcacgagaccattacctagaacatccaatcgaaaagtgattgattctctcctgctccttctttcttccatctctcctgtctctcttctctctctctctctctgtctgtctgtctggcaaaggccactgacggccgcggcggtgtcgatggagtggtggcagaaggcggtggtggtgccggtgaagcgcgcgtggatcgccgccgccgcccggctgacgacgcgccataagaaagaagacggcggccacggcgtcctggtgaagctccacgacgacgtccagacgtgcgcgtacgaggacgtgcaggtgatgtgggagatgctgcagcgggccgagacggagaggctggcacgcgagccctcgccaaagggcgcccgcgcgctcgtctggctgcgccgccaccacaagatggaccccgcgccggcgctgctngagaggacgacgactacgacaccctgatgcttttccttcctcctgctgcccccttcggctttgcttaccagctgccaccctgtgcaaccttgccctgggatgcgagagccgctccatctgcgctgggggtacaaattacctgccacatacg

SEQ ID NO: 55696 - protein, 103 aa, Zea mays
  misc_feature: Ceres CLONE 1490311
MEWWQKAVVVPVKRAWIAAAARLTTRHKKEDGGHGVLVKLHDDVQTCAYEDVQVMWEMLQRAETERLAREPSPKGARALVWLRRHHKMDPAPALLERTTTTTP

SEQ ID NO: 55697 - DNA, 698 bp, Zea mays
  misc_feature: Ceres CLONE 1490312
  misc_feature: Encodes the peptide sequence at SEQ ID NO. 55698
atagctggagctccccgcggtggcggccgctctagaactagtggatcccttgggctgcaggaattcgcacgagaccattacctagaacatcctaatcgaaaaataccccgccagccgccatcccctccgaccaaaccctagccggccatggcgtggcgtggccccgcctcccgggccgtccttgccgccgtccgccgcccagccgcagcgcccgcggccgcacgcctccacgccccgcgacctttcgcggccccgcgccgccgcgtcccgtccgccttcgccacctcctcgctcccgtccgcgcggcctctggcggcgatgatggggtccccggtgacggtggccgcggtgatggcgcgtctcacggcgcaccccggtgccagcgcgcgggcgtgctgcgagctctcccagggtacttgaagctgctgtgtagatcccatccttttcgaaaggataaaaggtgtcttttttttttggggggggggggggggggggggggaccggctgcaacagccgttctatgagcaccagggtggatgaatatactcaagcggacgtacgaatctaatataatgtatgaagagaatactaaataaaatgttcgaatggttgtgtttctagtgttttacacttcatgttctctcttctgtcgcgtcgtgcctatactttggtcctatgcactaggttcgtaatcaacg

SEQ ID NO: 55698 - protein, 33 aa, Zea mays
  misc_feature: Ceres CLONE 1490312
MMGSPVTVAAVMARLTAHPGASARACCELSQGT

SEQ ID NO: 55699 - DNA, 659 bp, Zea mays
  misc_feature: Ceres CLONE 1490348
  misc_feature: Encodes the peptide sequence at SEQ ID NO. 55700
  misc_feature (535)..(535): n is a, c, t, g, unknown, or other
caaagctggagctccccgcggtggcggccgctctagaactagtggatcccccgggctgcaggaattcgcacgagaccattacctagaacatcctaatcgaaaagactgtgagcttcgttcgttcagttcatccgtgttcttgtttgctaggtctagagagagagatgtcgtgctgcggaggcaactgtgggtgcggctccggctgccagtgcggcaacggctgcggagggtgcagcaagatgtacccagacatggctgagcaggtgaccaccaccacccaggctctcatcatgggtgtcgcaccatccaaggggcacgccgagggcgggttcgaggcggccgccggatctgagaacggcgggtgcaaatgcggcagctactgccagtgcgacccctgcaactgcggcaagtgagctaggtgctccaccctgtacgccggccggaggaagctagctaattattataagctacataaagtatagctgcgtcgctgtgtgtgtctcgagtcctcagtcagctaattgcatgccatggnctgcatcgctctgaatctgaaaagatgattaatgcttaatgccaggcttcggggcctggaaacttccccgcccccttggggagtttttgaagtaaaaaaatggttttttttttttttttttggg

SEQ ID NO: 55700 - protein, 82 aa, Zea mays
  misc_feature: Ceres CLONE 1490348
  misc_feature (1)..(80): Pfam Name: Metallothio_2 Pfam Description: Metallothionein
MSCCGGNCGCGSGCQCGNGCGGCSKMYPDMAEQVTTTTQALIMGVAPSKGHAEGGFEAAAGSENGGCKCGSYCQCDPCNCGK

SEQ ID NO: 55701 - DNA, 498 bp, Zea mays
  misc_feature: Ceres CLONE 1490354
aaagctggagctccccgcggtggcggccgctctagaactagtggatcccccgggctgcaggaattcgcacgagaccattacctagaacatcctaatcgaaaaatcagaaaccgatccttgtccctagcagcgcgcgacacgcacgtacccagcgcgcgagaaatcttacatcgatcatcacctgcgagccagccgggccgagcagcaacgatgggcgcgtacatgcgcgtgacccccccccccccaaggaaaggcaaaaaggtgaccgaaaaaaagcgggtccccgaaaaccgggccccgggaacggccaaaaacctttagggcgccaaatttggggggaaaaagggggccccccccccctttttaaaggggcccccccggaaaaaccccccccgggggggggggtatttgggccccccccccccccaattggggggggggggggaaaaaaccccctggggggggggccccccccaatttttttttaaaaaaaaaccc

SEQ ID NO: 55702 - DNA, 433 bp, Zea mays
  misc_feature: Ceres CLONE 1490355
  misc_feature: Encodes the peptide sequence at SEQ ID NO. 55703
  misc_feature (263)..(263): n is a, c, t, g, unknown, or other
aagctggagctccccgcggtggcggccgctctagaactagtggatcccccgggctgcaggaattcgcacgagaccattacctagaacatcataatcgaaaaattctcatcacactcgatcgcagtttgcagaaagctagaagacacaagaacatggcgtccaagcgactcctcgtgctagtagctctcctgctcgccgccgttttccttgcgtctcagggagcagctaacgacgaccaggcccaaaccgaggaaaagacaacngcgggcaaaaaacaaaacgcccaagtggcaggaaattcccttggcccccccccccccctttggccccaaatggggggggggggttcaccccccgggcccggggggttccaccggggggggggggggggtaccccctttgggggggccccccccgggttttttttaggagg

SEQ ID NO: 55703 - protein, 93 aa, Zea mays
  misc_feature: Ceres CLONE 1490355
  misc_feature (1)..(87): Pfam Name: GRP Pfam Description: Glycine rich protein family
MASKRLLVLVALLLAAVFLASQGAANDDQAQTEEKTTAGKKQNAQVAGNSLGPPPPLWPQMGGGGSPPGPGGFHRGGGGGTPFGGAPPGFFLG

SEQ ID NO: 55704 - DNA, 537 bp, Zea mays
  misc_feature: Ceres CLONE 1490356
  misc_feature: Encodes the peptide sequence at SEQ ID NO. 55705
  misc_feature (221)..(221): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (475)..(475): n is a, c, t, g, unknown, or other
aaagctggagctccccgcggtggcggccgctctagaactagtggatcccccgggctgcaggaattcgcacgagaccattacctagaacatcctaatcgaaaaatgcgcgttgcccccgcgacccgaaccgccgccgccgctcaccctccgagcgccttcctgctcctcctcggttgcgcgtccctcgcgatcggaggagcagccatggccggccacgtccntcggcgggcgtgaaaggagaaacccagcccgcgggccaaaaagcggcccaaaaccccaaagggggtttggggccgctttttccccctttaaaaaaaaaaacaaaaaaggggggccaaaaaaaaaaccccctccttcggggggaaatctccccccccccccccctggggggggggggccccccccagagaaacccggaggggggggggggggtgnnnaaagaaatttttttttttaacccccccccccccccccntttccttgttgtggggggggggggggcccccttaccaaaaaggaggggccccccccaaaaaa

SEQ ID NO: 55705 - protein, 43 aa, Zea mays
  misc_feature: Ceres CLONE 1490356
  misc_feature (40)..(40): Xaa is any aa, unknown, or other
MRVAPATRTAAAAHPPSAFLLLLGCASLAIGGAAMAGHVXRRA

SEQ ID NO: 55706 - DNA, 705 bp, Zea mays
  misc_feature: Ceres CLONE 1490367
  misc_feature: Encodes the peptide sequence at SEQ ID NO. 55707
  misc_feature (705)..(705): n is a, c, t, g, unknown, or other
atagctggagctccccgcggtggcggccgctctagaactagtggatcccccgggctgcaggaattctcacgagaccattacctataacatcctaatcgaaaactctcgtgtcgtctcttaagctataacacggcaagactatgctgccgctgaaagttcgccgccgccacggcgtgctcgattagacggactgctgctccaccgattctcatcctactcgtcctcttctgtctattctgtccacctccacgcctcatctgctctctcctcccagccctcctcccaccccaccgccacctggtcctcttccccactattccagcagccacaggatcagggggtttgccgcctgaacttgcggcacctgcccctgatgggtctgcagattccctcactacgcaggcgctagaggctaacacccaggatcagctcgaggcggacacactcacgaatgcgcatacctctgaacatggtctccacgttagcctagacaccatttccaaggcatctcatggaaaatctgcttgaaacacgcatgacaatggtctacaaagcattatgggaggagcttcatagcactgtgcatgctgaggaccagatgactaccaatactcctgatgaagctgctccctgatactcatcgatagatgcacgatacctgtgaaagcacatattatctgtgctgcggagattacgccatagctn

SEQ ID NO: 55707 - protein, 40 aa, Zea mays
  misc_feature: Ceres CLONE 1490367
MENLLETRMTMVYKALWEELHSTVHAEDQMTTNTPDEAAP

SEQ ID NO: 55708 - DNA, 701 bp, Zea mays
  misc_feature: Ceres CLONE 1490385
  misc_feature: Encodes the peptide sequence at SEQ ID NO. 55709
aaagctggagctccccgcggtggcggccgctctagaactagtggatcccccgggctgcaggaattcgcacgagaccattacctagaacatcctaatcgaaaaaattgcgccgccgcctcccccgaagccatccgcatccgcacgctcgctggccgcggccgcccgacgcgatggctgccaccaagaaggcgaaaaagagcggggagaacatcaacgacgggctgcagctggtgatgaagagcggcaagtatacgctcggctacaagaccgtcctcaggacgctgcgcagctccaaggggaagctgataatcctcgcaaacaactgcccgcccctgaggaagtcagagattgagtactacgctatgctggcgaaaattagcgggcaccatgtccatggaaacaatgctgatcttggaacagcctgcagcaagtactaccgggagtgctgcctcagcatccttgaccctggtgactcggacatcatcagcaccgccaccaccacccagtgaagaggagagaagagagctctccacctatttcatttagtcgagatgtagggtcctgttgcgctctcgagaccactcatgctatctgcggatgaagtacctgtttgcgacgctgagttggagctgtgatacagataatacttcatgaggttgttccactggacatgcgacaccaagaagagatagcttatcgac

SEQ ID NO: 55709 - protein, 112 aa, Zea mays
  misc_feature: Ceres CLONE 1490385
  misc_feature (12)..(106): Pfam Name: Ribosomal_L7Ae Pfam Description: Ribosomal protein L7Ae/L30e/S12e/Gadd45 family
MAATKKAKKSGENINDGLQLVMKSGKYTLGYKTVLRTLRSSKGKLIILANNCPPLRKSEIEYYAMLAKISGHHVHGNNADLGTACSKYYRECCLSILDPGDSDIISTATTTQ

SEQ ID NO: 55710 - DNA, 682 bp, Zea mays
  misc_feature: Ceres CLONE 1490390
  misc_feature: Encodes the peptide sequence at SEQ ID NO. 55711
aaagctggagctccccgcggtggcggccgctctagaactagtggatcccccgggctgcaggaattcgcacgagaccattacctagaacatcctaatcgaaaactagccatggcgtggagcgccgccgccgtctccaggttcgcagccgcctccccacccgcggcacccatctccgtcaggcttggagccgccgcttctcgctcgtccctgtccttctccagtgggcgccgacgccccgtggccgcgtccctctcgacctctgccaccgctgtaaaggaggctgttcagactgagaaggcaccaccagcactaggcccttattctcaggccatcaaagcaaataatcttgtgtttgtttctggagttcttggcttgaatcccgagaccaggaagtttatctctgagaatgttgaggagcaaactgagcaggttatgaaaaacatgggcgagatattgaaagctagtggtgctcactattcttcagttgtgaagacaacgatcatgttggctgatctgcaggatttcaatacagtaaacgagatctatggcaaatatgtcccggtgccagcgcctgcacgatcaacctaacaagtggcggcgctgccactgaatgcccggattgagatggagtgcatccctgctctcgtatcggatcatccaaacactcggtagatcagcaata

SEQ ID NO: 55711 - protein, 159 aa, Zea mays
  misc_feature: Ceres CLONE 1490390
  misc_feature (61)..(160): Pfam Name: Ribonuc_L-PSP Pfam Description: Endoribonuclease L-PSP
MAWSAAAVSRFAAASPPAAPISVRLGAAASRSSLSFSSGRRRPVAASLSTSATAVKEAVQTEKAPPALGPYSQAIKANNLVFVSGVLGLNPETRKFISENVEEQTEQVMKNMGEILKASGAHYSSVVKTTIMLADLQDFNTVNEIYGKYVPVPAPARST

SEQ ID NO: 55712 - DNA, 504 bp, Zea mays
  misc_feature: Ceres CLONE 1490394
atagctggagctccccgcggtggcggccgctctagaactagtggatcccccgggctgcaggaattcgcacgagaccattacctagaacatcctaatcgaaaaaaaacctgaccaaccccacccactggaccggcccgcgcccgcttggtccagcgccggccctgcctgcagccagccaccgttgtccgttacctcccgcgatccactcctctcgagcctctagggggaccgaaaggaaatccggccggggtttgggttcccaaccagggggaagggaaaaaaaaccccccccccccccccgctggggggggaaaaaagttttccccaaaaaaatcttaaccccaaaaaatttttggggaaccccccccccccaaaaaaaaaatgggggggggggcccccccccccaaaagggttttttttttaaacaccccctttttttttttctccccccccccccggggaaaaaaaaaaaaaagagggtgttggcacaaacccccccccccc

SEQ ID NO: 55713 - DNA, 676 bp, Zea mays
  misc_feature: Ceres CLONE 1490402
  misc_feature: Encodes the peptide sequence at SEQ ID NO. 55714
ccccgcggtggcggccgctctataactagtggatcccccgggctgcaggaattcgcacgagaccattacctagaacatcctaatcgaaaaaacggcaacgcctctaccacctgtggtggcttctcctctccccgctcccctcctgccccttcccttcgtcctcagatccgccgatcccccgcccctgcgcctccgtctgcatgatctctgcgcctctgcgggtgccggcgccgaaggctgccgccgggggttcgttcctgctcggcgcgtcctccgtcgagtccaatcccaatcccaagcccagcaggatccgctgcgcctgcgccaccctgtacgaggtcctgggcctgcgcgccggctcgacgggccgggagatcaaggccgcgtacaggcgcctggcgtgggagcggcacctggacgtggcgcacgcgcccggggccgccgccgagttcacccgcctgcacgacacctacggcaagctctccgacccggacagccggcgcgcgctacgacggccgcggcgccacgcccacgacggccgtggccaggggcccctagagaagcgccgtctacggccaggcccgacgggtcacatgggagacggaccactgctccgggtcgagagtacagaggcacaagcaagagcccctcgcgctgcttgtgtgaatgtgcactg

SEQ ID NO: 55714 - protein, 158 aa, Zea mays
  misc_feature: Ceres CLONE 1490402
  misc_feature (43)..(104): Pfam Name: DnaJ Pfam Description: DnaJ domain
MISAPLRVPAPKAAAGGSFLLGASSVESNPNPKPSRIRCACATLYEVLGLRAGSTGREIKAAYRRLAWERHLDVAHAPGAAAEFTRLHDTYGKLSDPDSRRALRRPRRHAHDGRGQGPLEKRRLRPGPTGHMGDGPLLRVESTEAQARAPRAACVNVH

SEQ ID NO: 55715 - DNA, 714 bp, Zea mays
  misc_feature: Ceres CLONE 1490434
  misc_feature: Translation starting site: 347
  misc_feature (410)..(410): n is a, c, t, g, unknown, or other
  misc_feature (411)..(411): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (438)..(438): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (469)..(469): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (492)..(492): n is a, c, t, g, unknown, or other
  misc_feature (493)..(493): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (518)..(518): n is a, c, t, g, unknown, or other
  misc_feature (535)..(535): n is a, c, t, g, unknown, or other
  misc_feature (541)..(541): n is a, c, t, g, unknown, or other
  misc_feature (542)..(542): n is a, c, t, g, unknown, or other
  misc_feature (570)..(570): n is a, c, t, g, unknown, or other
  misc_feature (582)..(582): n is a, c, t, g, unknown, or other
  misc_feature (583)..(583): n is a, c, t, g, unknown, or other
  misc_feature (589)..(589): n is a, c, t, g, unknown, or other
  misc_feature (622)..(622): n is a, c, t, g, unknown, or other
  misc_feature (650)..(650): n is a, c, t, g, unknown, or other
aaagctggagctccccgcggtggcggccgctctagaactagtggatcccccgggctgcaggaattcgcacgagaccattacctagaacatcctaatcgaaaacacgattccttccgttccatctccaccggctaaactgccctcgcctccgatcgaacagacgttcctcctccgtcgccgccgcggccgtttgatcctccttgcgagtccgaacctccccacgacggcacgcggccggatccagatcgggagtactccccactccccgcgcttctccttcgcatcacaagcggccccggccccagacccctagccggatcggatctcgcgcggcgccgtgccggagatgatgtcgtcgtcgtcggacgcggcagcggcgctggagctgcgaccgggggggggggaaggannccnnnnnggnnnnnnnnnnnnnnnngngggnnnccttgnnnnnnnnnnngnnnnnggncnnnggggnnnnggggccggggnncccccgggggnnngccgggcccccnggggggggggggccggngcggcnncccccccccccggggggggggggggggnccccccggggcnngtcccnttgggggggcttctcctccgaagggccccccgncccccccccccggccccccggggggggngggggcccccccttttggcccttgtttttgggcccccttttttttttgggcccgttttgcccct

SEQ ID NO: 55716 - DNA, 591 bp, Zea mays
  misc_feature: Ceres CLONE 1490441
  misc_feature: Translation starting site: 478
  misc_feature (144)..(144): n is a, c, t, g, unknown, or other
  misc_feature (161)..(161): n is a, c, t, g, unknown, or other
  misc_feature (162)..(162): n is a, c, t, g, unknown, or other
  misc_feature (173)..(173): n is a, c, t, g, unknown, or other
  misc_feature (174)..(174): n is a, c, t, g, unknown, or other
aaagctggagctccccgcggtggcggccgctctagaactagtggatcccccgggctgcaggaattcgcacgagaccattacctagaacatcctaatcgaaaagttgtttatcttgcgtccggcgtcctctctctctctcgtggncgacgactggggcgacnnctccccgcccnnccgccgctctacgccaggtgcccagatcttcgtcgggcccttcgccgaagacagccaacaggttgccggtctgcgagttgaatcatggcggagcacttggcttcgatcttcggcactgagaaggacagggtcaactgcccctttttactttcagattggggcctgtcgtcatggggatcgctgctctcgtctgcacaacagggccactatatcaccaactcttgtgcttgctaacatgtatcagcgccctgatatgataacccctggagttgatgctcaagcccacctattgaccttgaggagatgcaggagcattttgaggacctctatgaggactccattaagagtttggggaagtttgtgaaaattgaaaaactgaaagggttgggatacccctggtgaccccttgaatgggaa

SEQ ID NO: 55717 - DNA, 690 bp, Zea mays
  misc_feature: Ceres CLONE 1490495
  misc_feature: Encodes the peptide sequence at SEQ ID NO. 55718
aaagctggagctccccgcggtggcggccgctctagaactagtggatcccccgggctgcaggaattcgcacgagaccattacctagaacatcctaatcgaaaactcttgttctccggttccccgcggcatactctttcctgcgctctctctctcggttctgccgtgttcctcgcgtgcgctgtgtctccgagtggcgccgcctccgccgcctccgtcgaccctgcgccagattcgtggatatggctgataatgagaaagaagtgggggagggaaccaccccccgaggggcggattgggaagttgtgactctcacagcatctgcctatgaagcggcgccaggacctgtcggaacagaagtaaagcctgttaatgaaaatcaagagcatagttcatccaatgcactgctcatgtctgaccactttgtgtttccgccgagtgagcacgagaacctgccaatacaaaccagtttcgatgatatacagcctgagaaggatgtgcagaaacctagtaccactgtggaggattatagtattaagaatgttgttgggtctgagagagttcagtttgatgatgaagggaaagacctcttacatgatgatgtggagatgagagatgacacacctgggtacggttcatcccacgctgaagatgatgcacatggttctgttgttcacgatgatggtgttgagt

SEQ ID NO: 55718 - protein, 150 aa, Zea mays
  misc_feature: Ceres CLONE 1490495
MADNEKEVGEGTTPRGADWEVVTLTASAYEAAPGPVGTEVKPVNENQEHSSSNALLMSDHFVFPPSEHENLPIQTSFDDIQPEKDVQKPSTTVEDYSIKNVVGSERVQFDDEGKDLLHDDVEMRDDTPGYGSSHAEDDAHGSVVHDDGVE

SEQ ID NO: 55719 - DNA, 695 bp, Zea mays
  misc_feature: Ceres CLONE 1490498
aagctggagctccccgcggtggcggccgctctagaactagtggatcccccgggctgcaggaattcgcacgagaccattacctagaacatcctaatcgaaaaaggatctgtgtggccatcgactactctgagactgtcaaaaaggcgctcgactgggccctcgacgaccatgctccaccacgggaacacccgtcgtcgtcgactgcgttctgtactacggtacggacgagaccaatgcacgctctgcggctagtccggatcccccctgatcccactctgcgagttcacggagcccgagatgatgcaggcctactgtgtgatcccaggacaccgaactgctcgacgaaatctacgcgccagatcgacagagtgagactgaaggtggtgactgaaatgtactgggctcacgccaggtctcaatctctgagacctcctcgaggatctcaaaatggattctctcgtcatgggtaatcgggttctccgccccatccataggattcccctgggaagtgtgacaaactaagtgctgcctaacgcgtagggccctgtaacagtcatcgatgagaaacagtggtctgagcatcttgcccatcatattaataaagatgctagcgtgcaactcgcgtgggctgtagatgaacactatggtccgtactgatgaagcactgcgataaagcatgtgtctactacagttca

SEQ ID NO: 55720 - DNA, 694 bp, Zea mays
  misc_feature: Ceres CLONE 1490512
  misc_feature: Encodes the peptide sequence at SEQ ID NO. 55721
aaagctggagctccccgcggtggcggccgctctagaactagtggatcccccgggctgcaggaattcgcacgagaccattacctagaacatcctaatcgaaaaacggcctctcggcggggcccggcaacagaccgggcagcagcacggcagccatggcgtcgagttcgaccctggatttggcgatgggccccggcgccctcctcccccgcagcgcggtcccgtacgcctccttcgctccaggaaggggaaggagcgcgagcggaacgaggagcaggaatctggcgctctccgcttcctcctccaacggtgcagcagtgccatccctgacaacagattcggagaagaagggcccagtgataatggaaattccactggaccaaatccggaggccactgatgcgaacgcgggccaatgatccagtcaaggtgcaagaactcatggacagtatccgtgtcatcggcctccaagtacctattgatgtgttggaggtcgatggggtctattatggcttctctggatgccaccgctacgaggctcaccagcgccttggtctcccaaccatccgctgcaaagttcgccgtgggacaaaggaaacactgaggcgagagcaccttccttcagcttggattccatttttgaattacttgatgcactgaacttcagtttgctctttcaggcaccatatgcgatgagt

SEQ ID NO: 55721 - protein, 167 aa, Zea mays
  misc_feature: Ceres CLONE 1490512
  misc_feature (70)..(154): Pfam Name: ParBc Pfam Description: ParB-like nuclease domain
  misc_feature: SWISSPROT Homolog: EC 1.8.98.2 Sulfiredoxin
MASSSTLDLAMGPGALLPRSAVPYASFAPGRGRSASGTRSRNLALSASSSNGAAVPSLTTDSEKKGPVIMEIPLDQIRRPLMRTRANDPVKVQELMDSIRVIGLQVPIDVLEVDGVYYGFSGCHRYEAHQRLGLPTIRCKVRRGTKETLRREHLPSAWIPFLNYLMH

SEQ ID NO: 55722 - DNA, 679 bp, Zea mays
  misc_feature: Ceres CLONE 1490531
  misc_feature: Encodes the peptide sequence at SEQ ID NO. 55723
  misc_feature (676)..(676): n is a, c, t, g, unknown, or other
tggagctccccgcggtggcggccgctctagaactagtggatcccccgggctgcaggaattcgcacgagaccattacctagaacatcctaatcgaaaactctctccgtcgacctcgctctcgcctcgccgcctccgacccgcagcagcgcctccattgctctctctcacgagtcccggcgttccagtggggggcattcatggcggggcagtccgacccgcacctctccatcttctcgccctccgaggtggagttcgtggctgatgatgatattgtcgaaatcgtccccaacatccgcatggacgccctcaacatgatctgcggggatttcgggcccttcttcccccagattcccaccaaggtgcctctctggctcgctgtcgcgctcaagaagcgtatcaagtgcaccatccgcaccccggactggatgactgttgaccgcttgacacaggtattggaagcggacagagagtcgccacgagaattccagccattaccattccactatattgaaatgtctaagcttctgtttgatcatgctcgtgatgacatctcagatgcatacctggtaagatctctacatgacgacatcacagatgtcatatctcacaaggttgagactggattagagacgatatctggacgcacccatgcctgaaagctcaaacatctctctgncaa

SEQ ID NO: 55723 - protein, 152 aa, Zea mays
  misc_feature: Ceres CLONE 1490531
  misc_feature (20)..(152): Pfam Name: Psf2 Pfam Description: Partner of SLD five, PSF2
MAGQSDPHLSIFSPSEVEFVADDDIVEIVPNIRMDALNMICGDFGPFFPQIPTKVPLWLAVALKKRIKCTIRTPDWMTVDRLTQVLEADRESPREFQPLPFHYIEMSKLLFDHARDDISDAYLVRSLHDDITDVISHKVETGLETISGRTHA

SEQ ID NO: 55724 - DNA, 691 bp, Zea mays
  misc_feature: Ceres CLONE 1490550
  misc_feature: Encodes the peptide sequence at SEQ ID NO. 55725
aaagctggagctccccgcggtggcggccgctctagaactagtggatcccccgggctgcaggaattcgcacgagaccattacctagaacatcctaatcgaaaacaaaatacctggattggacagacagacgtacatgcattctttttggtgatgctgctggtgctgtgttggtacaggcatgcagtgctgatgaagatggcatgcttggtttttatgatcaaagtgatggcaatggacaacagcacctaagtgccataccggctaatgacaagtctatcttgtccaataccaatggtgttccacgatttccgccaaagaaggcaacctactcatgcattcaaatgaacggaaaggaagtttttcactttgctgtccgatgcgtgccacagtccattgataaggcactccaagaagctggtttgcctgcctcatgtatcgactggttgttgttacatcaagctaatcaacgtattattgatgctgctgccagtagattagatatcccatccgacaaggttatttcaaatcttgctaattacggcaataccagtgcggcatccatcccattagcattggatgatgctgttcgcagtggcaaggtgaagactgctgatattatagccgcatcaggttttggcgctggacttacctggggttcagctattgtcaaatggggctaattattctacgt

SEQ ID NO: 55725 - protein, 159 aa, Zea mays
  misc_feature: Ceres CLONE 1490550
  misc_feature (69)..(158): Pfam Name: ACP_syn_III_C Pfam Description: 3-Oxoacyl-[acyl-carrier-protein (ACP)] synthase III C terminal
  misc_feature: SWISSPROT Homolog: EC 2.3.1.41 Beta-ketoacyl-acyl-carrier-protein synthase I
MLGFYDQSDGNGQQHLSAIPANDKSILSNTNGVPRFPPKKATYSCIQMNGKEVFHFAVRCVPQSIDKALQEAGLPASCIDWLLLHQANQRIIDAAASRLDIPSDKVISNLANYGNTSAASIPLALDDAVRSGKVKTADIIAASGFGAGLTWGSAIVKWG

SEQ ID NO: 55726 - DNA, 735 bp, Zea mays
  misc_feature: Ceres CLONE 1490566
  misc_feature (241)..(241): n is a, c, t, g, unknown, or other
  misc_feature (269)..(269): n is a, c, t, g, unknown, or other
  misc_feature (341)..(341): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (425)..(425): n is a, c, t, g, unknown, or other
  misc_feature (426)..(426): n is a, c, t, g, unknown, or other
  misc_feature (432)..(432): n is a, c, t, g, unknown, or other
  misc_feature (456)..(456): n is a, c, t, g, unknown, or other
  misc_feature (609)..(609): n is a, c, t, g, unknown, or other
  misc_feature (628)..(628): n is a, c, t, g, unknown, or other
aacactggagctccccgcgcgtggcggccgctctagaactagtggatcccccgggctgcaggaattcgcacgagaccattaactagaacatcctaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcancaagatgtacccggacatggctgaacangtgaccaccaccaccccaggctctcctcatgggtggggcaccatcccaggggcacgcttatgtttgggttcnagggggccgtctggagcttatattttttttccccccccccccgaggaaaaagaaaagggggannnttnnnnttnnnnnnnnttnntttttnttaaaacaacaaaaaaaaaacccncacggggggggggggggtgttttttacctccccaacctatattccccggcccctgcggtgtctttgagttctacggcgccgcaagaaaagcctggcgccggggtggcgggcccccggccttccgcgtgatcgcgaatcgggcggccggggggnggggcgtcgaggtgcgggngcccgcgcggcggcccgtgcggcgtgcctttcgccgccaccacgatcattccttcggtggtcgcccgccagccacaaccgcgagccggcgacactcctcccccagcc

SEQ ID NO: 55727 - DNA, 636 bp, Zea mays
  misc_feature: Ceres CLONE 1490570
  misc_feature: Encodes the peptide sequence at SEQ ID NO. 55728
tggagctccccgcggtggcggccgctctagaactagtggatcccccgggctgcaggaattcgcacgagaccattacctagaacatcctaatcgaaaaaaacacggaagggaggctctcaccagtcaccactcacctgacgacgagcgagcgagaggaacggggcgagggaagttaaacgcgcggcgatgccggagctgccggaggtggaggcggcgcgtcgggcgctgcatgcgcactgcgtggggaggcgcatcgcgcgctgcgccgtggcggacgacgccaaggtggtcgttgccgccgccggccgcgcggccttcgagcgggccatggtcggccggaccatcgtcgccgcgcgccggatgggcaagaacctctggctatagctcgacgcgccgcccttcccgtccttccagttcgggatggcaggcgcgatatatatcagaggcattcctgtgacgaattatgagagatccgttgttaatcccgaagaggagtggccctccaaatactccaaatttctttgctgagcttgatgatgttttgaagttcccttttccctgaaaaacggctcttgcaaaagtcgtttgtttaaagaatccgaaacccctacccccaatttttagaactaggcccca

SEQ ID NO: 55728 - protein, 65 aa, Zea mays
  misc_feature: Ceres CLONE 1490570
MPELPEVEAARRALHAHCVGRRIARCAVADDAKVVVAAAGRAAFERAMVGRTIVAARRMGKNLWL

SEQ ID NO: 55729 - DNA, 684 bp, Zea mays
  misc_feature: Ceres CLONE 1490583
  misc_feature: Encodes the peptide sequence at SEQ ID NO. 55730
aaagctggagctccccgcggtggcggccgctctagaactagtggatcccccgggctgcaggaattcgcacgagaccatacctagaacatcctaatcgaaaacagttctaggaaatcatgattacaggggcaatgcgctcgcacagcttagcccagtcttgaggaagatcgacgaccgattcatttgcatgagatcgttcatcgttaacgcagaacttgtggacttcttctttgtcgacaccactccgttccaactggagtattggactcaccctggcaaggatcgttatgactggagaggggtggcgcctcgaggcaagtacatagccaatttgctgaaggatctggatgtggctatgaagaaatcaactgcaaggtggaagattgtggctgggcatcacaccatgaggagtgtgagtgagcacggggacactaaggagcttctggaattactacttccagtcctcaaggttacatttcagaagctatctcaatcggtttcaactttcagaaaggtccatgataataacactgtttctatgggaaaacaatccacaccattcaggacaatggcgtcgacttctacatcaatggacacgatcactgcctggagcacattagcagcagagacagtccactccagtatttcacgagcggaggcggttccaggcatggagaggagtct

SEQ ID NO: 55730 - protein, 165 aa, Zea mays
  misc_feature: Ceres CLONE 1490583
MRSFIVNAELVDFFFVDTTPFQLEYWTHPGKDRYDWRGVAPRGKYIANLLKDLDVAMKKSTARWKIVAGHHTMRSVSEHGDTKELLELLLPVLKVTFQKLSQSVSTFRKVHDNNTVSMGKQSTPFRTMASTSTSMDTITAWSTLAAETVHSSISRAEAVPGMERS

SEQ ID NO: 55731 - DNA, 698 bp, Zea mays
  misc_feature: Ceres CLONE 1490587
  misc_feature: Encodes the peptide sequence at SEQ ID NO. 55732
caaaactggagctccccgcggtggcggccgctctagaactagtggatcccccgggctgcaggaattcgcacgagaccattacctagaacatcctaatcgaaaaatcaaccaggtcagatctcgcgtatgctcgtttgtagcagtgtggatctgatactggtaattgaaacctttagatggtggtagggttactactgagaaatagaccacaactagtactggaacccacgtgtagtgaggagacatggctgcatacagagatccaacctcaggaaacagaaggagtggtgcgccaagaagggcagagcggataagagctagacatggttggcgctgctgctgcataagcacatgcacggcagcccgaaaggtgatgagaccagaggggtggagaggtactctgctgggaccggcacactcacgggtgcaaagaatcagctgtcctctgagaccgatgcagcacctgagacacttacacttctcgtctgcgtaatgtttctcccaggctcttgttctgtacgcatgccccagcacgccatgtccttgggctccatcgatggcttacctgatcttctgagcagctaggagtacagcgtctatgaagtgaagagtaattacgagtcgaaagaaacacgtaaagcttatcgataccgtcgacctcgagggttggcccggtacctaatacgtcctacaggagt

SEQ ID NO: 55732 - protein, 45 aa, Zea mays
  misc_feature: Ceres CLONE 1490587
MVVGLLLRNRPQLVLEPTCSEETWLHTEIQPQETEGVVRQEGQSG

SEQ ID NO: 55733 - DNA, 678 bp, Zea mays
  misc_feature: Ceres CLONE 1490601
  misc_feature: Encodes the peptide sequence at SEQ ID NO. 55734
  misc_feature (642)..(642): n is a, c, t, g, unknown, or other
aaagctggagctccccgcggtggcggccgctctagaactagtggatcccccgggctgcaggaattcgcacgagaccattacctagaacatcctaatcgaaaacttccacggcgcggcggggctgctggggctcggccgcggcccgctctcgttcgcgtcgcagctgcgcggcgtctacggcggccacgccttctcctactgcctcgtggagcatggcagcgcggccgggagcaaggtcatcttcggccacgacgacgcgctgctcgcgcacccgcagctcaactacacggccttcgcgccggccacggacacggacaccttctactacctccagctcaagtccatcctcgtgggcggggaggcggtcaacatctcctccgacacccttgccgccggcggcaccatcatcgactccggcacgacgctgagctacttcccggagccggcgtaccgggcgatccggcaggcgttcatcgaccgcatgagcccgtcctacccgctcatcgccgggttcccggtgctgagcccgtgctacaacgtgtccggagccggaaagatcgaggtgccggagctgtcgctggtgttcgcggacggcgcggcgtgggagttcccggcggagactacttcatccggctggagccngagggggtgatgtgcctggccgtccctggcacgccc

SEQ ID NO: 55734 - protein, 56 aa, Zea mays
  misc_feature: Ceres CLONE 1490601
  misc_feature (54)..(54): Xaa is any aa, unknown, or other
MSPSYPLIAGFPVLSPCYNVSGAGKIEVPELSLVFADGAAWEFPAETTSSGWSXRG

SEQ ID NO: 55735 - DNA, 661 bp, Zea mays
  misc_feature: Ceres CLONE 1490605
  misc_feature: Encodes the peptide sequence at SEQ ID NO. 55736
atcagaagaaacataacagaataatatgatagcggcggcgcggtctacgcgttctagactcccctctgaccccctgacgatagcgtcgaagatgtccacaaccagatccgcgtccctgctcgcgctgctcctcctggtctctgcgaccgccgccgctgccgggacgagcaagggccgcgcgggggtgcggccgtgccaggatctggcgacgcggggccagtgcgcggcgagcggcgggtgccggtggtgccgcagcgaggcgctcgacgacatgtgcttcgaggccatcgaggcgtggcgccttccgcgccaggtgttctcctgcgacccaccctccggtgccgcccacgcccgcttgaactgaagtaatgccgcggccggccgccggcgaagctatgttatgctatcgccttggtcgggatcgctcgatctgatctcgtttgtcgccaggcctccgttgttttctttgctggatctgagatatacaatagcgtgtttcatgctgctgcctgtctggtctgcggttctttcattcattgattgtgctgcccatcatactctcgattctcaaagtccaatggcctgtcatttgtattctcaaaattatgttaatgagcacgatcgtaccattccagagtcttgaacaaaaaaaaaaaaaaaa

SEQ ID NO: 55736 - protein, 112 aa, Zea mays
  misc_feature: Ceres CLONE 1490605
MIAAARSTRSRLPSDPLTIASKMSTTRSASLLALLLLVSATAAAAGTSKGRAGVRPCQDLATRGQCAASGGCRWCRSEALDDMCFEAIEAWRLPRQVFSCDPPSGAAHARLN

SEQ ID NO: 55737 - DNA, 713 bp, Zea mays
  misc_feature: Ceres CLONE 1490606
  misc_feature: Encodes the peptide sequence at SEQ ID NO. 55738
  misc_feature (391)..(391): n is a, c, t, g, unknown, or other
  misc_feature (491)..(491): n is a, c, t, g, unknown, or other
  misc_feature (605)..(605): n is a, c, t, g, unknown, or other
ggagctccccgcggtggcggccgctctagaactagtggatcccccgggctgcaggaattcgcacgagaccattacctagaacatcctaatcgaaaaagacgattcaccccgcaccgcgagcgaggagaggagcctggccgcgagggcgtcgacgctgatggcggcgtggtggcggaggaaggtggtgccctgcgcgcgccgcgcctgggccgccctcgccgcgcggctccgcgcgcgtaagcctggatatcacctggacaccgtggatcatgtgccaggcagtggtggcattctgaagctcaacgaggacgtgcagacttgcggctacaaggacgtccaggtcatgttcgacatgttgacatcggaactcgagggagccgctcaagcccanaagccaccgacgtcgccgccccgctggggaggagcgcttcccgctgcatggcccggccgggcctcgtcggcgatccctggtggcccgtagggttcctgcnaacagtacctttagaaaagcggtccgcccgccccttgcccttctttcttcctgaaagggggaaaaattgcagctgagaaccgttaggcttaggagtaatccgccggaagattcnaggggttccccaagcttcccggcttcaccgtgcgcgcgttggcagggcggaccggagcccccgtgttcgaaagactttttcttcgcccctgccggtattggggtgtgg

SEQ ID NO: 55738 - protein, 107 aa, Zea mays
  misc_feature: Ceres CLONE 1490606
  misc_feature (78)..(78): Xaa is any aa, unknown, or other
MAAWWRRKVVPCARRAWAALAARLRARKPGYHLDTVDHVPGSGGILKLNEDVQTCGYKDVQVMFDMLTSELEGAAQAXKPPTSPPRWGGALPAAWPGRASSAIPGGP

SEQ ID NO: 55739 - DNA, 641 bp, Zea mays
  misc_feature: Ceres CLONE 1490610
  misc_feature: Encodes the peptide sequence at SEQ ID NO. 55740
ctggagctccccgcggtggcggccgctctagaactagtggatcccccgggctgcaggaattcgcacgagaccattacctagaacatcctaatcgaaaaactgcgccatccaaggacgactggacgaggaagaaaaaggatttcgaaaaagcgacgctgccgggtatatatacggcgccggcgccgaggagagaggaccccggccgatcccgcacccctgactgtcagccgcgatccgctcttttttgcgtgcagcggcggagcaggagagatggcgtcggaggccaaggacgtgggcatcctcgccatggacatctacttcccgcccaactgcgtgctccaggaagagttggaaacacatgatggcgtgagcaaaggggagtataccattgggcttgggcaggaaagtatggcattttgcactgaagttgaggatgttatttcgatgagcttgacagtggtgaagtccctcctgaaaaaatataacattgaccccatgtgcatttggacgttggaaattggcagtgaaacagtaatagacaagagcaagtctataaagacatggctgatgcaaatatttgagggatctggcaatactgatattgagggagttgactccctcaatgcctggtatgggtgaac

SEQ ID NO: 55740 - protein, 122 aa, Zea mays
  misc_feature: Ceres CLONE 1490610
  misc_feature (4)..(122): Pfam Name: HMG_CoA_synt_N Pfam Description: Hydroxymethylglutaryl-coenzyme A synthase N terminal
  misc_feature: SWISSPROT Homolog: EC 2.3.3.10 Hydroxymethylglutaryl-CoA synthase
MASEAKDVGILAMDIYFPPNCVLQEELETHDGVSKGEYTIGLGQESMAFCTEVEDVISMSLTVVKSLLKKYNIDPMCIWTLEIGSETVIDKSKSIKTWLMQIFEGSGNTDIEGVDSLNAWYG

SEQ ID NO: 55741 - DNA, 681 bp, Zea mays
  misc_feature: Ceres CLONE 1490616
  misc_feature: Encodes the peptide sequence at SEQ ID NO. 55742
aaaagctggagctccccgcggtggcggccgctctagaactagtggatcccccgggctgcaggaattcgcacgagaccattacctagaacatcctaatcgaaaaacctcctgactgcacactcgtctccgcagtttgaaacgaagcccgcggctactgcaagctactccgtctccgtagctaaaggagaggtaggtttttatttggcgacgacatgagcacgggcgtgcggccggggcggcggttcacggtggggcgaagcgaggacgccacgcacccggacaccatccgcgccgccatctccgagttcatcgccaccgccatcttcgtcttcgccgccgagggatccgtcctctcgctcggtacgtacgcacgcacgcttcaccgtccgtcaaccacgtcttccgatccgctcgacgatgcgtgtgcgtggggtttgccgtttatttaatttattgttgtgttgtgtgtgcagggaagatgtaccacgacatgagcacggtgggcggcctggtggctgtggcgctggcgcacgcgctggccctggccgtggccgtggcagtggccgtcaacatctcgggcgggcacgtgaacccggcggtcaccttcggcgcgctcgtcggcggccgcgtctccctagtccgcgcggtcttctactgggtcgcgcagctgctgggcgccgt

SEQ ID NO: 55742 - protein, 67 aa, Zea mays
  misc_feature: Ceres CLONE 1490616
MYHDMSTVGGLVAVALAHALALAVAVAVAVNISGGHVNPAVTFGALVGGRVSLVRAVFYWVAQLLGA

SEQ ID NO: 55743 - DNA, 656 bp, Zea mays
  misc_feature: Ceres CLONE 1490641
  misc_feature: Encodes the peptide sequence at SEQ ID NO. 55744
  misc_feature (235)..(235): n is a, c, t, g, unknown, or other
  misc_feature (236)..(236): n is a, c, t, g, unknown, or other
  misc_feature (357)..(357): n is a, c, t, g, unknown, or other
  misc_feature (358)..(358): n is a, c, t, g, unknown, or other
  misc_feature (361)..(361): n is a, c, t, g, unknown, or other
  misc_feature (362)..(362): n is a, c, t, g, unknown, or other
  misc_feature (366)..(366): n is a, c, t, g, unknown, or other
  misc_feature (420)..(420): n is a, c, t, g, unknown, or other
  misc_feature (428)..(428): n is a, c, t, g, unknown, or other
  misc_feature (430)..(430): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
aagctggagctccccgcggtggcggccgctctagaactagtggatcccccgggctgcaggaattcgcacgagaccattacctagaacatcctaatcgaaaaacgatatgttcttaaaaaaagcaaatttgccgtctgcaaaacccctcccacagccgtcgccgcccgccagcccgccagcgagagaagtccgcttcatccgttcgccgcctcaagggacgaagatggacaacatnncaagccctgcagcacttgtcaatgcacagatgctgaaacatgtttgttgggcgaagagtgcgcacggtttgttcaagtcaaacaccatgaaagtgggagtggctttgtcggggcagtcccnnccnnccgnggaaaaattggggggggcccaaccacccccccaaaattttttttgttggttggntgtgctcntnaaaaaaaaaaagtgccatgggaccgtccccgtattccaaattttattgggaggggtttttgggaaatttccctaaannnaaaaacacccccagaacccctcccccggggggcccaaaaannnntttgcccagggaaagagttgttnnncnnnngggcgcccccaccattctgttggtggcccccccgcggaggggtgttttttttttgtaaaaaagaagaaataca

SEQ ID NO: 55744 - protein, 93 aa, Zea mays
  misc_feature: Ceres CLONE 1490641
  misc_feature (4)..(4): Xaa is any aa, unknown, or other
  misc_feature (5)..(5): Xaa is any aa, unknown, or other
  misc_feature (45)..(45): Xaa is any aa, unknown, or other
  misc_feature (47)..(47): Xaa is any aa, unknown, or other
  misc_feature (48)..(48): Xaa is any aa, unknown, or other
  misc_feature (66)..(66): Xaa is any aa, unknown, or other
  misc_feature (69)..(69): Xaa is any aa, unknown, or other
MDNXXSPAALVNAQMLKHVCWAKSAHGLFKSNTMKVGVALSGQSXPXXEKLGGAQPPPQNFFCWLXVLXKKKKCHGTVPVFQILLGGVFGKFP

SEQ ID NO: 55745 - DNA, 757 bp, Zea mays
  misc_feature: Ceres CLONE 1490649
  misc_feature (478)..(478): n is a, c, t, g, unknown, or other
ctagctggagctcaccgcggtggcggccgctctagaactagtggatcccccgggctgcaggaattcgcacgagaccattacatagaacatcctaatcgaaaaagtccaccaccaccaccggcccgtgccccaggcacaaaaaggcgaaatcaagggtggtcacgcccagcgactacaccaagacgcagtcggcgggggcaaagatctcccaacccccattgaatcgcccgtcaacaccccaaattattctgttttttccgcggctccctacccggcgatggccacttgtgcttctcttttctgtctttgaatctccaccatccggctccctgggtccgtcttccaacctcccccctcaattcctatttttttttttttattttttcactcccctccccaccagttttgtttattaacttgcaccccccccccccctccacagcaccccccctcccccccgagtcggtgcatggtggtncacacatcaatacggcccgacagtggttatatcctaatatttgaagcacaacaccaaccttgagtagttaccactatcccgtttgcacccaagatcaatacctgctacgcccgaactcatctttttctcccccctcctccccctaacattttatgtgtacctcgtttatattcctatagccataaaatatgcgaaatgtttctcatccaacccggtcccaagcacccaacaataccatcttggtattaccatatctccaactattttcacatactggtg

SEQ ID NO: 55746 - DNA, 711 bp, Zea mays
  misc_feature: Ceres CLONE 1490653
aaagctggagctccccgcggtggcggccgctctagaactagtggatcccccgggctgcaggaattcgcacgagaccattacctagaacatcctaatcgaaaaactcgagccagccagccagccagcaagccgcttgggcgccatctctctagagcttcgtaccctcgaagagagatccggcgcggcccaataaacacccgggctactacagactcgcagatggccggcctcaggatgaagttcgtcgccgtcgccgccctgggcgcccccgctcgtggggtcccccccaaccccccaaggccccggcccccggttccccggttccaaagccccggcccccgtaaccccttgggggggggtttccttgggggccgccccctttgggggacccctttttgtgggaaaacccccccgggaaaaagtgggccccccccccaaaaaaaaaaaatatcttcttttgtggcgcccccgcagaaaccccccccccgggggcggcgccgctccccttttttataaagggcccccccccccccctcttttttttttttgaaattacccccccctcccccccccaaaaaaaaaagggcccccccgtcgggggggtgtttttttttttacccaccccccgtgggtacgcgcccacaaaaatacacccccgcaggacttttgcgtaatcacataaaatattttttttctacacaaaaaaaaaaa

SEQ ID NO: 55747 - DNA, 654 bp, Zea mays
  misc_feature: Ceres CLONE 1490847
  misc_feature: Encodes the peptide sequence at SEQ ID NO. 55748
catagctggagctccccgcggtggcggccgctctagaactagtggatcccccgggctgcaggaattcgcacgagaccattacctagaacatcctaatcgaaaagatcgatctccaccgttccttctcccctctcctaatgtcagccgtgcagcctctccactgcgcccacttcttatactcccaccttctgctccctctcacggacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtatgagccgttcgatgaggacttcgagggaagatggatcgtctccaagaaggatgaataccaaggtgtatggaagcatgccaagagtgatgggcatgaggactatggtctccttgttagtgacaaagcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacactat

SEQ ID NO: 55748 - protein, 130 aa, Zea mays
  misc_feature: Ceres CLONE 1490847
  misc_feature (24)..(130): Pfam Name: Calreticulin Pfam Description: Calreticulin family
MMGGRALLLLLVSALLVQIRASDPLLYEPFDEDFEGRWIVSKKDEYQGVWKHAKSDGHEDYGLLVSDKARKYAIIKELDEPVTLNDGTVVLQFEVRLQNGLECGGAYIKYIRPQDAGWDAKEFDNETPYT

SEQ ID NO: 55749 - DNA, 698 bp, Zea mays
  misc_feature: Ceres CLONE 1490852
  misc_feature: Encodes the peptide sequence at SEQ ID NO. 55750
caaagctggagctccccgcggtggcggccgctctagaactagtggatcccccgggctgcaggaattcgcacgagaccattacctagaacatcctaatcgaaaaattccaggtgtgtctagtctcgagtctagctaggcactactctagctcccaagtggtcaagtatactcgccagagtacgtagagtgtagttgagcgtcgtccaaggatggcgtggacctcccgccgcatggtcgcgtccgcgctcgtcttcctgctgatgctgctcgccgcctcagagatggggacgacgagggtggcggaggcgaggcactgcacgtcgcatagccaccggttcgtcggcgcctgcatgagcaagagcaactgcgagaacgtctgcaggacggagggcttcccgtggggcaagtgcaggtggcacggcataaagcgcaagtgccactgcaagcggatctgctaataattaactagccggctggccagcgcatgcatgcacgacgaccgacctacctgctgctggtccgtttgcgtttgtttcttgtcctttgggccttgctgtggcgcgcagtcttgcgtacctgcgtgtgcgtgtgtcatttcagttactctcaattagacatagcagacgtgcgtgggtgcaagagtgtgtctcgttgcattgatgaaccggcttcacgtgctgtgcgtttacagtttctga

SEQ ID NO: 55750 - protein, 82 aa, Zea mays
  misc_feature: Ceres CLONE 1490852
  misc_feature (34)..(82): Pfam Name: Gamma-thionin Pfam Description: Gamma-thionin family
MAWTSRRMVASALVFLLMLLAASEMGTTRVAEARHCTSHSHRFVGACMSKSNCENVCRTEGFPWGKCRWHGIKRKCHCKRIC

SEQ ID NO: 55751 - DNA, 729 bp, Zea mays
  misc_feature: Ceres CLONE 1490854
  misc_feature (1)..(1): n is a, c, t, g, unknown, or other
  misc_feature (122)..(122): n is a, c, t, g, unknown, or other
  misc_feature (339)..(339): n is a, c, t, g, unknown, or other
  misc_feature (396)..(396): n is a, c, t, g, unknown, or other
  misc_feature (449)..(449): n is a, c, t, g, unknown, or other
naaagctggagctccccgcggtggcggccgctctagaactagtggatcccccgggctgcaggaattcgcacgagaccattacctagaacatcctaatcgaaaaatgtttgatgtcacttcgnaaggctgacatacaagaatgttccaacatggcacagggacctgtgcagggtgtgtgagaacatccccatcgttctctgcggaaacaaggttgatgtaaagaacaggcaggtcaaagccaagcaagttacattccacaggaagaagaacttgcagtactatgagatttctgccaagagcaattacaactttgagaagcccttcctttacctcgcaggnaagctggcaggggatcagaaccttcactttgtcgaagccgttgctctgaagccaccngaagtgcagattgatatggccatgcagcagcagcatgaagctgagctttgaanctgccgctgcccaccccctccctgatgacgatgatgacctgatccaattgattgtcccatggccctggtttaatcccagggggaaagccttttttacaaaaccgggggggtttcaattcttgtccggccataacccaacggaatttttcctgttatttacaccgctttttacaaaaggtttttgggggaccccctaattttgggaaaacaccccttttggccggccgattttttttcacttaaaaaaaaaaaaaaaatttttttaccccccccccccccc

SEQ ID NO: 55752 - DNA, 632 bp, Zea mays
  misc_feature: Ceres CLONE 1490855
  misc_feature: Encodes the peptide sequence at SEQ ID NO. 55753
caaagctggagctccccgcggtggcggccgctctagaactagtggatcccccgggctgcaggaattcgcacgagaccattacctagaacatcctaatcgaaaaattcgatccgttcccttgccctaagacccacccctgatttcatttccccaatcatggcggcggctctgtcggggacggcggtgtccacggcagcgcttctagccccaatccgagctccaaccagcgcgtttatccggcgctcccagctcacctgtcatcgcctccactcactaaaatgccgccgcgctgggcccatcgtccccgcggccgctgctgccgcggcgggcagcagctcgccgtcgtcagccgttttccacggcgagtgcttcgtggtgggcgacaatatcgacaccgaccagatcatccccgccgagcacctcactctggtgccctctaaagcggacgagtacccgcaaagctcggtcctttcgcctttcgcgggggctcccattcccggggggcttatccccaaaaacccctttttgtgcctcccccggggggagaaccccccccccaccccccacatattttggggggggaggaacacacatttggggggggggggggggtccccccccccggagaggag

SEQ ID NO: 55753 - protein, 158 aa, Zea mays
  misc_feature: Ceres CLONE 1490855
MAAALSGTAVSTAALLAPIRAPTSAFIRRSQLTCHRLHSLKCRRAGPIVPAAAAAAAGSSSPSSAVFHGECFVVGDNIDTDQIIPAEHLTLVPSKADEYPQSSVLSPFAGAPIPGGLIPKNPFLCLPRGENPPPTPHIFWGGRNTHLGGGGGSPPPER

SEQ ID NO: 55754 - DNA, 687 bp, Zea mays
  misc_feature: Ceres CLONE 1490861
  misc_feature: Encodes the peptide sequence at SEQ ID NO. 55755
aagctggagctccccgcggtggcggccgctctagaactagtggatcccccgggctgcaggaattcgcacgagaccattacctagaacatcctaatcgaaaaaccaggcaccagcatagatctcgtgctcgacactattattctgcacagcaacgcatcagccttctggaaccatctcgccgccgccacaccacaatccacaacccgtcgaagcgaagcaagcaatggccggagtcggatcgaaggccctcgccgttgccgccgttctggcggccgtctccttctcggtggccgccgcggccgaggcgcccgcgcccagccccgtctccgccgccgtcgcggcgtcgtcgcccttcgccgccgtccgccactgagccgatggggcctcgtgcctgcaggctacctagcagtacttcccccgccgccgccgccgccgcctagatctatttattggagtgctatccagtagtactagtagtagtgagatttgttcggtgctgtcgtgtcgtcgtcgcattttggtcggatctggtttccttggtgcagggagggtttctataccatgtcgcggtgtcggttgtgtgatctcatcccccccttgtagatagtactctgctatctcgtcgtgatcgtgagtggtgattctgtctggttgatatttgctactgatattggtcccatttgagaa

SEQ ID NO: 55755 - protein, 49 aa, Zea mays
  misc_feature: Ceres CLONE 1490861
MAGVGSKALAVAAVLAAVSFSVAAAAEAPAPSPVSAAVAASSPFAAVRH

SEQ ID NO: 55756 - DNA, 679 bp, Zea mays
  misc_feature: Ceres CLONE 1490867
  misc_feature: Encodes the peptide sequence at SEQ ID NO. 55757
caaagctggagctccccgcggtggcggccgctctagaactagtggatcccccgggctgcaggaattcgcacgagaccattacctagaacatcctaatcgaaaagctttcttgccagtaacccatccacccatccatcggggatcaccaggggtcaggggagcaagatgtcgactgccaccgccccaagattgcccgctcccagatccggggcaagctatcactatcagacgaccgcggctccggcggccaacaccctctccttcgccggccacgcgaggcaggcggcccgcgcgtccgggccacggctgtccagcaggttcgtggcgtccgcggcggccgtgctgcacaaggtgaagctggtcggcccggacgggacggagcacgagttcgaggcccccgacgacacctacatcctcgaggcggccgagaccgccggggtggagctgcccttctcctgccgcgccgggtcctgctccacctgcgccgggaggatgtcggccggcgaggtcgaccagtcggaggggtccttcctcgacgacggccagatggccgaggggtacctcctcacctgcatctcctaccccaaggcagactgcgtcatccacacccacaaggaggaggacctgtactagagattgggttgctttatgcatcagtggttgctccaaaggtggtggt

SEQ ID NO: 55757 - protein, 155 aa, Zea mays
  misc_feature: Ceres CLONE 1490867
  misc_feature (66)..(142): Pfam Name: Fer2 Pfam Description: 2Fe-2S iron-sulfur cluster binding domain
  misc_feature: SWISSPROT Homolog: EC 1.18.1.3 Ferredoxin--NAD(+) reductase
MSTATAPRLPAPRSGASYHYQTTAAPAANTLSFAGHARQAARASGPRLSSRFVASAAAVLHKVKLVGPDGTEHEFEAPDDTYILEAAETAGVELPFSCRAGSCSTCAGRMSAGEVDQSEGSFLDDGQMAEGYLLTCISYPKADCVIHTHKEEDLY

SEQ ID NO: 55758 - DNA, 692 bp, Zea mays
  misc_feature: Ceres CLONE 1490868
  misc_feature: Encodes the peptide sequence at SEQ ID NO. 55759
caaaactggagctccccgcggtggcggccgctctagaactagtggatcccccgggctgcaggaattcgcacgagaccattacctagaacatcctaatcgaaaaattacaaccgaccaacgcgctttgtaacgcctccgctgcaatcagcccccgcggcgagcttgccctgcccctgattgctagttctcgccgttacgtaaggcttcttggccttgcgtcctccgtctttcgttgctgatacatcgaggcatggcgatttatcggtccaacggtgacgccggctccgtcgctttcgtcgtggtatcttatctcgacctggtggccctgttcgcctgcttgcgctactacgagcagttggatcagcagcactcccaaaagcgcgcgagggtcaaggctggggtttggagcctcacgaccctccttactatcatgttcagttacaaggtggctgagattatgcccctgccagtcaaacttgttgtctggtcgatggcagccgctaccacctgtggcggcttctacgttttcttcgtccacagcgagaagcctgtcatgccagcggtggcgccacggcccgccgcggccaaggatgcagcctccaactaggttcgtttgccaccacaaggcgcatactgccggccttggttcggcaccgcgcgttagatcccagggccaactagcttgccggcgt

SEQ ID NO: 55759 - protein, 118 aa, Zea mays
  misc_feature: Ceres CLONE 1490868
MAIYRSNGDAGSVAFVVVSYLDLVALFACLRYYEQLDQQHSQKRARVKAGVWSLTTLLTIMFSYKVAEIMPLPVKLVVWSMAAATTCGGFYVFFVHSEKPVMPAVAPRPAAAKDAASN

SEQ ID NO: 55760 - DNA, 774 bp, Zea mays
  misc_feature: Ceres CLONE 1490872
  misc_feature: Encodes the peptide sequence at SEQ ID NO. 55761
  misc_feature (225)..(225): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (317)..(317): n is a, c, t, g, unknown, or other
  misc_feature (318)..(318): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (326)..(326): n is a, c, t, g, unknown, or other
  misc_feature (327)..(327): n is a, c, t, g, unknown, or other
  misc_feature (332)..(332): n is a, c, t, g, unknown, or other
tggaggggggggggaatcgggtggggtgggtgcggcttttgatcttctcaaaatggaggtcccccccgtggcggccgctcttcaatagcggatcccccccgctgcatgaattcgcacgagaccattacctacaacatcctactcgaaaaaagctttacacgctctccctcccacttcgtgcgagcgtcccgaactaagttgctcgtggtggaggtggtttgtggngatgggcttcaggctggtcaccnnnnccnnnnnnnnnnnnnnnngctggtgctcactgtgttatatctctcccgggggccgcccggnnnaanncnnnnttnncttcngaccatcacccaaaaacaaggggctccccccggccaacaactccgcaactcccatggctaaagaagaaagggttgatcgaactgcaatattgccgttggaaagcatcagacaagttttgattataatagataacaacagcacatttggacttgtggagagagcacagttttgttacaacgctgacacatatgataagcaatgctttccaccgggaatggctttggaaggggccttggcctgcacatctgggttaggggaaactgaaaagcccccatgcaccacggttggggagggacaagaaccccttgatgaacccccctttccttttccaaaggattctggctggaaacccaatttgcgcccctatggcaaataccccagggggttttagcacccccatggggtggatccctcaccattacccccaaaaaagatttgtga

SEQ ID NO: 55761 - protein, 112 aa, Zea mays
  misc_feature: Ceres CLONE 1490872
  misc_feature: SWISSPROT Homolog: EC 5.4.99.5 Chorismate mutase
MAKEERVDRTAILPLESIRQVLIIIDNNSTFGLVERAQFCYNADTYDKQCFPPGMALEGALACTSGLGETEKPPCTTVGEGQEPLDEPPFPFPKDSGWKPNLRPYGKYPRGF

SEQ ID NO: 55762 - DNA, 700 bp, Zea mays
  misc_feature: Ceres CLONE 1490881
caaagctggagctccccgcggtggcggccgctctagaactagtggatcccccgggctgcaggaattcgcacgagaccattacctagaacatcctaatcgaaaaacccacacatccgacgccgaggaagtaggaagcacgagcagcatatgtcacagagggccagcgtcccacacttctcctgcatagccttcgcgctccattcccatctcctggtctccagtgagatgtgccccagctcctattggcagcaatagctattctccgccttccttttttttttcttcttcttcctttcctcccgtctggatttcgtttccgtttgatcgagctggctctcagcttccgtttttagttttgttggcatctttgctctcggatccgtctctccctaactcctgaaacccaaaaggagagaagaaaccgggcaagcaagcgatgggtgtcaagggattcgtcgagggcggcatcgcctccatcgtggccggctgctccacccacccgctggacctcatcaaggtccgcatgcagctgcaggggggaggcggcggccgccgtggcgccgcagccggcgctgcgcccggcgctcgccttccacgccgggggccacgccgtcgcgctcccgcaccaccacgacatcccggcgccgccgcggaagcccgggccgctggccgtcggcgcgcagatcctgcggtccgaggg

SEQ ID NO: 55763 - DNA, 677 bp, Zea mays
  misc_feature: Ceres CLONE 1490885
  misc_feature: Encodes the peptide sequence at SEQ ID NO. 55764
  misc_feature (399)..(399): n is a, c, t, g, unknown, or other
  misc_feature (424)..(424): n is a, c, t, g, unknown, or other
  misc_feature (425)..(425): n is a, c, t, g, unknown, or other
aaagctggagctccccgcggtggcggccgctctagaactagtggatcccccgggctgcaggaattcgcacgagaccattacctagaacatcctaatcgaaaaaaaacgctcaaacagacaggaagcccgccgaacatcacaaggccgcgaacctcctagaagctcgaggagatgctgctctccaagctgtcggcgtggttcgtgaacccgcggaggaatccgctcgcgcgtctccaccggaacgccgtcgcctcccgcctccgcaatacgggctccggtatgacgacctctacgacccgtaccacgacctagacatcaaggaggcgctggcgcggctgccgcgggaggtggtggacgccccgtaccagcgcctcaagcgggccatggaccctctcatgnaagcacagtacctacccgacgacgnntcagctatacagacgccattcaggagctacctttttgacatgcttgctcttggtgaaaaagaaagcgcaaagcgtggaccattggggagcccttccacctctaccaaagaacctcccataaaggggccctttgcctgatccacccaaagtgcccgcaatgtatcccaaagccgaaccggaaaggggattggggttttccaagggaactctcctcctttttaaaccaatagggggccccggccttcaaaatta

SEQ ID NO: 55764 - protein, 59 aa, Zea mays
  misc_feature: Ceres CLONE 1490885
  misc_feature (6)..(6): Xaa is any aa, unknown, or other
  misc_feature (14)..(14): Xaa is any aa, unknown, or other
MDPLMXAQYLPDDXSAIQTPFRSYLFDMLALGEKESAKRGPLGSPSTSTKEPPIKGPFA

SEQ ID NO: 55765 - DNA, 687 bp, Zea mays
  misc_feature: Ceres CLONE 1490889
  misc_feature: Encodes the peptide sequence at SEQ ID NO. 55766
caaagctggagctccccgcggtggcggccgctctagaactagtggatcccccgggctgcaggaattcgcacgagaccattacctagaacatcctaatcgaaaacctagaagccaccctgccgcctcaccgcctctctcactctgagaccgcagatccgttgtccggtgagtggaagccgcacgaacccatggcctccggcgagcttgcctgcacctacgccgctctcatcctcagcgacgatggcatcgccatcaccgccgagaagatcgccacgatcgtgaaggcagccaacatcaaggtcgagtcctactggccggcgctcttcgccaagctcctggagaagcgcaacgtcgaggacctcatcctctccgttggatctggtggcggagctgctccagttgctgctgccgcccctgctggtggtgctgcggccgcggctgccccggctgtcgaggagaagaaggaagaggccaaggaggagtctgatgacgacatgggcttcagcctgttcgactgaggagacccctcgcccccagccattagcaaatttcacttgtgctgtccaagactatcttgtcttatgttatgtctctaggcttttgttacaactacccaagttttgagtttttgagacgtggctatggcaatgtgacgatgaactcaaaccatcttatgagggtcaaaaa

SEQ ID NO: 55766 - protein, 109 aa, Zea mays; identical to SEQ ID NO: 48282
  misc_feature: Ceres CLONE 1490889
  misc_feature (21)..(108): Pfam Name: Ribosomal_60s Pfam Description: 60s Acidic ribosomal protein

SEQ ID NO: 55767 - DNA, 810 bp, Zea mays
  misc_feature: Ceres CLONE 1490897
  misc_feature: Encodes the peptide sequence at SEQ ID NO. 55768
  misc_feature (35)..(35): n is a, c, t, g, unknown, or other
  misc_feature (39)..(39): n is a, c, t, g, unknown, or other
  misc_feature (40)..(40): n is a, c, t, g, unknown, or other
  misc_feature (45)..(45): n is a, c, t, g, unknown, or other
tttgggccaccacactccgccgcgggcccaccccnaccnnttttntttttcaaagctggagctccccgcggtggcggccgctctataactagtggatcccccgggctgcaggaattcgcacgagaccattacctagaacatcctaatcgaaaaaaaaattcattccgcacggcatccgggaaggtctgcgtcgtcgccatggccaccgaggaagtcgccaagccgtccccgatcccgccctaccccgagatgatcctggcggcgatcgaggacttaggcgacaagagcgggtcgaacaactcggccatctccaggtacatcgagggcaagtacgacggcgacctgccgcccgcgcacgcgtcgctgctggccgcgcacctggcgccgcatgaaggagtcgggcgagctgggcttcgtcaagaaaaactacttccgtgacaacgcgcccgacgcgccggtcgaagcgcgggccccccccctctccctgaaaggagcgggaacccccggcggcgctggtgcccgcccccttcggggaggggggcgcggggggcgcgcccatagcccagggacccctttatggaacgcgcgcggggaagacgggcccccgccggccatgccccagggtcccggcggccgccccgccccatcaagggcccaagaaccgagggggtggggggtacccccggcgcccccgcccggctgaacgggctcccgcccccccgatacaagcgcaggccctgccggcacagccccccccgaagaggagccggcccccggtgccgtagacccacaaggaagaacaaggcgccc

SEQ ID NO: 55768 - protein, 79 aa, Zea mays
  misc_feature: Ceres CLONE 1490897
  misc_feature (13)..(80): Pfam Name: Linker_histone Pfam Description: linker histone H1 and H5 family
MATEEVAKPSPIPPYPEMILAAIEDLGDKSGSNNSAISRYIEGKYDGDLPPAHASLLAAHLAPHEGVGRAGLRQEKLLP

SEQ ID NO: 55769 - DNA, 785 bp, Zea mays
  misc_feature: Ceres CLONE 1490898
  misc_feature: SWISSPROT Homolog: EC 2.7.11.1 Non-specific serine/threonine protein kinase
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
ttaattgtcctcccgccacgccacccaaaatannnnnnntnnnnnnnnaaaaactggagctccccgcggtggcggccgctctagaactagtggatcccccgggctgcaggaattcgcacgagaccattacctagaacatcctaatcgaaaatctcggagtgagctccccaccaccacctccgtccccaaatgtcccgtcaccatcaccacgccgccgccatcgctgctgccgtgctcttcctcctcacagcgcctccttgcgccgccgaccctaacgacgagcgttgcctgactcacctccaccagtccctctccgattcctccggaaggctcaactggaccaaggcggcgatctcggcgccgtgcgacggcttcttctcgcacctccaaggcgtgacctgcaacaaacgggcgcgtgtacaaactagacctcccggatctctcgcttgggggaaccgtcccgccggaactctccaattgcaccaacctccagcccctggacctgtccccgaacgcgctgtccggcgccataccgacggagctctccgcgcttctgaaccttcgccgtggttcaacctctccccgaaacgcgcatctctggggccatccccgcgggaagattccctaggctgcgccctaccctcaaccgcattaaattttcccatggcaaaccaagctgttccgggccccctccccccaaaaaaaacccgggccctccctcgtgccgggtttcctcgaaaccattcaaagttcttacctaacaaaccgaccttttttttggggcc

SEQ ID NO: 55770 - DNA, 698 bp, Zea mays
  misc_feature: Ceres CLONE 1490904
  misc_feature: Encodes the peptide sequence at SEQ ID NO. 55771
aagctggagctccccgcggtggcggccgctctagaactagtggatcccccgggctgcaggaattcgcacgagaccattacctagaacatcctaatcgaaaaaaagcctccgacccccttcctctctccctccgccgccgctgcgcacgcagggaacaagcgacatgggcgtctacacctttgtgtgccgcaacaacggcggcgagtggaccgccaagcagcactccggcgagatcgaggcttccgccgctaccccatacgagctgcagcgccgcctcgtcgccgccgcctccgcggccgactctgcctacggcgtccagtcgtccttctccatggtcacccccagctccgccgtgttccaggtgatcgtcggtgctgtcggtggtggtgcaatgatggtgagcggaggtggcggcggcggcggtgctgctgcatctggtggtgctgctgccgaggctcccaaggaggagaagaaggaagaggagaaggaagagagcgacgacgacatgggattctccctgttcgactagagttgtgtgtgtcatctggatctcagaggtggtggtttggtcctgttgccgtagttaattttgctgtcctgtctgtgaacctgaagaactcttgggtaattgttacaaagccaacctgttcccattttagtggaaaaaaatttgaaaattttgggtttggggagaaaaa

SEQ ID NO: 55771 - protein, 121 aa, Zea mays
  misc_feature: Ceres CLONE 1490904
  misc_feature (41)..(120): Pfam Name: Ribosomal_60s Pfam Description: 60s Acidic ribosomal protein
MGVYTFVCRNNGGEWTAKQHSGEIEASAATPYELQRRLVAAASAADSAYGVQSSFSMVTPSSAVFQVIVGAVGGGAMMVSGGGGGGGAAASGGAAAEAPKEEKKEEEKEESDDDMGFSLFD

SEQ ID NO: 55772 - DNA, 789 bp, Zea mays
  misc_feature: Ceres CLONE 1490905
  misc_feature: Encodes the peptide sequence at SEQ ID NO. 55773
  misc_feature (12)..(12): n is a, c, t, g, unknown, or other
  misc_feature (23)..(23): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
gggggcgcgctnccccccccccnccctttaaatnnnnnnggtaannnnnntcaagctgggactccccgcggtggcggccgctctagaactagtggatcccccgggctgcaggaattcgcacgagaccattacctagaacatcctaatcgaaaacacatccaaaattcccagtccgcgatacaagaccaatccaatccaatccaatcccagcggaagtggaagcagcttcatttccttccttgcagctagcagcgatgattcttgtggcgatagtggcggagctgctcgaggagtacaccgcgctggtggcgcgggtgctggagcagctgctcaacgacgcgccgttcccgcgccggatgcgcttcctcatgctgcggagcctccccttcgtgccgccgcctctgcccccgccgccgccgccgcacgccctccacgttaccacccgagtctgattattggctccattttttcccacgggtttcagcctactgcccgccatggccgcccaccccactaacctgcgcttgaggcagctagaaatagatactgtaaggtgaccagtgatcaccgggggggttctcgcttttcctttggccggtggaatctcaatggggtaaaccaacacggggctggaaaaggaaccaataagatcccgccctttgaagccaccaaattgaggggataaaaatttttggaaaacaaggggacccgggggagaaaacccttttccgtgtggaaaggaatagagaaaaacgtaagaggtctctctcggagcaccgggcgaccacc

SEQ ID NO: 55773 - protein, 65 aa, Zea mays; identical to SEQ ID NO: 44442
  misc_feature: Ceres CLONE 1490905

SEQ ID NO: 55774 - DNA, 677 bp, Zea mays
  misc_feature: Ceres CLONE 1490915
  misc_feature: Encodes the peptide sequence at SEQ ID NO. 55775
  misc_feature (663)..(663): n is a, c, t, g, unknown, or other
aaagctggagctccccgcggtggcggccgctctagaactagtggatcccccgggctgcaggaattcgcacgagaccattacctagaacatcctaatcgaaaaaagccgcgccgccggcgcggtcctttgtaaaggcctcgcggcacgggagcggcctgcgctccctctctctggattaggcaaagcatcctcctgtttggatcggcatggagaagacgacgacgacggcgcagccggtctgcgcgcaggagtcgctggctctgctcaactgcgtcgcctcggtcccctacgaccgggataggtgcctcgccctcgtcgacgccctccgtgaatgcatcgtgcgcaagagggtgaagaagttttcgctggcagaaccaagctccaccacaaccaccgaagctctgaagagcgatacgaagccctgagcattctgcaaagaaaactgtatcatctgattgggcgcggttgatgataagtctatgcctgttaatgtagcgttagatttgtacttttgaacccatgccagatgtacttgtgccagaaatcaccaatctgttgaactgaaaacgttacccgatgtccacacaaatgatacagtccatgatgccatttcgataagaaaggcaccatccatccaaggttttctaacattttgctgcgctngtgcttgaccgatg

SEQ ID NO: 55775 - protein, 72 aa, Zea mays; identical to SEQ ID NO: 44321
  misc_feature: Ceres CLONE 1490915

SEQ ID NO: 55776 - DNA, 614 bp, Zea mays
  misc_feature: Ceres CLONE 1490925
aagctggactccccgcggtggcggccgctcagaatagtggatcccccgggctgcagattcgcacgagaccattacctagaacatcctaatcgaaaatctgcggtttcttccacgcaccaatcatttcggccacactgcacacggacgaaactcgctcgtccttcgcctcagcagcagccgatccgtatccagttcccgtgccgtgcccaccagggggaacccgatcgatgggaaactgctgtctcgagaagccctcgtcgcggtggcaacggcaagtgcgggcctccgtgcaaaacccccagaacgaaaccccgggggggttggaggaaagggaaggaaggaaggcttgcaaagggcaaaagggaaaggggccccggcccaccctccccggggggggcgccccgggggggaaaaaaccgggaccccctggaaccccccccggaaaaaaactccctccccgcccgcaaaaaaagaaagcaaaaccccccgcgccggggggtttctcaaaaaaacccccccccccacaaaaaaaatttttcctcccaagagaaatcccctggggtgggggggggggggcccccaaaaataaaatcccccccacaaaattttgcggg

SEQ ID NO: 55777 - DNA, 693 bp, Zea mays
  misc_feature: Ceres CLONE 1490926
  misc_feature: Encodes the peptide sequence at SEQ ID NO. 55778
  misc_feature (678)..(678): n is a, c, t, g, unknown, or other
  misc_feature (693)..(693): n is a, c, t, g, unknown, or other
aagctggagctccccgcggtggcggccgctctagaactagtggatcccccggtctgcaggaattcgcacgagaccattacctagaacatcctaatcgaaaagccgacaaaattactaggtgcttaatttaactactagtggccctaggcgtgaaacttcaccagctccgccactgcccatggccaacggccgtccggaccctcgctgcgtcgtcctcaccgccgacactgcccgatccctcgtagattccgtcgacgccttcctcttcgactgcgatggggtcatttggaagggagataagctcattgaaggggtcccagagacgatggagctactgaggaaactgggaaagaaattagtttttgtaacaaacaactctagaaagtcgagaaggcaatactcaaagaaattcagatcacttggacttgaagttactgaggaagagatttttacatcatcgtttgcggcagccatgttcttgaagttaaataattttcctccagaaaagaaggtttatgttgttggtgaagatggaatcttggaagagctcaagttagctggttttgaatgttttggtggtccggaagatggcaagaaaacataaagttggaggcggatttctactttgaacatgacaaaagtgtatgcaagaacatgtattagtgagaaccctgactngcttttcattgcgan

SEQ ID NO: 55778 - protein, 141 aa, Zea mays
  misc_feature: Ceres CLONE 1490926
  misc_feature: SWISSPROT Homolog: EC 3.1.3.41 4-nitrophenylphosphatase
MANGRPDPRCVVLTADTARSLVDSVDAFLFDCDGVIWKGDKLIEGVPETMELLRKLGKKLVFVTNNSRKSRRQYSKKFRSLGLEVTEEEIFTSSFAAAMFLKLNNFPPEKKVYVVGEDGILEELKLAGFECFGGPEDGKKT

SEQ ID NO: 55779 - DNA, 684 bp, Zea mays
  misc_feature: Ceres CLONE 1490935
  misc_feature: Encodes the peptide sequence at SEQ ID NO. 55780
tggagctccccgcggtggcggccgctctagactagtggatcccccgggctgcaggaattcgcacgagaccattacctagaacatcctaatcgaaaaattttccgcgcggaaaatgccgccgtttcggccggctcttggaagggcgcttcttctgtaggaccgcggcgcgaggctgcgatggcgttcgccgccagcgagggaaatctttccccggcgctgcccctggccactctgatcggccgcgagctccgcggcgacggtaccgagcgcccgcacgtgcgctacggccactctggcttcgccaagcgcggcgaggactacttcctcgtcaagcccgactgcctccgcgtccccggagacccttcctcctctttctccgtcttcgctgtattcgacggccacaatggcgtgccggcggcggtgttcagcaaggagaaattgctggagcacgtgatgagcgcggtgcccgaggccatcagtcgcgaggactggctacaggcgctgccgcgcgcgctcgtcccaggattcggcaagaacgacttggacttcagcgcaagggtgaaacctcaggaaacaacggcaacctttgttggggttaaagggttcccggcccctggggcccccgggggaaaaattctagggggcttcggggaacacccggggaggggagggtctcttttggtg

SEQ ID NO: 55780 - protein, 169 aa, Zea mays
  misc_feature: Ceres CLONE 1490935
MAFAASEGNLSPALPLATLIGRELRGDGTERPHVRYGHSGFAKRGEDYFLVKPDCLRVPGDPSSSFSVFAVFDGHNGVPAAVFSKEKLLEHVMSAVPEAISREDWLQALPRALVPGFGKNDLDFSARVKPQETTATFVGVKGFPAPGAPGGKILGGFGEHPGRGGSLLV

SEQ ID NO: 55781 - DNA, 757 bp, Zea mays
  misc_feature: Ceres CLONE 1490944
  misc_feature: Encodes the peptide sequence at SEQ ID NO. 55782
  misc_feature (13)..(13): n is a, c, t, g, unknown, or other
  misc_feature (14)..(14): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (38)..(38): n is a, c, t, g, unknown, or other
  misc_feature (55)..(55): n is a, c, t, g, unknown, or other
  misc_feature (446)..(446): n is a, c, t, g, unknown, or other
  misc_feature (668)..(668): n is a, c, t, g, unknown, or other
  misc_feature (727)..(727): n is a, c, t, g, unknown, or other
aaaatagaattannaannnnnnatactaccagccgtgnaatcgagacgaaagcanaagaaaaacgggacctccacgcggaggcggccgctctagaactagtggatcccccgggctgcaggaattcgcacgagaccattacctagaacatcctaatcgaaaaataaacctccacctcgccggcggccatggcgttctccggcaggatccaggagctcgtgaggaagtatggcaaggtggccatttgcgtccacctatccgtctcctgcgcctccatcgccggcctttacgtcgccatcaacaacaacgtcgacgtcgaagccgttttccggaggttcggtatctcccccggcgttaccgtaggcggcgaggcctcacccgcccccgtttcccgcgatgaacacctgcgcgacgtccccctgccgcccatggccaacgaggtactgcnagaaaagacggagcgagagcggtagccccgctcccccaccatggagctcgtggcgtcaagtggcggcgcgttcgcgctcactgtcgtcctgcaaaaagcactattccccgtgaggggccccatcaccataggagctcaacacagcccggtcgccggggccctaaaacgcctgggaggctcgccagacacctgaactggggtttttttccgtcccaacctgcnactggaaaaaaacccgcgcgtcccaccacaccaagaaaaatccggaaaaaaagaaacancgcacccccgaaatacacaacaccaaagat

SEQ ID NO: 55782 - protein, 94 aa, Zea mays
  misc_feature: Ceres CLONE 1490944
  misc_feature (87)..(87): Xaa is any aa, unknown, or other
MAFSGRIQELVRKYGKVAICVHLSVSCASIAGLYVAINNNVDVEAVFRRFGISPGVTVGGEASPAPVSRDEHLRDVPLPPMANEVLXEKTERER

SEQ ID NO: 55783 - DNA, 682 bp, Zea mays
  misc_feature: Ceres CLONE 1490948
  misc_feature: Encodes the peptide sequence at SEQ ID NO. 55784
tggagctcaccgcggtggcggccgctctagaactagtggatcccccgggctgcaggaattcgaacgagaccattacctagaacatcctaatcgagaactcccagaaagggaggccgaactgagaaattattaccaatgagccatccaactccaaccccacttcgactgcacaaatcggtaccatcccagagagaaagatgagggcgcgtctccaaagcccagaagcagaagggcgcccagcccacctccgcgctcatgagcaccgacaccaggaccgccactcagaggaagggcgaggacgaccgccccgtgcgcgtctacgccgacaggatcttcaatctcttccacttcggccacgcccgcgccctctagcaagccaagatgctgttccccaacacctatcttctcgtcggatgctgcaacgactagctaacctaccgctacaagggcaagaccgtcatgacccatgaagagcgatacgaatccctgcggcactgcaagagggttgatgatgtcattcctgatgcaccgtgagttctcacacgggagtttattgataagcagcatagtgactatgttgctcatgatgagctgccttatgctgatcgagaggaacagctaatgatgtctatgaatttgtgaaccagattggaaaattcgatgaaagccaagagactgacgg

SEQ ID NO: 55784 - protein, 38 aa, Zea mays
  misc_feature: Ceres CLONE 1490948
  misc_feature: SWISSPROT Homolog: EC 2.7.7.15 Choline-phosphate cytidylyltransferase
MSTDTRTATQRKGEDDRPVRVYADRIFNLFHFGHARAL

SEQ ID NO: 55785 - DNA, 677 bp, Zea mays
  misc_feature: Ceres CLONE 1490953
  misc_feature: Translation starting site: 263
tggagctccccgcggtggcggccgctctagaactagtggatcccccgggctgcaggaattcgcacgagaccattacctagaacatcctaatcgaaaaattgctccccttcgttcacctcgcgtacgcgacaaactaggccgaccgccgccgccctacgctcagctgcccacctgccctggtcttcgactcttcgtcgtgcgctttgccggcggcgagcacccatcacaccaggtgctttattgggtccgtccatacggcaggatggcgctaaggggggtctggcagctgcagaagctcgtggtaaactactgcgactggggagggagcagcaggggcatcagggccttcatggaggcacatcttccagcctttaaggaaaagaatctgacacttagaggtggtgacagagctcgcccccggtcaacatcctaacttgaagggaatttacaaaaaccataacgagcgagtggtatgcgtgagaaatttaccgccagaggaaatactcctgcaagccaccaggctaaggaactctctgggcaagaaagtggtgaagctgcggaccagacatgtaacgaaacgccccagtgttcaggggacgtggacgacggaactgaagatgtgaagcaaccagccaaggtgtttcattggtctttggagggctgaattgcaaaaatga

SEQ ID NO: 55786 - DNA, 706 bp, Zea mays
  misc_feature: Ceres CLONE 1490960
  misc_feature: Encodes the peptide sequence at SEQ ID NO. 55787
tggcggccgctctagaactagtggatcccccgggctgcaggaattcgcacgagaccattacctagaacatcctaatcgaaaaacagccgccgccgccgacgacgacgacgacaccgacgcatctctcagcctccccgcactcgcttccgtcgccgcagccgccgccgccgccgccgcttcgcagccatgggtaaggtgcacggatcgctggcccgcgccgggaaggtccgcgggcagacgcccaaggtggcgaagcaggacaagaagaagaagccccgcggccgcgcgtacaagaggatgcattacaaccgccgcttcgtcaccgccgtcgtcggcttctgttaaaagcccgcgcccaacgcggggcgagaaatatgtcccccaccgaggtggcgacgccccccgggatcgcaaagccaatgcctaatgcgcttgcccctcccggggtagaaattttccttttgggaccagcaaaagaaaaacctttttttggggtcccaatccccattttcgaagaaaaacttgaagattaattggcgaccccccttacataattaagggccaaagttttctaaaatatgatggaaacgcggggaaaaaaactcctgggcccctaaaacaaaaaagaagactgttctttcggtcccggcccctcacacattgggaggccccgcgtaccactagtccaccccatatccgatcctca

SEQ ID NO: 55787 - protein, 52 aa, Zea mays
  misc_feature: Ceres CLONE 1490960
  misc_feature (3)..(53): Pfam Name: Ribosomal_S30 Pfam Description: Ribosomal protein S30
MGKVHGSLARAGKVRGQTPKVAKQDKKKKPRGRAYKRMHYNRRFVTAVVGFC

SEQ ID NO: 55788 - DNA, 715 bp, Zea mays
  misc_feature: Ceres CLONE 1490965
  misc_feature: Encodes the peptide sequence at SEQ ID NO. 55789
tggagctccccgcggtggcggccgctctagaactagtggatcccccgggctgcaggaattcgcacgagaccattacctagaacatcctaatcgaaaaatcggtagcatcgacacgagcgggacgagcatgctggacgagctcaacaagtccttggacaggaggggaatgcaggtaaagagcagaagcgatggcacatccatccacctgattcagtgctttaattatctgctctcaactccagcagagtgttctgaaaccagtgctgtctttcttttgttcgcagatcgtgctggcgaacccgggcagcgagatcatgaagaagctggacagctccaaggtgctggagcagatcggccacgagtgggtgttcccgacggtgggcaaggcggtggcgtcttgcgactaccccccccccctcgcccagccgggaaatgccaaaggagagcgccctccccccccaaaagcttgggggggaaaaaccccccccccccccaccgaaagtgaagtggggccccggttcccgtcttgaataaaccagtctccccgggggaccgaattataatttaggttcccccgggttcccaggatttggaacccccccccccccccgggggaaaaaaaatttcaaaaaaaaaaaggcccccccccggtttttttttggggaaaaaaaaaaaaaaaaaaaaaatttttttattcacgcccccacccccgggg

SEQ ID NO: 55789 - protein, 71 aa, Zea mays
  misc_feature: Ceres CLONE 1490965
MKKLDSSKVLEQIGHEWVFPTVGKAVASCDYPPPLAQPGNAKGERPPPPKAWGGKTPPPPTESEVGPRFPS

SEQ ID NO: 55790 - DNA, 754 bp, Zea mays
  misc_feature: Ceres CLONE 1490968
  misc_feature: Encodes the peptide sequence at SEQ ID NO. 55791
  misc_feature (1)..(1): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (48)..(48): n is a, c, t, g, unknown, or other
  misc_feature (49)..(49): n is a, c, t, g, unknown, or other
nttatctcccccccccgccgtacacacaaaatataannnaccagaggnnaagaaaatggagctccacgcggaggaggccgctctagaactagtggatcccccgggctgcaagaattcgcacgagaccattacctagaacatcctaatcgaaaaactaactcagcactcggcagtcccagctcatccccatccctgcccgtctccccggccggccactcgaccagaagcaccggagcgagcggagaccgatcggaggccgacggctatgggcaagcaagcgatggcgctggcgctgctgtgcgccgtcctgctggcggcgacggcggacgacgcggcggcggcggcgtcgtcgtgcaacccgtcggcgctgagcgcgtgcgcgcccgcgttgttcggcagggcggtcacgctggggtgctgcgcgtcgctgcgcgcgcaacagccgtgcctctgccagtacaagcgcgacccccccaaccgcgcctacgtcaacggccccgccgagcagcgcttcacccgcgcctgcgggctcacccaaatgaagtgctgatggaccgagagcctgcatgcgctccgccggccgctggagatgttgtaatatgcgcggttaagggtatgtactactactacgaggccacgggggggccctggaaatacatacgtgccggctaaaaaaaaaacgggtcgcgggcgactcgtacgacgaggtccaagaaaaacatggtcatctacaaaaacctcgttcagcaggaat

SEQ ID NO: 55791 - protein, 94 aa, Zea mays
  misc_feature: Ceres CLONE 1490968
MGKQAMALALLCAVLLAATADDAAAAASSCNPSALSACAPALFGRAVTLGCCASLRAQQPCLCQYKRDPPNRAYVNGPAEQRFTRACGLTQMKC

SEQ ID NO: 55792 - DNA, 785 bp, Zea mays
  misc_feature: Ceres CLONE 1490981
  misc_feature: Translation starting site: 267
  misc_feature (27)..(27): n is a, c, t, g, unknown, or other
  misc_feature (28)..(28): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
gaagaaacaacccgagcgcgcgacgcnntataatnntnttcgatnnnnnnnaaaactggaactcaccgcggtggcggccgctctagaactagtggatcccccgggctgcaggaattcgcacgagaccattacctagaacatcctaatcgaaaaatcaccaatcagtcagtcacagctcacagcaaacaccgcgaagccgcccccgctcccaaacccgaccgagcaaagcgcaaagccccccaaccgcggatcaatccgcagcatcgatggcgcccaaggcggagaaaaagccggcggcgaagaagcccgcggaggaggagcccgcgaccgagaaggcggagaaggctccggcagggaagaagccgaaggcggagaaacgcctccccgcgggcaagtccggcgccggcgagggcaagaagggcaagaagaaagccaagaagagcgtggagacctacaagatctacatcttcaaagcgcctcaagcaggtgcaccccgacatcgggatctcgtccaaggccatgtccatcatgaattccttcatcaccgacatcttcaagaaagtcggcgaggaggccgccaagctcgcccgcctacaacaagaagcccaccatccccctcccgcgaaaatccaaaacctccggtccgccttccgtccaacccgggggaagttcgccaaagcacgaccgtgcttttgaaagggaacaaagggggggacaaccaaggttccagcttccccgcctaaaaacgtgggatggccctccccccccccccgttaagaacgagg

SEQ ID NO: 55793 - DNA, 674 bp, Zea mays
  misc_feature: Ceres CLONE 1490983
  misc_feature: Encodes the peptide sequence at SEQ ID NO. 55794
tggagctccccgcggtggcggccgctctagaactagtggatcccccgggctgcaggaattcgcacgagaccattacctagaacatcctaatcgaaaagacacacctcccgagccacgtccgccgcgcgccccccctgcaccggtgcgccctgctgcccgattcgtcggggggcgcgggaatggagctggagctggaggcggcggcccggcgcttccacctctggttccgcgggctgcgctcgctgcgccgggacctggcgtcggcccggtggtcggacgacccgacggcccagctccccgcgcaggtgggccgcttcgtggcccacctggagtcgtactgcgccgcgcgcgccgggctggacccggtgtggacactgtcggcgccgtgggccacccccgcggagcgcggcgccccgtactggctcgccgggtggcgccccaccacgctggtccacctgctgtacaccgagtccgggcgccgcctcgaggcgcagctgccggacctcctcctcggcgtgcggtcgtggaaccttggcgacctcacccccgcgcagctggcgcaggtcgacgacctgcagcgccgcacggtggccgaggaggacgcgctggcaagggagatggcgctcgtgcaggagggccacggcgtcctcgtgctgccggcggcgccggacgga

SEQ ID NO: 55794 - protein, 165 aa, Zea mays
  misc_feature: Ceres CLONE 1490983
MELELEAAARRFHLWFRGLRSLRRDLASARWSDDPTAQLPAQVGRFVAHLESYCAARAGLDPVWTLSAPWATPAERGAPYWLAGWRPTTLVHLLYTESGRRLEAQLPDLLLGVRSWNLGDLTPAQLAQVDDLQRRTVAEEDALAREMALVQEGHGVLVLPAAPDG

SEQ ID NO: 55795 - DNA, 685 bp, Zea mays
  misc_feature: Ceres CLONE 1490990
  misc_feature: Encodes the peptide sequence at SEQ ID NO. 55796
  misc_feature (682)..(682): n is a, c, t, g, unknown, or other
tggagctccccgcggtggcggccgctctagaactagtggatcccccgggctgcaggaattcgcacgagaccattacctagaacatcctaatcgaaaaaggttccaggtcttcgtcactccctttcattatcttcgtcgtctcattcgccggcgacgagcacccaccagaaatcatagctgctttgggtatggaggcgctgtttgggagcaataaccatggcggccacaaggccgctgatttggcctcgcttataattacccaggttgccttggaggtgccaaggttacttgggctccttgccatgaatttgattactaggattctgggcaaaagcgaagatgaaactaatcctgagaacaaagatgatggagagtccgatgatgataatgatgatgaaggagacgatgatgatgctgaaaacgaggaggaagatgatggtggtgatgagggatcagatgacaatgagaatgaggaagatgacgatggagatgatgatgatcctgcagccaatggcgaagggggaagcgatgacgacgaagatgatggtggagaggatgaagaggatgatgacgacgacgacgatgatggggacgatggcaatgaggaagaagaggaagaatctgaagaagatgatgatgatgatgaagtccccccacccactactaaaaagaggatatgatncac

SEQ ID NO: 55796 - protein, 163 aa, Zea mays
  misc_feature: Ceres CLONE 1490990
MEALFGSNNHGGHKAADLASLIITQVALEVPRLLGLLAMNLITRILGKSEDETNPENKDDGESDDDNDDEGDDDDAENEEEDDGGDEGSDDNENEEDDDGDDDDPAANGEGGSDDDEDDGGEDEEDDDDDDDDGDDGNEEEEEESEEDDDDDEVPPPTTKKRI

SEQ ID NO: 55797 - DNA, 680 bp, Zea mays
  misc_feature: Ceres CLONE 1491109
  misc_feature: Encodes the peptide sequence at SEQ ID NO. 55798
tcccgtcggggggcgcgcaatcgaacagtggccgggctgcggattctccacgagagcttacctagaactcctaatcgaaaaaaacctattatattctgtccttaattcccgtgtttctcgtccgtctccgctcctccgcaaccccttcccctcctccgccgaagcctctcctccggccgccgaaaccctagcctccgccgctgccgtcatggcaagcagcaacgtctcgaccgtttacatctctgtcattgatgacgtcatctccaggtccgcgaggatttcatcacctacggagtcggtgacgccgtcctaaacgagctccaggctctctgggagatgaaaatgctacactgtggcgcgatctcggggaacatagaccgaaccaaggctgctgccgcgtccgtcggaggcaccaccggcacgacaccggccgtgcacgacctgaacgtgctgtacgaggccacatctgaggagtacgccaccccgaccgctgacaatgtgtttccgccgacacaatgcagacccccatcagactcctctgcagggacgacacagcgatgtacacctacccactgggccttcgattaaggcccctccccatcacgaatttccggatgggaaggcataaatggggaaaaccaaaggggggcttcaagccctaatggcaccccttcccttgg

SEQ ID NO: 55798 - protein, 83 aa, Zea mays
  misc_feature: Ceres CLONE 1491109
MKMLHCGAISGNIDRTKAAAASVGGTTGTTPAVHDLNVLYEATSEEYATPTADNVFPPTQCRPPSDSSAGTTQRCTPTHWAFD

SEQ ID NO: 55799 - DNA, 745 bp, Zea mays
  misc_feature: Ceres CLONE 1491114
tggagctccccgcggtggcggccgctctagaactagtggatcccccgggctgcaggaattcgcacgagaccattacctagaacatcctaatcgaaaagcgtattcgatccgcaatagcgttttttcgcgtactcccgagaccccaatcttttccccctctcgtcgcatcggggggggtgacaggacatcgtgcggcggctgcggcggcggcggctggacagccgcataacgaaggaagggttctcctgtagcgccgttcctcgtcccgatccgcacggatccgctccacctaggggcctcgtgcacaaggagcaaagatgataaaccttttcaagatcgaggcgtagacgaacgaacaggcattcaactcgaaaggggggcctctcgtcgagaagcaagtcctggggattacctctccataaagatattgctggagcttacctttcaaagacaactaaaatttcttttctaaatggaaaggatgatctcctgaattttgaagtccctcttcggacctgtggagggaatctcccgaggggggagcattttacttttcccccttccagtgatcccctttcctaccctcccaaaggttttcaagggtcaaggggcaaaccccagggtttccctctcccaaattggccctaaaaagaaaatgttcggcctaaaaatttttgtgaaaaaaacgggaaaacctttttttaacacccccccccccttttataaggggcgttaaacctctttt

SEQ ID NO: 55800 - DNA, 848 bp, Zea mays
  misc_feature: Ceres CLONE 1491120
  misc_feature: Encodes the peptide sequence at SEQ ID NO. 55801
  misc_feature (36)..(36): n is a, c, t, g, unknown, or other
  misc_feature (37)..(37): n is a, c, t, g, unknown, or other
  misc_feature (48)..(48): n is a, c, t, g, unknown, or other
aatgcccgcccccgcccttttaaatataaaaatccnncctcccccccncaaaactgggactccaccgcggtggcggccgctctatactaggggatcccccgggctgcaggaattcgcacgagaccattacctaaaacatcctaatcgaaaaaagtcaagtgttcacggtccatcctctcgagagtctaggcccttctcccgaagccgcagacgcagaaaacggctctacatatggaggcgaagaagaagccgtcggcccccaccgccgtcggagccgcgccgccgcctccgggtaacgggtacttcagcaccgtcttctccgcgccgactgcgggaagcgcaagtgacgcaaagcatgcggacttgtacacgatgctgaccaagcagagctcccaaaggccaaaaatggcaaagatggtaaatcccaaagccccccctacttacagggaagggaaaaattggccttccaaaacccccccagcgaaaatctccttaattttgggtaaacccgggcattataaagggggtcggggaatttcccacaaaccccgttttttataaaaaccccacccccccaaggaaacccccataacggaattaacaaggggggaaaacacccgcgagggtccctggccaaccacaaaggtgatattggggcacgtgttccatttttataagcccgaaaaatttctggggggccccctcccctctttggcaaaaccaagataataaaaaggcgaaaaaaaaaaaaaagtgcttcttattatttgcccagaatggagtatgcccctttcccccctcaacactcccccatagagaaaacaacttgtcaaaaagattaaaacggg

SEQ ID NO: 55801 - protein, 109 aa, Zea mays
  misc_feature: Ceres CLONE 1491120
MEAKKKPSAPTAVGAAPPPPGNGYFSTVFSAPTAGSASDAKHADLYTMLTKQSSQRPKMAKMVNPKAPPTYREGKNWPSKTPPAKISLILGKPGHYKGGRGISHKPRFL

SEQ ID NO: 55802 - DNA, 809 bp, Zea mays
  misc_feature: Ceres CLONE 1491124
  misc_feature: Encodes the peptide sequence at SEQ ID NO. 55803
  misc_feature (809)..(809): n is a, c, t, g, unknown, or other
tcacccctgccagagcatccacttacacctccccatcccctaccaccaaaactggcgctccccgcggtggcggccgctctagaacttctggatcccccgggctgcaggaattcgcacgagaccattacctagaacatcctaatcgaaaactggtgacagaccgtgagaagaaaaccccagccaaagctgagatctcacgtgtcatgaaccatatgaaagatatgggagtgttggttggtaagggtggtttctacgggaacgtttttaggataacaccgccgttgtgcttcaccaaagaggattccgacttcttcattgaggtgatggacattgcgctctcgaagctgtgaggcaggcagggcgaagatgatgtgcaaaccctggtccgtggccatgggttttttgcccatgaataatattaacattagtgagacagcacctcgttgtctcttaatctattaccaccccatgtcatccggtggcatggtattcctgcttgcccataaataagggacgagttgtgagacagaacctcgttgtctcgtgatcagacccctggtccatggagccatacgattcttgtaaactccagcttcatccaattcggttcctcctgatctaaactactcggaatagcaactgttccgcttgttaccaacatcccatttctttttttgaaggcccccataattccccgtcttccctgtaaaccacaaaagctactacttggctcattaaaagccggaaaatgtcgcattatccaatttttaccctcgccccataaacaaaaaaaaaaggcttcacccgan

SEQ ID NO: 55803 - protein, 115 aa, Zea mays
  misc_feature: Ceres CLONE 1491124
  misc_feature: SWISSPROT Homolog: EC 2.6.1.44 Alanine--glyoxylate transaminase
TPARASTYTSPSPTTKTGAPRGGGRSRTSGSPGLQEFARDHYLEHPNRKLVTDREKKTPAKAEISRVMNHMKDMGVLVGKGGFYGNVFRITPPLCFTKEDSDFFIEVMDIALSKL

SEQ ID NO: 55804 - DNA, 713 bp, Zea mays
  misc_feature: Ceres CLONE 1491137
  misc_feature (411)..(411): n is a, c, t, g, unknown, or other
  misc_feature (412)..(412): n is a, c, t, g, unknown, or other
  misc_feature (452)..(452): n is a, c, t, g, unknown, or other
  misc_feature (456)..(456): n is a, c, t, g, unknown, or other
  misc_feature (457)..(457): n is a, c, t, g, unknown, or other
  misc_feature (460)..(460): n is a, c, t, g, unknown, or other
  misc_feature (462)..(462): n is a, c, t, g, unknown, or other
aagctggagctccccgcggtggcggccgctctagaactagtggatcccccgggctgcaggaattcgcacgagaccattacctagaacatcctaatcgaaaagtgctgatctttccaccgtcgcatacaggcagcaggatgctctttattcccctgtgtcagcttcagcgaagctaatcccattccagtgcccgtaccgcgccgtccctatcgtgccggatcgccacccgctcgctgcgcccccacctcccccccctcgccggttcgccacttcgccccacctccgcgcctcagatccatccccaatccggcaaccctagcgccgggttcctcctcctcgtctccgcccgccgccgcctcccattgcagaggtgatcgagggggagagacagagcttgggtggtccgattanngaaagagggagggaagatgtccagaaagtcggtgaaccgnaccnngcngntggcgaaacggggcttgccgtctttcggcgccggttccaccctaagcacgctcgctcccgggctcacattgccctcgcggccggggggcatttttctaatgcccatttaaaagaaacccagggtaactgttacaaacaaaaaactggacccggtctaaaggtcttggcatcaaaaatttcggggccttccatttctaaaaagcaattgcaagccttgcaaaggtttccccgaggcccgaaattttaaaaaa

SEQ ID NO: 55805 - DNA, 650 bp, Zea mays
  misc_feature: Ceres CLONE 1491139
  misc_feature: Encodes the peptide sequence at SEQ ID NO. 55806
acaacaaaatccccgtcttctgtgactggctggctaggtatagctaggtaaccgtgcgtgcatgagcgagcagggcaagaggccgacgacgacgatgtccggcggcgggtcggcggccgagtcgccggcgagctcgtgcgtgtcgtcggacgcggaggacgaggtacagcaggcggtggcgccgaagccgatggtggtggtggggtgcccgcagtgcctcatgtacgtgatggtgtccggggaggagcagcagcccaagtgcccgcggtgcaagagccccgtgctgctgcacttcctccgcggcggcaacggcaagctgccagccggccggcagtaacgcatcacatatattattagtattagctaattaagctagctagcagctatagctcttgtgtgttttagttaattaattgctgctgcccttttctagtagtcttttcttttttttatgcatgttagcgtcgatggattggatccaagaatgttgttactaccgtagtaggagtactatgtactagcttatagattgcttcttcttcttcttcttccaccgctagctactatagcaaataaagcgcagctgtgaaatgaaatgaaatgaatattaggtggtggtggtgtgttgcttgctaaaaaaaaaaaaaaaa

SEQ ID NO: 55806 - protein, 91 aa, Zea mays
  misc_feature: Ceres CLONE 1491139
MSEQGKRPTTTMSGGGSAAESPASSCVSSDAEDEVQQAVAPKPMVVVGCPQCLMYVMVSGEEQQPKCPRCKSPVLLHFLRGGNGKLPAGRQ

SEQ ID NO: 55807 - DNA, 778 bp, Zea mays
  misc_feature: Ceres CLONE 1491159
  misc_feature: Pfam Name: PLATZ Pfam Description: PLATZ transcription factor
  misc_feature (39)..(39): n is a, c, t, g, unknown, or other
ttaatcccctccaataatccgccacccaaggcgcctacncctttcatccccaaaaactggcactccccgcggtggcggagcgctctaaatctagtggatcccccgggctgcaggaattcgcacgagaccattacctagaacatcctaatcgaaagaacattagcacaaagaacacaatagaccactgatttcacaatgaaaagggagacaatgccttcatggctagaactgttgcttgcaacacaattctttacgacttgtgctaaccatcttcttgctagtcgcaatgaatgtaacctattttgcacccagtgtgagaccaaaccagctgctttctgtaactattgtcgttcaagtgatcattccacccaccgtgtaatccagataaggcgttcatcgtaccatgacgttgtgagggtgtccgagattgaggatatccttgatgtcagcgatgtgcaaacttatgtaatcaataccccccccattgcattcctgaatgagcggccacaactgcgtgcttctagtgtccccatttgtaaggcacccacatcatcaacacacagctgtgagacatgtacccgtgtgctacttgatgcatttcgcttctgctctcttggatgcaatcttagaagccttaaatatggaccctggtattgaagctatgcgtgggcaaccaccctcgggcccaatggtatggaatcatgttggctaaggattgcacaatgtttggtttcaggtaactaccacatgacccaaaacagcttgccaatgaccaaaa

SEQ ID NO: 55808 - DNA, 767 bp, Zea mays
  misc_feature: Ceres CLONE 1491166
  misc_feature: Encodes the peptide sequence at SEQ ID NO. 55809
  misc_feature (253)..(253): n is a, c, t, g, unknown, or other
  misc_feature (270)..(270): n is a, c, t, g, unknown, or other
  misc_feature (405)..(405): n is a, c, t, g, unknown, or other
  misc_feature (415)..(415): n is a, c, t, g, unknown, or other
  misc_feature (422)..(422): n is a, c, t, g, unknown, or other
  misc_feature (423)..(423): n is a, c, t, g, unknown, or other
acccgcggtggcggccgctctagaactagtggatcccccgggctgcaggaattcgcacgagaccattacctagaacatcctaatcgaaaaatcgtatcacacgcccatctgcgccaagcttgggtaaaagaaggatcggagaatggctgcgcagacgacggtgcaatgcagggtgatcggtggcggtggcatgcggacggtggagtgcctgaggggaaggcttctcgcggagcgggtggcatcccaggctgcnaaggaggatgccgaccnactgaccaaaaggggaacaccttgatgcatccagtggctgtggctcagcaaaatcggaagaagcgttctacgaaagcgacgacaggctagcgctatcgcggggtctcgttgaaccaccaccagcagctgcaggcnaagggtccangaccccnngataacgaccccccatgcaggaaggtcgttgccctggattcccaggaaaagaggagacccccaagctttggattgttttagccaacccccaccccagttcaaggggaaggtgaacccgttttcccggggctcggggggggaaaaaaacctttgctttccccataaacccagaaactcccccccccacccaggatttttccccccccgggggggggggccccataaaaaaacgggggggtctcttttcaagggggggccccaatttgtggtcgggaataattttcaagggtttttgggggggggagacctttccaaaaaaaaaaacccgcccctcttggtggagg

SEQ ID NO: 55809 - protein, 50 aa, Zea mays
  misc_feature: Ceres CLONE 1491166
  misc_feature (43)..(43): Xaa is any aa, unknown, or other
MAAQTTVQCRVIGGGGMRTVECLRGRLLAERVASQAAKEDADXLTKRGTP

SEQ ID NO: 55810 - DNA, 663 bp, Zea mays
  misc_feature: Ceres CLONE 1491167
  misc_feature: Encodes the peptide sequence at SEQ ID NO. 55811
  misc_feature (320)..(320): n is a, c, t, g, unknown, or other
tcgcacgagaccattacctagaacatcctaatcgaaaactatcgactcggcgcagccacccccaccaccgaagcatcactccggagagcaggccaggcggagaccgagatggcgcgcggcgtgccggcggctaccaagggcggcgcgggcgccgggaagaagaaggggtcggtcaccttcgtgatcgactgcaccaagcccgtcgacgacaagatcatggagatcgcgtcgctcgagaagttcctgcaagagcgcatcaaggtcgccggcggcaaggccggcaaccttggggactccgtcaccgtcgcctgggattaaancaaggtcaccgtcacctccgacggggccttctccacccacgcacttgaagtacttgacaaagaagtacctgaagaaacccaatgtgcgtgactggctccgggtgatttcatcccacaaggaccgctgtgtctatgagctcttgtacttcaacctgcccactaccagggtgaggaggaggattaaatatcccccgccctttttcctgtggccacgagccaccttttacctccttccgcccttttgccggggaaagttttgatggtttattttttcccacgaaggccccgccacttgggtatatgtcccccccaggagatggatggcttttgataacccacccct

SEQ ID NO: 55811 - protein, 69 aa, Zea mays
  misc_feature: Ceres CLONE 1491167
  misc_feature (17)..(70): Pfam Name: Ribosomal_L22e Pfam Description: Ribosomal L22e protein family
MARGVPAATKGGAGAGKKKGSVTFVIDCTKPVDDKIMEIASLEKFLQERIKVAGGKAGNLGDSVTVAWD

SEQ ID NO: 55812 - DNA, 687 bp, Zea mays
  misc_feature: Ceres CLONE 1491170
  misc_feature: Encodes the peptide sequence at SEQ ID NO. 55813
  misc_feature (402)..(402): n is a, c, t, g, unknown, or other
  misc_feature (526)..(526): n is a, c, t, g, unknown, or other
  misc_feature (528)..(528): n is a, c, t, g, unknown, or other
gctctagaactagtggatcccccgggctgcaggaattcgcacgagaccattacctagaacatcctaatcgaaaaatcgcacgcactcctcatcttatcccccgcctcctccggtcctcccgccgctgttgctcacttctgagtcccgacgcacgagctcccaagagctagccatggcgtccaccaccctctcctccgccttcaccctcctatcccgcccctccacctccccgtgccccgccgcctcgctcccgaggtcctcccacgccgcgccccacatccgccggggccgccgcgccgtcgccgtcgcgtgcaccgccaccgagtctcccaagatcctggagctcggggaagacatcaccgggctcacgctcgaggaggaccgcatcctcgtccacccccnccaggagcggctcggcgtcaccgccgcggcctttgcgccggccgccgtctgctctgtacccgggggaggtcggcggggtcccgggctaagaagaagccccccgcccaaaaaaacggataatttnancggggatgatataaaaaagggtgccaatacccccgtggtttccccccccaattagggggggggggggggggttataccaagcccttcgggtttaacgggggggccaagggagctttatccccgggggttttcccaacacaaaaggtccccacgtaggct

SEQ ID NO: 55813 - protein, 136 aa, Zea mays
  misc_feature: Ceres CLONE 1491170
  misc_feature (77)..(77): Xaa is any aa, unknown, or other
  misc_feature (118)..(118): Xaa is any aa, unknown, or other
  misc_feature (119)..(119): Xaa is any aa, unknown, or other
MASTTLSSAFTLLSRPSTSPCPAASLPRSSHAAPHIRRGRRAVAVACTATESPKILELGEDITGLTLEEDRILVHPXQERLGVTAAAFAPAAVCSVPGGGRRGPGLRRSPPPKKTDNXXGDDIKKGANTPVVSPPN

SEQ ID NO: 55814 - DNA, 719 bp, Zea mays
  misc_feature: Ceres CLONE 1491174
  misc_feature: Encodes the peptide sequence at SEQ ID NO. 55815
  misc_feature (702)..(702): n is a, c, t, g, unknown, or other
aaagctggagctccccgcggtggcggccgctctagaactagtggatcccccgggctgcaggaattcgcacgagaccattacctagaacatcctaatcgaaaaatggactccaccaggagcaaccaggtcgccggcagatgcagcagcaccatcgcgtcaagggttgccacggtcccgccgtcgctgaccatgccgcgcggcgaactcgctgacgccatcgtgggcggaggcggaggaggaggagcggacggggacccccgggccgccctcctccgtctgtctgctctcggggaccgcatggccgccgtccggggccgtatctccgcttctatctcgggcgaagcccggcctctctcctacgccgacatccaatctgtctcctccgagatctccgccgccgcccaactcgtcgtccttaacgccgccgagctcctcgcttcctccgcccccttccccgccccacctccacctcctccttccgccgctccctctcccgctcccgtccgagagatcccagttgtggccgcttccgcccaagagcaacccctggaggccgccaaggacgacggcggctacgaggtcgtggagctcgacgccgccgagctgctagcggagcacgtgcacttctgcgagatctgcggcaagggcttccgccgcgacgccaacctcaggatgcacatgcgcgcccacggagaccgcttncagaccctagacgcgct

SEQ ID NO: 55815 - protein, 205 aa, Zea mays
  misc_feature: Ceres CLONE 1491174
  misc_feature (174)..(196): Pfam Name: zf-C2H2 Pfam Description: Zinc finger, C2H2 type
  misc_feature (200)..(200): Xaa is any aa, unknown, or other
MDSTRSNQVAGRCSSTIASRVATVPPSLTMPRGELADAIVGGGGGGGADGDPRAALLRLSALGDRMAAVRGRISASISGEARPLSYADIQSVSSEISAAAQLVVLNAAELLASSAPFPAPPPPPPSAAPSPAPVREIPVVAASAQEQPLEAAKDDGGYEVVELDAAELLAEHVHFCEICGKGFRRDANLRMHMRAHGDRXQTLDA

SEQ ID NO: 55816 - DNA, 885 bp, Zea mays
  misc_feature: Ceres CLONE 1491177
cagcccacatggacccaattttttttacaaccccacaaatcacccccaacccggaactccccgccggggcggacgctctagaactagtggatcccccgggctgcaggaattcgcacgagaccattacctagaacatcctaatcgaaaagcgtcgcctgcgcaatcatacttcctaccctccccacctcttccacggttccaccccgtccctctcctctcgagaagcacccgcaccatacatcttccggcgcccgacgcggacggcgagccgctgctgctgctgccgccggaggaggaagggcaccagggccagcgggtgcaggaggaggaggagcagcatcaggccgccggccgcttggcgctgtgccacatgccgctctggggggccgccgcgtccgcggcgcccgcatccgaaggtgagtccccccacgcgccctccggaatcggtggaggcatcaaagggaaccccccctttttgatccccaaccgggggccggctacgccttaaaaccgccccggcaaggtcctactttcccataaggagtcccggggaaagaaaaatccggaacccgccgggccagggattatataaaatattgagaaaggcccccaagggtggcccttcccaagttttccaaaccgcaggggacccaaaagaatgtggccttcaaggggaccctcccgaggcggcgggtggttttttttttcatcggggaaaagacatcttttaacccaccaacgctttataaaagatctcggggaaataaatcccccagaaacaaaccataaaacccccgagagggcacaaattgcgcaagggcgtaaaatttaataaaaattgccgccgccctcatgaaccttaaaaagggccctctgtgggataat

SEQ ID NO: 55817 - DNA, 826 bp, Zea mays
  misc_feature: Ceres CLONE 1491179
  misc_feature: Encodes the peptide sequence at SEQ ID NO. 55818
  misc_feature (32)..(32): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
cactattaccccccataccaaaaacaattcancccccccccccnnnncnaaacaaaactgggactccccgcggtggcggccgctctagaactagtggatcccccgggctgcaggaattcgcacgagaccattacctagaacatcctaatcgaaaaaaacacgtgacacctccgcccaccctcgccccctccctaccggcaccgcccagatggcctgctcccacatcgacaccgccgggggggtctcctcccccgacacagcggcggctcgctccccggcgcattctcccgatgccgccttcgagcgcctccggtcgacgcctcatttcgcgagcgctggcttgccggctaagggaaactcacgcggcgatcccgttggccgccgccgcggggacagagacgccagaaacggtggtcaacctggaaggatggttggaaccaaaacagacaacccttatgcgttgtagaaattgttccaccccgcgcgggtaaggacctctgccagtacatggggggaactcccccccgaaactttcaaaagcaaggccgcattgacgaaaactgaaccatataaagatgtggaggagggaacacacccccccgggcgaaatactttattttcccccccggacctggggcgaacccaccggaactcgggtaaatttcatttgcgaaaaccggcctcccggagtttatggccccagtccatcccatactttttttggcaagtcttacaaagggcccattggcaaccgccactggagaagaagtgaattctgggaaagaaaaaagaatatatttcgggagcttctcttaccggggatagg

SEQ ID NO: 55818 - protein, 85 aa, Zea mays
  misc_feature: Ceres CLONE 1491179
MACSHIDTAGGVSSPDTAAARSPAHSPDAAFERLRSTPHFASAGLPAKGNSRGDPVGRRRGDRDARNGGQPGRMVGTKTDNPYAL

SEQ ID NO: 55819 - DNA, 780 bp, Zea mays
  misc_feature: Ceres CLONE 1491185
  misc_feature: Encodes the peptide sequence at SEQ ID NO. 55820
  misc_feature (29)..(29): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (780)..(780): n is a, c, t, g, unknown, or other
gtgccccccccccgctctattattttatncgccnnnntatccccccctcaaactggaactcaccgcggtggagggcgctctataactagtggatcccccgggctgcaggaattcgcacgagaccattacctagaacatcctaatcgaaaactagcctccactccgccccctaacccaaaccctaccccgccgccgccgtcgccgccgcagcgcgcggaggcgacctcgcaccgccgccaagatgcagatcttcgtgaagaccctgacgggcaagaccatcacgctggaggtggagtcctcggacaccatcgacaacgtcaaggccaagatccaggacaaggagggcatcccgccggaccagcagcgcctcatcttcgccggtaagcagctcgaggacggccgcaccctcgccgactacaacatccagaaggagtccaccctccacctggtgctccgcctccgcggcgcccccaacaaccgcaagaagaagacctacaccaagcccaagaagcaaaagcacaagcacaagaaggtgaagctcgccgtcctccagttctacaaggtcgacgacgccaccggcaaagtgaccaggctcaggaaggagtgtcccaacgccgaatgcggcgccggcacctttcatgggccaccaactttcaaccgccactaactgcgggaagggcgggtctccccctaagttctacaaacaaaaaggcttaaaaggggggcttcgcgttttgcacccgcctcttttttacctacctcactcgagaaatccgaaan

SEQ ID NO: 55820 - protein, 141 aa, Zea mays
  misc_feature: Ceres CLONE 1491185
  misc_feature (6)..(74): Pfam Name: ubiquitin Pfam Description: Ubiquitin family
  misc_feature (101)..(142): Pfam Name: Ribosomal_S27 Pfam Description: Ribosomal protein S27a
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLHLVLRLRGAPNNRKKKTYTKPKKQKHKHKKVKLAVLQFYKVDDATGKVTRLRKECPNAECGAGTFHGPPTFNRH

SEQ ID NO: 55821 - DNA, 889 bp, Zea mays
  misc_feature: Ceres CLONE 1491186
  misc_feature: Encodes the peptide sequence at SEQ ID NO. 55822
  misc_feature (37)..(37): n is a, c, t, g, unknown, or other
  misc_feature (47)..(47): n is a, c, t, g, unknown, or other
  misc_feature (48)..(48): n is a, c, t, g, unknown, or other
  misc_feature (837)..(837): n is a, c, t, g, unknown, or other
  misc_feature (838)..(838): n is a, c, t, g, unknown, or other
gaaatcacctccacaccccaaaataccaatccccccngacacccccnncaaaaaatggaactcaccgcggtggcggccgctctataactagtggatacaccgggctgcacgaatgtccacgagactcttacctagaacatcctaatcgaaaaacgggtgccaaaactccctgccgatccagtcccccggcaaattcccaaccgccgcacagcaacaccagcggacggatcgggggagaaacggaagggcaacagcagagcgcgaattcctcagacaaatccaaggtttcgagcacagacacaggcgaaactcgatggcggaggggtccaagccggacgtgccgctgttccagctcctcagcgatcttctccagcaggtggagtcaatgagcaatcacgaagaagtagagttgcgcgtctaagattggaagattaaggataaaaagggccctaaaggaccaaaaatagggtgggttccccccccccaccgaagttaaaaaataacccgcaaaagtttgaaaaacctggaccatcccaggccttgaaaaaacgcccaacaaaaaagaataatcaacggcgcaaggggtccttcgaaataccgggaaggatgaaaggcttttctttcggggcgcacccaaccttcggaataaagaggggaaggcgcggtgactataatacagcccgcccgtggcaaatataaccagtgcggggaactttattcttcggcgccgaaaaatacccccacccgcgcatcccagagaaaaaacccgaggataaaattctcaacaacaaaaaaagggggagaaatgaggcgcgcccccacaaaaaatctccattnntgccggggaggatctagttaattggcaccactctaactctgcgtataaaaa

SEQ ID NO: 55822 - protein, 35 aa, Zea mays
  misc_feature: Ceres CLONE 1491186
MAEGSKPDVPLFQLLSDLLQQVESMSNHEEVELRV

SEQ ID NO: 55823 - DNA, 711 bp, Zea mays
  misc_feature: Ceres CLONE 1491189
  misc_feature: Encodes the peptide sequence at SEQ ID NO. 55824
  misc_feature (510)..(510): n is a, c, t, g, unknown, or other
ggagctccccgcggtggcggccgctctagaactagtggatcccccgggctgcaggaattcgcacgagaccattacctagaacatcctaatcgaaaaacttcccgtgtttctaactccggtggctccaccaccagcaacccgtgcagcgagcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcagggtgatattaaggctctgcacaagaacctagctgccagagaattgctataccaacaccagcataacaaaaggatgagctgccctgccatggcacagctcctctccaataccctgtactacaagcgcttcttcccatattacgcccttcatgtgctncgtgggcttgacagcgaggggaaagggtgtgttttccctatgatgcagtaggtcctacgagagaactggtttagtgctcagggaactggatctactttgattatgccagccctggacatccactaaaatcaccagtcctctattgctccctggcagggatgctgtcacccaattgtcggagtcaagggcatcgatctatta

SEQ ID NO: 55824 - protein, 130 aa, Zea mays
  misc_feature: Ceres CLONE 1491189
  misc_feature (10)..(131): Pfam Name: Proteasome Pfam Description: Proteasome A-type and B-type
  misc_feature: SWISSPROT Homolog: EC 3.4.25.1 Proteasome endopeptidase complex
MSRRGDWVYENNGGTCVAIAGADYCVVAADTRLSVGYSILTRDHSKICDLADKCVLASSGFQGDIKALHKNLAARELLYQHQHNKRMSCPAMAQLLSNTLYYKRFFPYYALHVLRGLDSEGKGCVFPMMQ

SEQ ID NO: 55825 - DNA, 758 bp, Zea mays
  misc_feature: Ceres CLONE 1491195
  misc_feature: Encodes the peptide sequence at SEQ ID NO. 55826
  misc_feature (758)..(758): n is a, c, t, g, unknown, or other
ggagctccccgcggtggcggccgctctagaactagtggatcccccgggctgcaggaattcgcacgagaccattacctagaacatcctaatcgaaaaattttttggggagggtgtgttccagccttgcaggccgccgagatggtgggaggcagcaagccgctgggggaaagcgtattcgcggtccacgcggtcgccggtgcggcggcgatcagcgcctccgccgtcgccgtgtaccccctcgatacggtcaagacactcctccagctgggagcgacggggcagaagcagaagatggggctccggcaggtggtggaccggctcatggccgcttccggccctgcaggtttttacaatggcattggatggtccatattgggtaaacttcctggattgggagcacgttttgggacccccccaccttttaccagccttctataaagatggaagggaggaccactatgtctattattctgagggtttgaagggttggcatacctgctgggggctgtaaaggttgttttctgcccccccatttgaacttttccgatttccgaaaccagtttaggtcctgtggttcccttccaaacctatggggccccgccaatggttcctccaaaaagcttttccccggcgctttccaacgggtggcccgggaataggtccctgaataaaggggggggggaaaaacccccctggggcccttttttattggattttttttccccacgcactttcggaaatgtgtgggcgggccctcn

SEQ ID NO: 55826 - protein, 99 aa, Zea mays
  misc_feature: Ceres CLONE 1491195
  misc_feature (12)..(94): Pfam Name: Mito_carr Pfam Description: Mitochondrial carrier protein
MVGGSKPLGESVFAVHAVAGAAAISASAVAVYPLDTVKTLLQLGATGQKQKMGLRQVVDRLMAASGPAGFYNGIGWSILGKLPGLGARFGTPPPFTSLL

SEQ ID NO: 55827 - DNA, 731 bp, Zea mays
  misc_feature: Ceres CLONE 1491196
  misc_feature: Translation starting site: 236
  misc_feature: Pfam Name: LEA_3 Pfam Description: Late embryogenesis abundant protein
ggagctcaccgcggtggcggccgctctagaactagtggatcccccgggctgcaggaattcgcacgagaccattacctagaacatcctaatcgaaaaatccctcaaagccatttctgaaatcaacattctagttcgagagagagaacacagacgaaaacaagaagaaagtttcaacctttactgtctgttctatctctatctctctctctttcaagaaactacatacttcgaaaacatggctcgttctctctctaacgttaaaatcgtatctgctttcgtctctcaagaactctccaatgcaatcttccgacgcggttatgcggccactgcggcgcaagcgagcgttggtaaaggtggagccgttgtttcggcggtgatgaagaagaagggagtggaagaatcaacccagaagatagcccgccaccccacatcccaaaaccggttattacagaccggaaaccggttcataagagatcgacccagctgagctacgagcagctctcttgaacaacaggcagtgatgaattaactgaaaagaagctctgtttctgttaattattcgttgttgatttttaatgtcttggggaatagggaattgatcctttgccgtgaaccctgtttttgccggcccggtacgggtgattctgctattaataacatagagaagcttttcagggtgcctctactttgaaacataagggacgaagggaggaatgaatggattccctcta

SEQ ID NO: 55828 - DNA, 768 bp, Zea mays
  misc_feature: Ceres CLONE 1491200
  misc_feature: Encodes the peptide sequence at SEQ ID NO. 55829
tccccgcggtggcggccgctctagaactagtggatcccccgggctgcaggaattcgcacgagaccattacctagaacatcctaatcgtaaaacaggcctcccgcgctctattctctctatctaccactactactacccagcagcagcaggccagcacacaatacacacactctaatctctccacacagccaacacagatacggacaggacaggaggatgaagctgggagcaaaaggcctcggcctcctgctcctccttgtcctgcttgcgctttgctccaccattgaagtcggcgaggcaagaagagaccggcattggaggtcgtcgaggacctcctcctctcagctgctgaagaaagggaaaggaaagaagaccagctccccgccgccataagggaggccacgggccccccccccaagcccccgggcagctcgacaccgaactctgggggcgggggcaaaggaaaccagaatcccgaccaaccaaggcccgaatggcccttccattccaaggcccagcccccccggccaaggggagggcccattccatgcccaaggcggccgaattctccaaggttgggggaaggggttttcagaggccctttccgagtcccgcccccccccacccaaaacccctcccccgaaagagggggccaaattatcaagggggggggaattatcgaaccaccggcggggggaggaatttcccacacaaacaaggggtttttcttaagaagccgggggaggtgcgtctctctcccccccaagg

SEQ ID NO: 55829 - protein, 73 aa, Zea mays
  misc_feature: Ceres CLONE 1491200
MPKAAEFSKVGGRGFQRPFPSPAPPHPKPLPRKRGPNYQGGGNYRTTGGGRNFPHKQGVFLKKPGEVRLSPPQ

SEQ ID NO: 55830 - DNA, 750 bp, Zea mays
  misc_feature: Ceres CLONE 1491201
  misc_feature: Encodes the peptide sequence at SEQ ID NO. 55831
  misc_feature (451)..(451): n is a, c, t, g, unknown, or other
  misc_feature (463)..(463): n is a, c, t, g, unknown, or other
  misc_feature (475)..(475): n is a, c, t, g, unknown, or other
tggagctccccgcggtggcggccgctctagaactagtggatcccccgggctgcaggaattcgcacgagaccattacctagaacatcctaatcgaaaagtgctctctcagaggtgggctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacgggcagggagctcgacggccgtaccatcaccgttaaccaggcccagtcccgtggcngtggcgttggcngcggtggctacngcgggcggtcgcggcggccggcgcttatgttggcgggcggccgtgacagcggttatggcggcggggtgggctacgggggtttcgcccaagggggggggccgccgtctaccgaaggggggggcggttaaagcgggtcggcccaagggggggggggggggggttaaagcggggggggggggggggtttggaaggaaagtaaatgtgggggcccttccggggtttcgggcggagttttcttttcttcctcttaaagacccggtgctcccgctcccctc

SEQ ID NO: 55831 - protein, 81 aa, Zea mays
  misc_feature: Ceres CLONE 1491201
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAADVEYRCFVGGLAWATSNESLENAFASYGEILDSKVITDRETGRSRGFGFVTFSSENSMLDAIENMNGQGARRPYHHR

SEQ ID NO: 55832 - DNA, 643 bp, Zea mays
  misc_feature: Ceres CLONE 1491710
  misc_feature: Encodes the peptide sequence at SEQ ID NO. 55833
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (643)..(643): n is a, c, t, g, unknown, or other
aaagctggagctccccgcggtggcggccgctctagaactagtggatcccccgggctgcaggaattcgtctcacccctagaaaaaatccaagaagctcaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaacaggcggcggcggccaaaaagtgacgtacagtacgtgtggagtgtaatggagcttccatgcatgagtgaatccatgccatgtaatgaatctagtccttccttttctgtatcttccctgtgaacgcgggcgtgggcttcccctccagttgtgatgatgcccagattaattactacaaaataaaacccttggttggtgaacgggggtgcccaaannnaaaaaaaaaaacctatagaaaaaatcgataaatctttggaccggggaaaaacaaaaaaaaaaaaacccggggccccctccccgaaggaacccccccan

SEQ ID NO: 55833 - protein, 63 aa, Zea mays; identical to SEQ ID NO: 28299
  misc_feature: Ceres CLONE 1491710

SEQ ID NO: 55834 - DNA, 707 bp, Zea mays
  misc_feature: Ceres CLONE 1491711
aaactggagctccccgcggtggcggccgctctagaactagtggatcccccgggctgcaggaattcgtctcacccctagaaaaagtaagtggcatccatcagaccaacatcttccaatccttccgtcgatgctccccgtctcgtcccccatctctcactaaatctttgcctgccctccctctgtcttgcaggtgcttgaggtgatccaccccggccgcgccaacgtctccaaggcggagttgaaggagaggcttgccaaggcgtacgaggtgaaggaccccaacaccatctttgtcttcaagttccgcacccacttcggaggaggaaagtccactggtttcggcctcatctacgacaacctcgaggctgccaagaagttcgagccgaaataccgcctcatcaggaatggtcttgctactaaggttgagaagtcccgcaagcaaatgaaggagcggaagaacagggccaagaagatccgtggtgtcaagaagaccaaagctggtgacgccaagaagaagtaaacgttcgtttacatttgtattactgttctgggctctgggtggtctagctgcaatgtcataattatggtcgtgttaggttttgttccacccttggcacttgaatgattttttttgtaattcctcggcactgaagtgaagttttgtctgaatattgcctcgtaacataattgcccggcccctgttctag

SEQ ID NO: 55835 - DNA, 731 bp, Zea mays
  misc_feature: Ceres CLONE 1491712
  misc_feature: Encodes the peptide sequence at SEQ ID NO. 55836
  misc_feature (398)..(398): n is a, c, t, g, unknown, or other
  misc_feature (400)..(400): n is a, c, t, g, unknown, or other
  misc_feature (673)..(673): n is a, c, t, g, unknown, or other
aaagctggagctccccgcggtggcggccgctctagactagtggatccctcgggctgcaggaattcgtctcacccctagaaaaaaagctaagtggacgggctctctacctctcattctttctacgtggccggttcctcgcccatacggtcgggcggtcggaataatccgaggagggggctataggagggggatcatcgggccacttggtgctggccttggtgtcggtccagaaccgcggagaccgagagatcacctcgcggatgggcggccagatccctaaggggggctgcgacaacggaggcggcgcgcacctaggccaccatggtgagtctggccggggccaagcgactgcacgaggtgttttatatcccggcccctcgaggggggggggggggatnantcaccccgctggtggatcgcttcttggatcccacgcctaataggcacttccgcatcgcccagggcggtctccccgggctatgcctcaagggtactcgcgacagaaacaacttcaggatccccctcaacgcccgtatccccggggggattgagctggctcaggaagaataagagctccggccacaccaccttgtgccggatcctcgacttgttcatgaaagcatgagtaaatgccctggggaactacgtctcagaaagacttgctaccccgggnctcgcctctctttaagggcggggggaaagaccccaggtgggtttatattcaccccaag

SEQ ID NO: 55836 - protein, 82 aa, Zea mays
  misc_feature: Ceres CLONE 1491712
  misc_feature (26)..(26): Xaa is any aa, unknown, or other
  misc_feature (27)..(27): Xaa is any aa, unknown, or other
MVSLAGAKRLHEVFYIPAPRGGGGGXXTPLVDRFLDPTPNRHFRIAQGGLPGLCLKGTRDRNNFRIPLNARIPGGIELAQEE

SEQ ID NO: 55837 - DNA, 923 bp, Zea mays
  misc_feature: Ceres CLONE 1491715
  misc_feature: Encodes the peptide sequence at SEQ ID NO. 55838
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (35)..(35): n is a, c, t, g, unknown, or other
  misc_feature (37)..(37): n is a, c, t, g, unknown, or other
  misc_feature (38)..(38): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
tttttttttnnnnnnntttttttttttggtgttgncnnccccgtnnnnnntcaaactggagctccccgcggtggcggccgctctagaactagtggatcccccgggctgcaggaattcgtctcacccctagaaaaaacggcagcgagccagcgactcctctcttcttcgtctcctacaagtagccagacaccactccgactttgccggcaacccgtcgacagcgacgaggcgcagcataaggcatacgggcacggcggccatggcgaccagctccaaacccgccgcgcccgtggaccccatggtcgtgctcgcccacgagttccccgaggtgtcattctactacaacgagagggatgtcgcgttgtaccccgctgcgggcttggtgcctgccgcggacgacgcccgtcgacgaagaaggagctctcagttcgtgttaccacaggggaggggggccggctctacattcatcggccctcgtatacccggccgcacgcattgtcgctggaagggtcgggaagagtggcccttaaaatactcctgtttctgggcaatccacacaccagccaatattcaccccccccacctgccctcctcttaccgcaaactctctatcttcactggtgcctatgtatcttaacgcgcacatggagacaagtgttttctgacgacaacgtgctcgtccggcgggcgtcgtggtagaataatacccaggaggagtctgcgggcgtgtatagccgccggccccacacctaccccccactctcctccgcttaccgtacttccaaatctacaaccaagtgctatactaaaaaaagaacattacgtcccacaaaacatctaataattacgacacccaagcaacacacacactaaagattatccaagatcttattataactattgcatgacatcatatacattaa

SEQ ID NO: 55838 - protein, 125 aa, Zea mays
  misc_feature: Ceres CLONE 1491715
MATSSKPAAPVDPMVVLAHEFPEVSFYYNERDVALYPAAGLVPAADDARRRRRSSQFVLPQGRGAGSTFIGPRIPGRTHCRWKGREEWPLKYSCFWAIHTPANIHPPHLPSSYRKLSIFTGAYVS

SEQ ID NO: 55839 - DNA, 758 bp, Zea mays
  misc_feature: Ceres CLONE 1491720
  misc_feature: Encodes the peptide sequence at SEQ ID NO. 55840
  misc_feature (358)..(358): n is a, c, t, g, unknown, or other
ggagctccccgcggtggcggccgctctagaactagtggatcccccgggctgcaggaattcgtctcacccctagaaaaaaccgacggcatttgcatctgagttcctgattgttgtattccagtttcttctgtgagttttgtgggatcgcgaggaagaactagaaggatgtcgtgctgcggaggcaactgcgggtgcggcgccggctgcaagtgcggcagcggctgcggagggtgcaagatgtacccggacatggctgagcaggtgaccaccactacccagactctcatcatgggtgttgcaccgtccaagggcgggttcgaggcggcccgcggagctgagaaacggcggtgcaagtgcnggcgccactgcacctgcgacccctgcaccctgcagtgaaacgaacgcgatgaccctgcagggcgtctggggatccgaaggacccttttccctaaacccctagaaaaaatcccacccaggcccttttggttttgttcgaatcaatccaaaatttcacccccgggcccgggggccagggaaaaaaaggcccttgcccccccctttttggcccccacccctttttccaagggggggccccgtgggggaaaaaaaaattttcccccaaattttgcgccccttttggggggggcccccccccccccccccgggggccctctttttaaaaaacaaacattttttttttttttttttttttttggccccctttttgagaaaaaaaagggcccccccctctctttttg

SEQ ID NO: 55840 - protein, 76 aa, Zea mays
  misc_feature: Ceres CLONE 1491720
  misc_feature (1)..(75): Pfam Name: Metallothio_2 Pfam Description: Metallothionein
  misc_feature (65)..(65): Xaa is any aa, unknown, or other
MSCCGGNCGCGAGCKCGSGCGGCKMYPDMAEQVTTTTQTLIMGVAPSKGGFEAARGAEKRRCKCXRHCTCDPCTLQ

SEQ ID NO: 55841 - DNA, 772 bp, Zea mays
  misc_feature: Ceres CLONE 1491721
  misc_feature: Encodes the peptide sequence at SEQ ID NO. 55842
atagctggagctccccgcggtggcggccgctctagaactagtggatcccccgggctgcaggaattcgtctcacccctagaaaaactaaaccctacccgactccgccgccgcccgccgctccgcctcagcgcatagcccgccgcgacctcatcgatcaccttcaactttcaatcatggcggacgtcgatgtcgaaccggaggttgccgccggagctcccaagaagaggacgttccgcaagtacagctaccgcggcgtcgacctagatgcgcttctcgacatgtccacggacgacctcgtccagctcttccccgcgcgcgccaggagaaggttccagaggggtctgaagaagaagcccatggcgctcatcaaaaagctgcgcaaagcgaaaaaagatgcccctgcgggggaggaaccggaaccagccaaaacccatctccggaacatgatcatttgcccctgaaatgaattgaaacctttgttgggggtcacaaacgggaaaaaccttcaacccagttggaaataaaccccgaaaattaacgggccccccccttgcgagaattcccccttccccaaaaaaccgggaaaaaattgggaggccccggtattcgggcccccccccccccgccgggtttttccccccaaaaaaacgtttcccccccctttgtttccccccaaaaacattttgggaattctccccccctttttccctttggttggaaaagtttaagccccctattttttttttttttctctccccccacaaaaaaaaaa

SEQ ID NO: 55842 - protein, 95 aa, Zea mays
  misc_feature: Ceres CLONE 1491721
MADVDVEPEVAAGAPKKRTFRKYSYRGVDLDALLDMSTDDLVQLFPARARRRFQRGLKKKPMALIKKLRKAKKDAPAGEEPEPAKTHLRNMIICP

SEQ ID NO: 55843 - DNA, 703 bp, Zea mays
  misc_feature: Ceres CLONE 1491726
tcaccgcggtggcggccgctctagaactagtggatcccccgggctgcaggaattcgtctcacccctagaaaaatagcaagaactcctgtccatccgattgtcacttgatctccttcccacatagctagattaaggccggtcgtcatccctattatagctagttttattatccatgggggaagagaagcaacaccaccaccacctgttccaacttaacaatgacgaggaacatgaagagcacctcgcccgcgtccggtaacgccattccctctagtacactgatgccactgagacggaggtggtgtccacggccgagaacgattacgacgattacaacgatgagaagcagcataagcacaagcagtacctcagccaggccggcaccatctgctcctgttccttcgcactctacgagaagcactaggcaaagaaggacccggagcacgcgcaccgccacaagatctatgaggaggccacgtcggccgggaccgtcggctccggttgtttccccttccacgagcaccactagaagaataaggaccacacggacgccataggagaccgcttctagaagaagcaccactgcttcgactgattgatccctcccgtatcctcgtccctccccgggtgctacacgtgctgggtgtgaaaccgatatcgaccgccctgctcgtttgtgagcgcaaagttaatgtatccgctc

SEQ ID NO: 55844 - DNA, 706 bp, Zea mays
  misc_feature: Ceres CLONE 1491730
  misc_feature: Encodes the peptide sequence at SEQ ID NO. 55845
aaagctggagctccccgcggtggcggccgctctagaactagtggatcccccgggctgcaggaattcgtctcacccctagaaaaattggaattctctcggaagattcatctagtttcaacaagtcattagaggagaatggtcctgtcttctttactgatagagacaaaatcaatctggcagacccagtgggtgtccaggaaaagatggcttcgttacgttccacatttggcatcgtctgcgatatttctcattctatcaagaattcgctaattacaaaacaggagcttttccataatattcttgccaacaacttggagatagaacagatgggagagatagaagagcagctacatattttagaggatctggctcccaattggatatctaagaaggtgataaatggagaagaaatactttacagctttgaaactatagcagatcagaattcagtgtgggaaaggcttgtagaagctgtgtgaggtgtggaatagctgggattggtttaaagctaaagaatcagccgcatagtactatgtatgtaacgctaacggaacccatcaaacagccacattttctcatcatgggaaatccttcaagaaattgcctccgtccttattcaaaaaaaaaaaaaaaaaaccagaacccctcccaaggtacccacatttcccccccattagggggagccccctttttacccccccccccg

SEQ ID NO: 55845 - protein, 91 aa, Zea mays
  misc_feature: Ceres CLONE 1491730
MASLRSTFGIVCDISHSIKNSLITKQELFHNILANNLEIEQMGEIEEQLHILEDLAPNWISKKVINGEEILYSFETIADQNSVWERLVEAV

SEQ ID NO: 55846 - DNA, 750 bp, Zea mays
  misc_feature: Ceres CLONE 1491737
  misc_feature: Encodes the peptide sequence at SEQ ID NO. 55847
ctggagctccccgcggtggcggccgctctagaactagtggatcccccgggctgcaggaattcgtctcacccctagaaaaagacgcacaggcgcacaccgacaagcgcagcgatggcggccgcgggggacggacagacgccgccgacgccgcaggagccggagccagtggcgggagcggcggctggaggcggcgtgatcgcgaagctggaagaggagtggcggaaggcaaaggagcacgcgcagacctacccgtacgtgtggggctcctacatcctcgtctacggcggcctcggcgcctacctcgcctggcgctggcgtaagctcccgcgccaccgaggaccgcgtcggcgttcttcagaacgcctccgcaagttttctgcggccgaggagtccaagggttgcttttgcccccgggttcgttttcactcctttgacccttccctggccaaagaatcggccttttgggccccaaaacgggttttttaaccgggaaaagaaaaaacttccttttttttttcccccctttttgggggggggggtttaaatttttcaggagggttttcccctttgaccccccccgggggggggggggccctcacgggggggggggccccctcccccaaagagggggggggggaattaattcaccgggcgggggggggggggggttcctttttgtggctcaaaatgggggggggggggcaacaaacttctcccgggggggggggccctcccccaaagatgtgtgtg

SEQ ID NO: 55847 - protein, 124 aa, Zea mays
  misc_feature: Ceres CLONE 1491737
MAAAGDGQTPPTPQEPEPVAGAAAGGGVIAKLEEEWRKAKEHAQTYPYVWGSYILVYGGLGAYLAWRWRKLPRHRGPRRRSSERLRKFSAAEESKGCFCPRVRFHSFDPSLAKESAFWAPKRVF

SEQ ID NO: 55848 - DNA, 654 bp, Zea mays
  misc_feature: Ceres CLONE 1491743
  misc_feature: Encodes the peptide sequence at SEQ ID NO. 55849
  misc_feature (76)..(76): n is a, c, t, g, unknown, or other
aaactggagctccccgcggtggcggccgctctagaactagtggatcccccgggctgcaggaattcgtctcaccccntagaaaaagtcgagtctaaccctagcgcgcgccgccacacctgccgttgctaccgccccgtacctcgcttgctttcccgtcgccgaaatgacgaagcgcaccaagaaggctggaattgttggcaaatatggaaccaggtatggcgctagcttgcgtaagcaaatcaaggagatggaggtatctcagcactccaagtacttctgcgagttttgtgggaagtttgctgtgaagaggaaagcagttggaatttggggatgcaaggactgtgggaaggtcaaggctggcggtgcttacaccatgaacactgctagtgcagtcactgtcaggagcacgattcgtcgcttgagagagcagactgaagcatgatttagcttgctacatcagggttctcctagttgctgttgtcgggaatgttgagctcctctagttggatcacgagactggctaaaagttgggtgctaagattttgagttggttaccgttgtgaatttctcaagggatattatcctatgcttggcccaatgacccaaatttggttgggggttccaagccttttgggctggtcaatggtttgccct

SEQ ID NO: 55849 - protein, 92 aa, Zea mays
  misc_feature: Ceres CLONE 1491743
  misc_feature (2)..(91): Pfam Name: Ribosomal_L37ae Pfam Description: Ribosomal L37ae protein family
MTKRTKKAGIVGKYGTRYGASLRKQIKEMEVSQHSKYFCEFCGKFAVKRKAVGIWGCKDCGKVKAGGAYTMNTASAVTVRSTIRRLREQTEA

SEQ ID NO: 55850 - DNA, 879 bp, Zea mays
  misc_feature: Ceres CLONE 1491748
  misc_feature: Encodes the peptide sequence at SEQ ID NO. 55851
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (281)..(281): n is a, c, t, g, unknown, or other
  misc_feature (283)..(283): n is a, c, t, g, unknown, or other
  misc_feature (289)..(289): n is a, c, t, g, unknown, or other
  misc_feature (536)..(536): n is a, c, t, g, unknown, or other
  misc_feature (781)..(781): n is a, c, t, g, unknown, or other
  misc_feature (879)..(879): n is a, c, t, g, unknown, or other
tttttttttttnnnnnnnnnnnnnggannnaannnnnnngnnnnnnnaaaagctggagctccccgcggtggcggccgctctagaactagtggatcccccgggctgcaggaattcgtctcacccctagaaaaatctgcccctccaacctctcctcttcctctggtctctggacaaccaagccagagaggagcagccagcgacaacctcctctcctctcctcccctcttattccgcgcccagcagcgaggcatggtggagaaggcgaggaccatggcgcgcantngctggnatatcccccagtggaaggccgacggcctgccgtcgccgacgagcccgctggaccgcgcgtcggcgtcgccccgtgggtggcgcccccgcgacgccgtaaggaagaaggccttggggttttcgggaattcctggcggttttctccaagtggccaaaaaggggtccgggggggggggcgcccccccaaggtgtgtccttcccccgggcgcccggcgggcgcgcgtggggggactcaaaaattccctttnttaaaggggtgggtgccccctgacactacgccccagaggatttttttactcggggcttccctaactggttccttcggagtcgccgcccacattctctccaccccacaacacacttctccgtaggtgaaaaataacctcatcaccgggaggccatcctgttagttacagaatcgaatcccttgcattcgcccccgagccaacacacaaacatccccccacccagggagggagggtggggttcaggncgcaggccctggcgggaagagccgtcgggttatggttcgatcataaacacggaccctccccccggcggcgcagtcgcaacgacaggtagttggttcan

SEQ ID NO: 55851 - protein, 95 aa, Zea mays
  misc_feature: Ceres CLONE 1491748
  misc_feature (11)..(11): Xaa is any aa, unknown, or other
  misc_feature (12)..(12): Xaa is any aa, unknown, or other
  misc_feature (14)..(14): Xaa is any aa, unknown, or other
MVEKARTMARXXWXIPQWKADGLPSPTSPLDRASASPRGWRPRDAVRKKALGFSGIPGGFLQVAKKGSGGGGAPPRCVLPPGARRARVGGLKNSL

SEQ ID NO: 55852 - DNA, 913 bp, Zea mays
  misc_feature: Ceres CLONE 1491752-R
gtctcgtttttttttttttttttctagacttttaatagatagatagatatttagcgtatgtcgatagattcaagaagagctcaaccctgaagacaaaaaggaggtggtttcactgcggctggtggcacgtggctagctactgtacttagtactgctactcctcttctctgcggagaagaaatgcctggcaacaaatacttctaggccggacctgatcctcttgtgggcggcgcccgcctggtggcggacggcgcccacggaccccccctcagacgcggcgcgggcgcctccgccttcggacgccgcgaagatcgaggtagaggtcggcgtaaaagtctacgacgcggcggatgttgttgttgagctccctgatgaggcccacgttgcgggagaggtcgccgggcaccttggtactcgtggttgtggttgatctccttgatcaggatgcagttctggtccaaaatcttctgcacctgctctaagatagtctggaacacgtgcattaccttggtgtactcgccgggggaccctgctcccccgaatccagacagcgtcggataacagccctccatcccttatcaatctcctcctatgaggtggtgctgcaggtgatcttcttctccccggggtgagactatttttcactcctgagggcgggaagaacaccacatctcatcggaatggggccttgtactcctcccccctcctaacaacaaaactcaggtgagaagatcttttaggagggtacatgattgctgtctacgcgggggattcccaggtcttaagcagacaccgcagccgggtacaccaacttagttgccgccttgggggggggttatttcccccttggcgtaatcaagggcaagcggttcccgggggaaatggttccggcccaattcccaaaaatagagcc

SEQ ID NO: 55853 - DNA, 706 bp, Zea mays
  misc_feature: Ceres CLONE 1491759
  misc_feature: Translation starting site: 163
aagctggagctccccgcggtggcggccgctctagaactagtggatcccccgggctgcaggaattcgtctcacccctagaaaaaatcccacgcattcgcatccttccccgctctcgctctctcagccgcagagccactcgtgtcggtgacggcggcgaaggcaatgtcatccctccgcccgtccctcctgctcgtggtgtcgctgctcgcggcggctctgcttgcagcggcgccgtcctccgcgtctcgcgacctccgcccgctccaggcgagcttcgtcgtgcgcggccgcgtctggtgcgacaactgccgcgcgggcttcgatacccccgcatccacctacattgccggagctaaggtgagagtcgactgcaaatcgaagaccaccggggcaaatacatgcagcttcgaggggcatactgaccgcaccggcacctacaacatccttgtcatttgatgagcatgagcatgagctctgcgagtccgtccttgtgagcagcccggacaaggggtgtgccaatgttgtggctggtcgtgagagggcccccgtcttccttgccagcaacaaccgtgttgcatccaacgttcgtttggcaaatgctctgggggttcagaaagacgttgcccttcctaaatgctcgcagatcctcaagatgtaccaggatgatgatgaccgtggcctatttttgcctgattttcgcttttct

SEQ ID NO: 55854 - DNA, 733 bp, Zea mays
  misc_feature: Ceres CLONE 1491761
  misc_feature: Encodes the peptide sequence at SEQ ID NO. 55855
  misc_feature (380)..(380): n is a, c, t, g, unknown, or other
ggagctccccgcggtggcggccgctctagaactagtggatcccccgggctgcaggaattcgtctcacccctagaaaaaagaagagagcagagggccagaggcgcagaaggcagtcgcggacaggaggaagaggaagaagaagcggcagcgagcgaggatgccgtgcctgaacgtgtcgaccaacgtgaacctggagggggtggacacctccgccatcctcgccgaagcctccaagtccgtcgccaacatcatcggcaagcccgaggcctacgtgatggttgttctcaagggttcggtgcctatggcatttggaggtacccaggagccagcagcttacggtgagctggtttccatcggaggcctgaaccctgatgtgaacnagaagcttagtgctggcatcgcttttatcctggagtcaaagctgtctgttcccaggtcgcgcttctacctcaagttctatgactcgaagcgctcggacttcggttggaccggctcccccttctaaaactgaaggctgccgttgaaataaaagaaattccgggaatcctgggacccaatgcccatgggcttttgccttttaaggaaatgtgcataaaagtgggcctaaaccggggctaaacggaaaaaacaaacccttttttccggaaaaagaaaaggggggcgcgggggttaaaaaagttttgttcccccccccaaaaaaagggccgcgtgtttttttttttttttttttttt

SEQ ID NO: 55855 - protein, 115 aa, Zea mays
  misc_feature: Ceres CLONE 1491761
  misc_feature (2)..(116): Pfam Name: MIF Pfam Description: Macrophage migration inhibitory factor (MIF)
  misc_feature: SWISSPROT Homolog: EC 5.3.2.1 Phenylpyruvate tautomerase
  misc_feature (75)..(75): Xaa is any aa, unknown, or other
MPCLNVSTNVNLEGVDTSAILAEASKSVANIIGKPEAYVMVVLKGSVPMAFGGTQEPAAYGELVSIGGLNPDVNXKLSAGIAFILESKLSVPRSRFYLKFYDSKRSDFGWTGSPF

SEQ ID NO: 55856 - DNA, 883 bp, Zea mays
  misc_feature: Ceres CLONE 1491765-R
  misc_feature: Translation starting site: 514
  misc_feature: SWISSPROT Homolog: EC 5.2.1.8 Peptidylprolyl isomerase
  misc_feature (809)..(809): n is a, c, t, g, unknown, or other
  misc_feature (883)..(883): n is a, c, t, g, unknown, or other
agcgtctcgtttttttttttttttttccttgaagattatcttatgataaagcctgacgggggtaacagcatccatctatccgcagtccatgctggttgatgcatgggtctgctggagccgatgatgaactccgcacttacaactgactcatagcgaccttgcaatcaataactcagatgggctactacgaacatgatacgaacgatgataaaccctctggactagggtaaacaacacggtagcgaactggataacttggccgcgcgggccccaacactcatttcctccagttcccttctgagttgccgtaacccccaccacggttgccaccttcgaaaccgccgcctccacctccataacctccttcctccaccttaatctccgccgacaccgccttattcgtcgccgccatgacgacgacctcctccatcttatgcacctcctccacggtctcctccgtagacaccggaaccgcctacactgtctcctagggactgggcctcgtataccgtgatgttgcggacatccagatccttgccgttcatgccatcaatggcgttccgcatcgcctcctccgtggagaaggtgacgaacccgaagccgcgagacctctgcgtctcccgatcgaggatgatcttggactcgaggacctcgccgtaggtgctgaatgctcctgggaggaaatggtcatccgtggcccaggcgaagccgcctacgaagcagcagtactcaacatccgacgccggcttctcgatgcgcttacccacgaaactgaaccgcggtagactcacgaccgcgatccgtaccgnaaggtgaggagaagctaccatctctatgagcactttttctagggtgagactattcttcagcccggggatcactn

SEQ ID NO: 55857 - DNA, 931 bp, Zea mays
  misc_feature: Ceres CLONE 1491766
  misc_feature: Encodes the peptide sequence at SEQ ID NO. 55858
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (28)..(28): n is a, c, t, g, unknown, or other
  misc_feature (29)..(29): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
ttttnnnnttgggggtgtgttttttttnnaggnnnnngccnnnnnnngaaagctggagctccaccgcggtggcggccgctctagactagtggatcccccgggctgcaggaattcgtctcacccctagaaaaaaactgacgagctcgccatggcctccctctcctctgccgccgtcaccgccccttccttcgccgcaccagcgccagcccgcgccgtggtcagaaggaggtccttcaccgtgcgcgcccctttccgcaagggcaccggcaccgccgccgtgtaaatggatgtatcgcctcccctccgcccccgcgccatggaccccacacgggctcttgaattctatgagaccgtggggcggatttttatatctaatctaatgtacattcacagcgcccgccccgcccctccctccggcgcactagtgtgaggcttggccgccgagagggggggcgggcagcaataccctgacggtccccacccccccccccccccccaccatatataattcctgtctctaccggttcccttcgccgcgccgctgcacggaggtgtagtgcgcccacctcccaggcaccagttccccgcatataatcccccccttctccccttttataatgttaaaatttccttcggggcccctcccgccggtatgtttcggtcgagtccacctcctgtctgtttgttgcttgactcgggtctgccgctcgcccctggattgctcattaatactttaaatgttttatctattctcccctagcagtgacacacacacaacgccacccacacaccttgggctgtacgctggttggggcccattgctacgcggtgcgcagccctaccctcgcacttgcgctgcacctccccctgagtccgctatcttggtcccgatgggcgcgccccgtgttccttacctcgttttaaattgtca

SEQ ID NO: 55858 - protein, 44 aa, Zea mays
  misc_feature: Ceres CLONE 1491766
MASLSSAAVTAPSFAAPAPARAVVRRRSFTVRAPFRKGTGTAAV

SEQ ID NO: 55859 - DNA, 874 bp, Zea mays
  misc_feature: Ceres CLONE 1491767
  misc_feature: Encodes the peptide sequence at SEQ ID NO. 55860
  misc_feature (14)..(14): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (31)..(31): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
tttttttttttttntttttnnnnnnnggggnggtnntnccccgcttttttttaaaactggtgctccccgcggtggcggccgctctagaactagtggatcccccgggctgcaggaattcgtctcacccctagaaaaaatctcccataacggagagagacgaagagagcagaagcgaagagcagcggcgcaaaggaaagggagccatgctcgcctcgccggcgctcgccggcgcccactccttcgcggcgtccgtgtatggaaacatcctcgtcccctcgcctcccgtccccgcgccggcacgtcgcgcggcgctgtccgtcgtcgccaaggtcaaggtggccacgccccaggacaaccgcatcgcccgccacgttcggcctgcgcaagaaggtaagtggcccccactgaaaggccgaaggttaaatgttttccggttcaaaaaaacattttgaccgcccaattcatcccaccgaaccaaaaccccccctcttccggggttttcgcctcaaccccgggcccaaaagcttccccccccaaggaattttgaacaaattaggcctggggccataccatcccaaaattcccccaaaaagtttcggtggggaggtggatttgccccgctcccgtgccctgggtagaaagggagaccccccatggtttgcccctccacccaggagggggggttccccccacccacaggctcccccaaaagggccctccgctcagattaccgcctaataatcagccggggttgttgatattcttagggcacccctggagggctttttcgtggtcgccaggcgaaccccccggtgtggcctgccgcattcctggtgttcttcactctatgtacgacaaaaacaattatttttta

SEQ ID NO: 55860 - protein, 82 aa, Zea mays
  misc_feature: Ceres CLONE 1491767
MLASPALAGAHSFAASVYGNILVPSPPVPAPARRAALSVVAKVKVATPQDNRIARHVRPAQEGKWPPLKGRRLNVFRFKKTF

SEQ ID NO: 55861 - DNA, 781 bp, Zea mays
  misc_feature: Ceres CLONE 1491774
  misc_feature: Encodes the peptide sequence at SEQ ID NO. 55862
  misc_feature (71)..(71): n is a, c, t, g, unknown, or other
  misc_feature (779)..(779): n is a, c, t, g, unknown, or other
ggagctccccgcggtggcggccgctctagactagtggattcttgggctgcaggattcgtctcacccctagnaaactcgccctcgcccgcctgtttaaacctgactgtctataacttaccgccggtccgcacccgcccaccgtccctgtccccttccccgtctaagcactcggatcctctgccgccgcgatgagctactacggccagcagcagccgcccgtcagcgcgccgccggcgcaaggttatcccgggaaggacgcgtacccgccgccgggctacccgcccgcgggatatcctcccgccggcgcagggctacccaccgtagggttacccggcgcagggctaccctccgcaatctttttttttcccccccccgagaggggggggggggggggtccaacctctcccccccccccccatctcgtggtgggagcggcgtagcccatttttttgagacggaatggttggtggctgtgctttgttgtcagccgccctttctgccagccgcagcctccggaaattagagggcggcggatcgccgtccgttagtgacctttgcgtttctgtgttagacggagcgaacctacacgtgggtgatatgaggagctgtcgcgtgcggagagcctgttgtcacaagaggagtcgccgtctcctaatcgttggtgtcttcgtagatttcgcctccagctatgccgtgcgagttcgattctggccattgtgtttgtagggttggtgttatggctgattgcaggacgacgcccctcgccccccgcgtcccgncg

SEQ ID NO: 55862 - protein, 83 aa, Zea mays
  misc_feature: Ceres CLONE 1491774
MSYYGQQQPPVSAPPAQGYPGKDAYPPPGYPPAGYPPAGAGLPTVGLPGAGLPSAIFFFPPPERGGGGGPTSPPPPHLVVGAA

SEQ ID NO: 55863 - DNA, 971 bp, Zea mays
  misc_feature: Ceres CLONE 1491775
  misc_feature: Encodes the peptide sequence at SEQ ID NO. 55864
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (9)..(9): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (41)..(41): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (712)..(712): n is a, c, t, g, unknown, or other
  misc_feature (859)..(859): n is a, c, t, g, unknown, or other
  misc_feature (971)..(971): n is a, c, t, g, unknown, or other
nnntttggnttggtgtgttggtgtttaacacannnnngggngnnnnngcatagctggactccccgcggtggcggccgctctagaactagtggatcccccgggctgcaggaattcgtctcacccctagaaaaaaaccttatcggtctatctatccttgtgtccccattcccatcccgagactggagaaggcagggatgctgctcctgagctcccccttcgtgtccgtgtcgccgccgccgccgccgctcagctccgatggcgctcgcccggcgctgcggagcgaggcggccaatcagctgaaaggccgggtggtgacgaccaaagcagacaagacggtcggtgtggaggtggtgctcctggctcccactccccaagtacccgcggcggggagcgccatattgtattatgtaccagtgggtcaggacccccttgagaccatattcaaggttgggggaaaaattctttaaaaccttccaacgcgtctgggcccccccccctccaaggccccgtggtaatttgtcctggggcggtttccctggtttccccggcccccccggggacaattttggccggggagggtttggatgggctttccgtgtgcgtggccgccctttcagtgtctcccgcagacataacgctaggccgggataagaggcccgtgttcgtcccggctcaagagagtagatattgtatctctctgtgctatcacganatttgcctgttcgcggtgtatatgtagaggccttttgtgtcgtaggaaagcctctccccctctcccctcacaacaagaggtggtggggggtcttccacaagagccccccacactgcgacaaacggaggcggtgtggcgtattttttnaccgccgataaaactattattccttcctctccccactgacaaacaactaaagagtagacatgcagccgcaccattggtcccctacgaaagagaccgtagggtggcgggggan

SEQ ID NO: 55864 - protein, 90 aa, Zea mays
  misc_feature: Ceres CLONE 1491775
MLLLSSPFVSVSPPPPPLSSDGARPALRSEAANQLKGRVVTTKADKTVGVEVVLLAPTPQVPAAGSAILYYVPVGQDPLETIFKVGGKIL

SEQ ID NO: 55865 - DNA, 696 bp, Zea mays
  misc_feature: Ceres CLONE 1491779
  misc_feature: Encodes the peptide sequence at SEQ ID NO. 55866
  misc_feature (696)..(696): n is a, c, t, g, unknown, or other
aagctggagctccccgcggtggcggccgctctagaactagtggatcccccgggctgcaggaattcgtctcacccctagaaaaaaaaggaaatgaaatcctcaagaagtttcctttctccttccttgcttctccaactcattttgctttgctttgccttgccttgcctggctcctctcccctgtatctataaatataagagtgctcggaccgtgagattatatattccctcggagcaaagtggtgtggaattcacatcaaccagggagaagcccgctgctcgctgcaactgcaagccgtcacgggctgagctgaggctgtgtcgaactgtcgatccatccgtattctcagcaaaacaacgccaatcaatccactccagaggaagggcgatggccgccgctaggatcgccgcttgcaccacctccgcccgcaccgccctcgccttggcagacgaccccgcgccgccggacacgctggacgtggtgcgccggcagcgccagctcctacgccgcgccgccgcgctctgcctcgaccccatcgccgaggagtccgacggtggcatcgactctgcctccgacgtccaccccttgggtcggagccggggccagaccgccgccacctccgcactgccggcgcggccctgaggatctgaaccgtcaaagacgagacctttttctccttgccctaagagtggagtn

SEQ ID NO: 55866 - protein, 84 aa, Zea mays
  misc_feature: Ceres CLONE 1491779
MAAARIAACTTSARTALALADDPAPPDTLDVVRRQRQLLRRAAALCLDPIAEESDGGIDSASDVHPLGRSRGQTAATSALPARP

SEQ ID NO: 55867 - DNA, 832 bp, Zea mays
  misc_feature: Ceres CLONE 1491781
  misc_feature: Encodes the peptide sequence at SEQ ID NO. 55868
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (36)..(36): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
nnnnnnnnnnnnnnnnnnnncccccctttttttttnaaaagaaannnnnnacagactggagctccaccgcggtggcggccgctctagaactagtggatcccccgggctgcaggaattcgtctcacccctagaaaaaacctgcagccaaccatctaccagcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggaaggggggtggcctgaccgtctaccgtctacgccatcgggagaaagggctaagggcaaggtcgtgtacctgtttcgttcgaccagggacgggcgcccaaacctcaactgaaacagccccaatccaaccacaaggaatgactggatctctccaccggggtaacgacttccgtcgcgcgggaaccacccggggccaccccgacctgcgggccgggccacccctcgcccgggaataccttgggaggggggggccccctcccctcgcgtcaaccaacaaccaccctgaccctctaacgggtgaaaaggagtatccctatggccctccccccctccccggcccaccgcccccatcgtagagaagccggggggggcgggggcggtgtataagcgcaacgctcgccggggcggcgcgatcgacgcgcgggatggaggcggaaaccaccaaacttacaccgtctcctccccaacaccgacacga

SEQ ID NO: 55868 - protein, 161 aa, Zea mays
  misc_feature: Ceres CLONE 1491781
MAASMISSSALAVAPQGLPPLGRRASSFAVVCSKKKIKTDKPYGKGGGLTVYRLRHREKGLRARSCTCFVRPGTGAQTSTETAPIQPQGMTGSLHRGNDFRRAGTTRGHPDLRAGPPLAREYLGRGGPPPLASTNNHPDPLTGEKEYPYGPPPLPGPPPPS

SEQ ID NO: 55869 - DNA, 728 bp, Zea mays
  misc_feature: Ceres CLONE 1491786
  misc_feature: Encodes the peptide sequence at SEQ ID NO. 55870
atagctggagctcaccgcggtggcggccgctctagaactagtggatcccccgggctgcaggaattcgtctcacccctagaaaaacatccaactcacacacaggctcaccccaccaacagcaagcgaaaatctcccgatcccctctggtctccgcggcgaagatgtcggggcgcggcaagggcgggaagggcctgggcaagggcggcgcgaagcgccaccggaaggtgctccgcgataacatccaggggatcacgaagccggcgatccggcggctggcgcgcaggggcggcgtgaagcgcatctccgggctcatctacgaggagagccgcggcgtcctcaagatcttcctggagaacgtgatccgcgacgccgtcacttacaccgagcacgcgcgccgcaagaccgtcacagccatggacgtcccctacgcgctcaagcgccagggccgcaccctctatggcttcggcggctaggctaagccggccgcgcctcgctgtcgtcgctgcggttctatttgtttttgcaattcccaagtagtggctcggcggcaaaaatgctgggtactgtggcactaaaatcaagcatgttgtgcctgtcctgaagaaaatgccaatttgggactttcctgttttgtccaaaaataaaaaaaaaaaacggagacgcctccgagggcaccccattttcccccttaaaggggagttcggtattaccccccgccttccttgggc

SEQ ID NO: 55870 - protein, 103 aa, Zea mays
  misc_feature: Ceres CLONE 1491786
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVKRISGLIYEESRGVLKIFLENVIRDAVTYTEHARRKTVTAMDVPYALKRQGRTLYGFGG

SEQ ID NO: 55871 - DNA, 848 bp, Zea mays
  misc_feature: Ceres CLONE 1491789
  misc_feature: Encodes the peptide sequence at SEQ ID NO. 55872
  misc_feature (1)..(1): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (15)..(15): n is a, c, t, g, unknown, or other
  misc_feature (20)..(20): n is a, c, t, g, unknown, or other
  misc_feature (21)..(21): n is a, c, t, g, unknown, or other
nttttgtttnnnggnaaaannttatattttttttatttttctccttttgtgtcaaactggtactccccgcggtggcggccgctctagaactagtggatcccccgggctgcaggaattcgtctcacccctagaaaaagatggccatggggttcccaaattcgacacgctctctcttggcttcactttgcaggcggctacggaactctggaagaggtgcttgaggtcatcacctgggcgcaactaggaatccataagaagccggttgggcttgtgaacgtggatgggttctacgacccgttgctgtccttcatcgacatggccgtgaaggaagggttcatcaaggaggacgctcggcgcatcgtcatctcatctcccacggcgaaggagcttgttctcaagcttgaggagtatgttccggaatactaagtcagttttgtgtgggaggatcagatcccggctgttgtaacttgtaaatctccggtattgcctttctcctcgtcactagaacttagagctgccctttccctgaacctcgtcctgaggcccggaatctactaattattttagcatcctattactgaatataacacaccgaagcttagctctaagagctcagccccggtgggcgcttgtgactatgtaggaaacgggtcgaatgcgggttctttccttttactttcattatccctctagcacgtcgagtggaaaaagcacctttcactcccagcactgagctcgacaccttttcatggggccgtatttcgcccccatcaatcacaaatccaaataaaggaaacaggcaatgacagatctgcacctcaaacagtacaaaccacccaaggtgtaga

SEQ ID NO: 55872 - protein, 36 aa, Zea mays
  misc_feature: Ceres CLONE 1491789
MAVKEGFIKEDARRIVISSPTAKELVLKLEEYVPEY

SEQ ID NO: 55873 - DNA, 769 bp, Zea mays
  misc_feature: Ceres CLONE 1491790
  misc_feature: Encodes the peptide sequence at SEQ ID NO. 55874
  misc_feature (1)..(1): n is a, c, t, g, unknown, or other
  misc_feature (2)..(2): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (19)..(19): n is a, c, t, g, unknown, or other
  misc_feature (20)..(20): n is a, c, t, g, unknown, or other
nnttttnnnnnnnnttttnnttttttgtttgtgtgggttgtggttttttttattcaaaactggtgctccaccgcggtggcggccgctctagaactagtggatcccccgggctgcaggaattcgtctcacccctagaaaaacctaggtccatgttcgtgtcgcagttgatcgggaccgcccttggttgtgtcattgctccactcaccttttggctctactggtcggctttcgatattggtaaccctgacggcgcattcaaagctccatatgctgtaatcttccgtgagatgtcaattcttggcgtggaagggttttctgcactgcctcagcactgcctagcgatctgctcgtttttcttcattgcatctctagtgataaacctcctcagggacgtcaccccaaagaatgtctccagattcatcccaatcccgatggctatggccattcccttctacatcggtgcgtacttcgccatcgacatgtttgttgggacagttatccttttcgtctgggagagggtgaaccgcaaggagtgtgatgacttcgcaggtgcggttgcctctggcttgatctgtggtgatggaatctggactgttcctcctgcctaactgtcaatccttaagattgacccgccaatatgcatgttattcagaaccacactttatcagctaaagttggcacaaagtgtcaacccatttttctcgaatacccaaacaacaaacctaatttgaaggattatctttataactctccccaacattgtataacg

SEQ ID NO: 55874 - protein, 201 aa, Zea mays
  misc_feature: Ceres CLONE 1491790
  misc_feature (2)..(2): Xaa is any aa, unknown, or other
  misc_feature (3)..(3): Xaa is any aa, unknown, or other
  misc_feature (4)..(4): Xaa is any aa, unknown, or other
  misc_feature (6)..(6): Xaa is any aa, unknown, or other
FXXXFXFFVCVGCGFFYSKLVLHRGGGRSRTSGSPGLQEFVSPLEKPRSMFVSQLIGTALGCVIAPLTFWLYWSAFDIGNPDGAFKAPYAVIFREMSILGVEGFSALPQHCLAICSFFFIASLVINLLRDVTPKNVSRFIPIPMAMAIPFYIGAYFAIDMFVGTVILFVWERVNRKECDDFAGAVASGLICGDGIWTVPPA

SEQ ID NO: 55875 - DNA, 794 bp, Zea mays
  misc_feature: Ceres CLONE 1491792
  misc_feature: Encodes the peptide sequence at SEQ ID NO. 55876
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (794)..(794): n is a, c, t, g, unknown, or other
ttttnnnnnnnttttttnnnnnntttttttttattttttttcatctattatgccaaaactggagctccaccgcggtggcggccgctctagaactagtggatcccccgggctgcaggaattcgtctcacccctagaaaaaagctctgctcactctcatcacttcgctccaagccagtgctagcccggccccttgtgtacgtgagagacggcatcgtaccgtagagcagcatccatggcggctcagggaagtggcagtgctcgtggcagcggcgccgccgccgcgcttgcgctggtcctcctctgcgtgctcctccacggcgagttggccgagtcggcggagtacacggtcggcgaccgctgcgggtggagcttcaacaccgccaactggcccaagggcaagcggttccgcgccggcgacgtgctcgcgttcaggtacaacgccaaggcgcacaacgtggtgcccgtgagcgcggcggggtacaagtcctgcagcgcgcccaagggcgtgagggctctcaccaccgggaacgaccgcgtcacgctgaagcgcggcgcctactacttcatctgcagcttcccaggccaatgccaggccggcattgaagatcgctgtcaccgtcccagtgaggcccccggaacgattcagccgcgccccggcgactaccaaacgtacggaaaccacgggtctccaatccggtggcccagcctttttcacttattgcttaatttccgcctctcccaatagtaaaaagtctttccccgattccccttaaaccctacatttgccgtggatn

SEQ ID NO: 55876 - protein, 170 aa, Zea mays
  misc_feature: Ceres CLONE 1491792
  misc_feature (45)..(123): Pfam Name: Cu_bind_like Pfam Description: Plastocyanin-like domain
MAAQGSGSARGSGAAAALALVLLCVLLHGELAESAEYTVGDRCGWSFNTANWPKGKRFRAGDVLAFRYNAKAHNVVPVSAAGYKSCSAPKGVRALTTGNDRVTLKRGAYYFICSFPGQCQAGIEDRCHRPSEAPGTIQPRPGDYQTYGNHGSPIRWPSLFHLLLNFRLSQ

SEQ ID NO: 55877 - DNA, 882 bp, Zea mays
  misc_feature: Ceres CLONE 1491807
  misc_feature: Encodes the peptide sequence at SEQ ID NO. 55878
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (46)..(46): n is a, c, t, g, unknown, or other
nnnnnttttnnnnnnnnnnntttgtttttttcttttctctctattnttttcaagctggactccccgcggtggcggccgctctagactagtggatcccccgggctgcaggaattcgtctcacccctagaaaaaaccacacatcccttcctctctctctctcctcgagcattcgtgctgctccgaccccaccgccacaggctcggcggtccggcgatctcgctcaccggcgggaacatgactacttcacggcgccttgctgacaggaagactgctaagctcctgaagaacatcaccaggaggggttctgtgcctgaaaccactgtcttgaagggaaatgactaccctgttggccctctattgcttgggttcttcatcttttgtcgtcattggatcatcataggtttcagatcatcaggaacggcgaccaagcagcggggctgggctttgagagcctggcccacattctaaatcccccagttataagaggagtggctttggttataacatggcatcccagtctatggaatatgttgtagcattccattaagatgtttaagaccgtgaacatagaactggccccctggccctttcaccgtttccatccttgagtgtggggcccttggataattgttggataacttggacacccattaacgggcactgaaattcgtcgttaaccctttcgacatcaagatgtgcttcataattgcgataaaacttgcgcaaccgcccacacgcgtgtcccacgtgcaaaaaaagatgaaaaaagaaaataacgatgcagggcttctgaggagaggcaccaaaccccccaccaaagaatggggattaactagtgagtactacgggataacgaactgaagaccgagcgtgattataata

SEQ ID NO: 55878 - protein, 77 aa, Zea mays
  misc_feature: Ceres CLONE 1491807
  misc_feature (1)..(65): Pfam Name: RAMP4 Pfam Description: Ribosome associated membrane protein RAMP4
MTTSRRLADRKTAKLLKNITRRGSVPETTVLKGNDYPVGPLLLGFFIFCRHWIIIGFRSSGTATKQRGWALRAWPTF

SEQ ID NO: 55879 - DNA, 841 bp, Zea mays
  misc_feature: Ceres CLONE 1491811
  misc_feature: Encodes the peptide sequence at SEQ ID NO. 55880
  misc_feature (1)..(1): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (15)..(15): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (841)..(841): n is a, c, t, g, unknown, or other
ntttttgttnnnttntnnntttttttgttttttttgaagaccannnnnnacaagctggtgctccccgcggtggcggccgctctagaactagtggatcccccgggctgcaggaattcgtctcacccctagaaaaattgttaagatcctacagagctagccgcgactacccttatatcttcccaccttgagagatggtcggtggaatccggcatgcctggggccagggcaacagtggtaagttcttgaatcgtctccccttttgcatggtcaggaaaagcctctctggcctgcgcccttatcgtggagcatcacgaccgggaatccttcatcattcctctgtaccaccgcccccctccctttcagtgtctggacatatggccacccaggcccccctttattacctgtgaattctcccactcgagaggaggggtaccgaacggataacttttttctagccatgttacatcctctattggacccttgtcctccatttttgctttttggacattggccaccgtaggaattgtggtagctgggcgttcacgtagttgtaagtgttatttgattttcctcaaaccccgaaaaaagataccggggaaatttccagagggacagaagcctctctgtgttctttgcttcctcgtgaaaaaccattgcacaccgcacacacaaaaactttaaatgggccctggccccggcattctgtcggtagcaacacccttttgcgcccctgataataaacaaaaaaatataccaaaccgtcccctaggtgtacccaatgctcgtaccattctgttgtagtcagtagttttccccggtcgtgtctattagtcgattggtn

SEQ ID NO: 55880 - protein, 71 aa, Zea mays
  misc_feature: Ceres CLONE 1491811
MVGGIRHAWGQGNSGKFLNRLPFCMVRKSLSGLRPYRGASRPGILHHSSVPPPPSLSVSGHMATQAPLYYL

SEQ ID NO: 55881 - DNA, 730 bp, Zea mays
  misc_feature: Ceres CLONE 1491816
  misc_feature (730)..(730): n is a, c, t, g, unknown, or other
aagctggagctccccgcggtggcggccgctctagaactagtggatcccccgggctgcaggaattcgtctcacccctagaaaaatccgttccttccgtcctccatccgccatggcgaccgctacgactactgagctcctccttcctctatgatccgccgccgcccgtagggcctcctccccttcctccgcctcatggagcttcaccacgtctcaactcgccggactctccctcttcaccggcgttgacactccaacacgctcgatctccctcctccccacgaggcaccatgctccagcccatcgtctctacggcgagtgtgcccgctcacgcactgaacgacaaaccgcgttaacatgtgagcctgtactaccacaagacgaataatcagcacttattcctcctgcactgctcgaggcagtgatgagatgactcctatggattcctacatgtgcgcctgtccgcctagacatcggctcttctagatgcactgactcaacttcgtaacacgatagcgccgagaactacttaagatcgaactctctgtcaaatgcgcccatacgatgaatcttctactacccgtcacaagcttcatgctcagcgttcacactcacactggacctctacgacagacagtcgcgcctgccagcaccatgctgctttatagatatccaaccaaaacctttttcaaccccaaaaatacagaatcctccctcccatctagtgacctan

SEQ ID NO: 55882 - DNA, 865 bp, Zea mays
  misc_feature: Ceres CLONE 1491817
  misc_feature: Encodes the peptide sequence at SEQ ID NO. 55883
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (27)..(27): n is a, c, t, g, unknown, or other
  misc_feature (30)..(30): n is a, c, t, g, unknown, or other
  misc_feature (31)..(31): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
ttgggttggttttttttttnnnnnngnagnntnnnnntttnnnnnccatactggagctccccgcggtggcggccgctctagactagtggatcccccgggctgcaggaattcgtctcacccctagaaaaaaagaaccactttcacctgaactcctgaagcaatggccatgagagctctcccgctgaccccttccaggagctcctcgtttggagctcaccaaaccaggccgagcggcggcggccccagatcagtgagagcttatgcgaagggagacgaggagggcgacaagcagtccctgttcagaagcatcaccgaggcgctggacttctcgcatgtccggtctgagaaggacgccgagctgctgtacgaggccacggagtccaccacaggtggagggaggatgacgagggagcattacggagcacttaagaaaaagattggtggcacctaccacggatttcttccagccatatgtttaaagccgacggggccatacctggaggaggggttgggtccgacaaaacctgccagaatctggcaaaaggggtcaccaagggggggagccccaaggccaggtttgacaaaccttaggaaagattacgcctcaccgttggcggtgtccgtgggagaaaccccctaacccctaccaaaatttttttccgcccaaaaatccttccgccagaaatgaaacatatgcctggcgttccgttacgaaaagccgttcggcctccccctccccctccgggggtgttagcagaagctcccactattttccagggttaagggttcttgtttgttggcctttccaaaaggggggacacaagaatgtggggcccaccgatatttgtcccaaatagtggtattg

SEQ ID NO: 55883 - protein, 159 aa, Zea mays
  misc_feature: Ceres CLONE 1491817
MAMRALPLTPSRSSSFGAHQTRPSGGGPRSVRAYAKGDEEGDKQSLFRSITEALDFSHVRSEKDAELLYEATESTTGGGRMTREHYGALKKKIGGTYHGFLPAICLKPTGPYLEEGLGPTKPARIWQKGSPRGGAPRPGLTNLRKDYASPLAVSVGETP

SEQ ID NO: 55884 - DNA, 750 bp, Zea mays
  misc_feature: Ceres CLONE 1491821
  misc_feature: Translation starting site: 144
ctcgctggagctcaccgcggtggcggccgctctagactagtggatcccccgggctgcaggaattcgtctcacccctagaaaaatcaagcatttgtccttctggaagtttccacactcccttcccttcccttgtacccactccaatggcgccctccctcctcgccgccgtctcagcctcgcccttcctcctacccggcagcagccgcaggccgctgggcgctgcccccacccgccgggccggactgcgcgtggccgcgcttaagtacgaccctgccaaggtggcaccgcagaacgaccgggtgctcgtccgtcttcagcagatccctgagaaatctgctggtggtgtattgcttaccgaaatctgcttttaactttgccaggttccggatgggggagattctcacggttggtgctgatgcccccgaagttaaggctgggaaaaaagttctcctcctcaaaatcaatgcttacaaggcggaaccttgataccgatcgagaagcactggcttcctgccggtagtctaatttttcttagcttgtctaccaatgaaaccttcaccaccgacaattaacatagctttataattccactacccccactggcatgggaactaccccttgccacactcctctgtgtgtcattataaacccactctctccataaggacacgttaagccttctcacccccccgctacctcttctctcactgtactacatatattgtactgttcccacaccacctcatctcg

SEQ ID NO: 55885 - DNA, 460 bp, Zea mays
  misc_feature: Ceres CLONE 1491823
  misc_feature (202)..(202): n is a, c, t, g, unknown, or other
aagctggagctccaccgcggtggcggccgctctagaactagtggatcccccgggctgcaggaattcgtctcacccctagaaaaaaaaaaccctaatcgcatctgcttccagagccccccgccgccgctgcgccctcctctcggtcctgccgtccgtcgaggtaaaaggacagcatggtgagggtcagcgtgctcaatgatgncttctcagtcccatggtacaaagggcttgaaaaagaatatagggaaacgcaggtctgatcaggcctctccaaggggaatattagtttcctaaagggattggagccccttgggttttatttggggaaatttttcaaaaattcggggaaaaccacaaaaattgggaaaaaaattcgggggggggtcctttttgggaaaaaccaaaaaaaagggggggggggtttttaacccccccccctttttttaagaaaaggagggga

SEQ ID NO: 55886 - DNA, 717 bp, Zea mays
  misc_feature: Ceres CLONE 1491827
  misc_feature: Encodes the peptide sequence at SEQ ID NO. 55887
  misc_feature (717)..(717): n is a, c, t, g, unknown, or other
atagctggagctcaccgcggtggcggccgctctagactagtggatcccccgggctgcaggaattcgtctcacccctagaaaaacggcggcgctcggttccgtggcggggagtgttttccaggcggcggcgcggtagcgtgaaaccgggcgaccgagcaagcgacggccatggcgttctggcagacgcgcgattttctcttctgtggcatatgcggcaccctcctcaccttcgactccgtccgctccgcctcctgccctctatgcggcttcaagcgcgatgccaaagaaattgaagggaaagaaatacagtacacgatgaccgccgaggatattcgaagagggttaaagacacaaacggaggacgttgttgggcaaagaccagtgacaaataaagcctgtccaaaatgcgaccatccaaaagctgaattttacaacatacagatgcgttcagcagatgagggagagacgacgttctacatgtgtaaaggatgcggctgtaatttcaaagacgaatgaggagttatcctaccacttcttcggatatatggcattggtgccgaagaaattcccagcgttgacagactagtactccctccgcccttttttttatttatcatccgtctagtttcaaaaaagaacccggccggataaatatttcgaaaatttgcaatcctactcctcttgacattggtttccatttacatgggaatgccgctn

SEQ ID NO: 55887 - protein, 115 aa, Zea mays
  misc_feature: Ceres CLONE 1491827
  misc_feature (75)..(113): Pfam Name: TFIIS_C Pfam Description: Transcription factor S-II (TFIIS)
  misc_feature: SWISSPROT Homolog: EC 2.7.7.6 DNA-directed RNA polymerase
MAFWQTRDFLFCGICGTLLTFDSVRSASCPLCGFKRDAKEIEGKEIQYTMTAEDIRRGLKTQTEDVVGQRPVTNKACPKCDHPKAEFYNIQMRSADEGETTFYMCKGCGCNFKDE

SEQ ID NO: 55888 - DNA, 805 bp, Zea mays
  misc_feature: Ceres CLONE 1491830
  misc_feature: Encodes the peptide sequence at SEQ ID NO. 55889
  misc_feature (79)..(79): n is a, c, t, g, unknown, or other
catgctggagctcaccgcggtggcggccgctctagactagtggatcccccgggctgcaggaattcgtctcacccctagnaaaaccctcagcacgccgccgctacagcccgcacctcgtttcctctcccgtctccgagatgacgaagcgaaccaagaaggccggaattgttggcaaatatggaaccaggtatggtgctagcttgcgtaagcaaatcaagaagatggaggtatctcagcactccaagtatttctgtgagttctgtgcgaagtttgctgtgaagaggaaagcgcttgggatttggtgatgcaaggactcgtgggaaggtccaggccggtggtgcttacaccatgaaacactgctagtgcggttagtgtgcgggagcaccatcccgggggggggagggaacaaacattaatccatgatcggccccccccgcacaggtatactggaggtccctcttctattggggttgcgccaccgcgaacccacttcctcccgccctttcgcatgggtctttgtctcttaataatcctctaaaaggccgcggcgcgccacttgatttccacccttcgcggtacagaatgtagaaattacgcctagtgggagactttgcacctccctggcttgttaccgttattgacccgccgcgaaaaaaagacattgacctggtaccgctcttttagttcttccccctttccccccttcccgacaaccgcgaaacacctcctacccccgtggtgcgttttatggtttatcatcctcctccgtggctaattcccctcctgtcgccgacctcccgcccgc

SEQ ID NO: 55889 - protein, 55 aa, Zea mays
  misc_feature: Ceres CLONE 1491830
  misc_feature (2)..(56): Pfam Name: Ribosomal_L37ae Pfam Description: Ribosomal L37ae protein family
MTKRTKKAGIVGKYGTRYGASLRKQIKKMEVSQHSKYFCEFCAKFAVKRKALGIW

SEQ ID NO: 55890 - DNA, 907 bp, Zea mays
  misc_feature: Ceres CLONE 1491832
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (28)..(28): n is a, c, t, g, unknown, or other
  misc_feature (34)..(34): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (871)..(871): n is a, c, t, g, unknown, or other
tttttttttttnnnnnnnnnnntgatgngatagnagtgggtgtnnnnngcctttttttacaaactggtgctccccgcggtggcggccgctctagaactagtggatcccccgggctgcaggaattcgtctcacccctagaaaaaaccttgccatcacctcctcgcctagcctgccactgccagcaggtgccaccgccatctctgctctgctctcgcaacgcaagcacacgcccggccgcctgccacagttgccatgtgcgaccatgccacgatggcgctgctgaagcccgccgccaagccgctgaccgttcggttccttcatcagcagccgccgcgtctccctcgcgttcccgatgtgcaagacctcccaaaaagctctttttttctttttcccccttctcctttttttgcggccttctccttccacactcctgaggattactacccgaacgttgccccatgcttaaattccttggggggggggcgaaaccccagcggttatcctctctcctcgccaatcaaccccccaccaaccaatcgagtaccgccacctatttcaatgggtgggagccatatacaaaatcccccccccccacgcctcccccacaaccacacggggaggccggcttcgcccccctccttcctccctccccgctggccgacctccatcaagtgcttctttctcgcattttcctcctctcgtcgttcgatgttgccgtccccttttcccgtttgtttttctctctcccctcacacacttcggacgctcacaaccaaccagcgcgcccactagcgcgatagacacgacacctaactatcgcataaacaccaccctcacatacaaactataaaacctaaactagatataatcnaaacaccacaaatcaacaatcgaactctatcccaca

SEQ ID NO: 55891 - DNA, 746 bp, Zea mays
  misc_feature: Ceres CLONE 1491833
  misc_feature: Encodes the peptide sequence at SEQ ID NO. 55892
  misc_feature (400)..(400): n is a, c, t, g, unknown, or other
  misc_feature (402)..(402): n is a, c, t, g, unknown, or other
ggagctccccgcggtggcggccgctctagaactagtggatcccccgggctgcaggaattcgtctcacccctagaaagagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcaaaccatccgccacatgatcgaggatgactgcgccgacaacggtatccctcttcctaacgtcaacgccaagatcctatccaaggtaatcgagtactgcaacaagcacgtacatgccgccggcgttttttttcgccccccccaagggggggggggggggaatttantncctcctccccccaacccctccggtgccttcggtgaagacctcatgaacccggaagggggacttcgtccaggccaaaccaggccccgctttgtcgacctctgcctgggttgcttcctatcttcaagatcagggggtctgcgggaccccgccccgggccgaccggttggctgaacaggattaaaggggcaagagtacccgagagagtgtccccacccaccttgcactaccgaacacagcacgcaaccccccggaagcagagacaaaaaagaaccccccccgcccaccaacccgctgcgccgccaccgcctgcccggcgggctcggcgacccccctccggcgcgtcc

SEQ ID NO: 55892 - protein, 142 aa, Zea mays
  misc_feature: Ceres CLONE 1491833
  misc_feature (8)..(68): Pfam Name: Skp1_POZ Pfam Description: Skp1 family, tetramerisation domain
  misc_feature (86)..(86): Xaa is any aa, unknown, or other
MAAEGEKKMITLKSSDGEEFEVEEAVAMESQTIRHMIEDDCADNGIPLPNVNAKILSKVIEYCNKHVHAAGVFFRPPQGGGGGNLXPPPPNPSGAFGEDLMNPEGGLRPGQTRPRFVDLCLGCFLSSRSGGLRDPAPGRPVG

SEQ ID NO: 55893 - DNA, 907 bp, Zea mays
  misc_feature: Ceres CLONE 1491834
  misc_feature: Encodes the peptide sequence at SEQ ID NO. 55894
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (52)..(52): n is a, c, t, g, unknown, or other
  misc_feature (53)..(53): n is a, c, t, g, unknown, or other
  misc_feature (613)..(613): n is a, c, t, g, unknown, or other
  misc_feature (891)..(891): n is a, c, t, g, unknown, or other
nnnnnnnnnnnnnnnnnnnnnnnnnnnnngggagggggggcttcggtttttnnttaaaactggtgctccccgcggtggcggccgctctagactagtggatcccccgggctgcaggaattcgtctcacccctagaaaaaaatcaccaaacaagcaagctagctggtcaccagttgttaacatatacatcagcaagctccacgaaagcaagaagaagaagaaacatgacgaccactgctgcggtcgtcaagctcctgacagccgtactcctcttcttcgccgtctctcttcggggtaccaagggcgagccatgcggcacgtccaccatccacgggcaaaccgccaacccgggcgcgaacggcggccgccgggttaatcgttgttcgagggccatgtggaaaaccttgttggccattgcaaccgtaaagaaaagcccgccttgggacgggggactagctttcccaaaccaaccggcggaagggcggacctcggttccctgggtccccgcccaagtgagaaatgcgtggtggtcttaacccctgggtaaaaacaccggggggaaaacccctttcggcattggaaaggtgcggctgcccggggatcctcttccctttnctatcgcttggggtgccccccccctgttttcccgccagccgacgcccccaagacaggccttgggggaatgctcacttggaccatttgtttacttctgtatttatatctccttcaaaaaaaattcaaaaacatatatagtaatatttcgttctccgattttttataacacctacaagaagtggagggggcgtagactcgggaaaacatgttgatatttcaacctctctcgcatttaccactcattctcccctcactaccaaaacaataaaatgtcttcncccgccgtatgtctca

SEQ ID NO: 55894 - protein, 103 aa, Zea mays
  misc_feature: Ceres CLONE 1491834
MTTTAAVVKLLTAVLLFFAVSLRGTKGEPCGTSTIHGQTANPGANGGRRVNRCSRAMWKTLLAIATVKKSPPWDGGLAFPNQPAEGRTSVPWVPAQVRNAWWS

SEQ ID NO: 55895 - DNA, 713 bp, Zea mays
  misc_feature: Ceres CLONE 1491841
  misc_feature: Encodes the peptide sequence at SEQ ID NO. 55896
  misc_feature (634)..(634): n is a, c, t, g, unknown, or other
  misc_feature (713)..(713): n is a, c, t, g, unknown, or other
aagctggagctccccgcggtggcggccgctctagaactagtggatcccccgggctgcaggaattcgtctcacccctagaaaaagacgccgtcgccgctcttgttgtttccgatcccaaaccccaaacacgctccaccggcacctccgctcccacaccacaccgatggcccgcacgaagcagacggcgcgcaagtccaccggaggcaaggcgccgcggaagcagctggcgaccaaggcagcgcgcaagtcggccccggcaaccggcggcgtgaagaagccgcaccgcttccgcccgggcaccgtggcgctccgcgagatccgcaagtaccagaagagcacggagctgctcatccgcaagctccccttccagcgcctggtccgcgagatcgcgcaggacttcaagaccgacctccgcttccagtcctccgccgtcgccgcgctgcaggaggccgcggaggcctacctcgtcggcctcttcgaggacaccaacctctgcgccatccacgccaagcgcgtcaccatcatgcccaaggacattcagctcgcccgccgcatccgcggggagcgcgcttaggcgtttacggttgattgtcactactgtagatgtttaggctatgttctcgccatgtcctangtctgctttgttcttatttgttttttggtttcatcctgtgcgttgatggttgtcaaaaaaaaaaaaaaaaaaaaaaaan

SEQ ID NO: 55896 - protein, 136 aa, Zea mays; identical to SEQ ID NO: 6923
  misc_feature: Ceres CLONE 1491841
  misc_feature (58)..(132): Pfam Name: Histone Pfam Description: Core histone H2A/H2B/H3/H4

SEQ ID NO: 55897 - DNA, 726 bp, Zea mays
  misc_feature: Ceres CLONE 1491842
  misc_feature: Encodes the peptide sequence at SEQ ID NO. 55898
  misc_feature (371)..(371): n is a, c, t, g, unknown, or other
aaagctggagctccccgcggtggcggccgctctagaactagtggatcccccgggctgcaggaattcgtctcacccctagaaaaaagcagcagccagctccatccatcctctttcccctcctcgcttcgcttcctcggcggattcctcctccctcgaccgtccccgtccccgtccccttccggcgcgcaagctcgcccgagatggcaaacgcgagatcgggtgtcgctgtgaatgacgagtgcatgctcaagttcggcgagctgcagtcgaagaggctgcaccgcttcctaactttcaagatggacgacaagttcaaggagatcgttgtggaccaggtcggggatcgcgctaccagctacgaggacttcacnaacagcctccccgagaatgactgccgatacgcgatctatgatttcgactttgccactgcaaaagatgtccaaaaaaacaggaacttctttttcttagggcccccacctcccccaaggggaaaaagcaaatgctttagccagcctcaaccaaaaattaaaaagggggcccaagggcttccgggggaactggggctccctggtccaaggaaacacccccttgagaaaaaaaaggacgggccccccttggccccctcagtaaccgcccccgggggctttggcccccaccggggggtttttgcccccttataaaaggggggcgaaaaaaaaactctgaaaaattcccgggcttttttcc

SEQ ID NO: 55898 - protein, 159 aa, Zea mays
  misc_feature: Ceres CLONE 1491842
  misc_feature (12)..(123): Pfam Name: Cofilin_ADF Pfam Description: Cofilin/tropomyosin-type actin-binding protein
MANARSGVAVNDECMLKFGELQSKRLHRFLTFKMDDKFKEIVVDQVGDRATSYEDFTNSLPENDCRYAIYDFDFATAKDVQKNRNFFFLGPPPPPRGKSKCFSQPQPKIKKGAQGLPGELGLPGPRKHPLEKKKDGPPLAPSVTAPGGFGPHRGVFAPL

SEQ ID NO: 55899 - DNA, 865 bp, Zea mays
  misc_feature: Ceres CLONE 1491844
  misc_feature: Encodes the peptide sequence at SEQ ID NO. 55900
  misc_feature (7)..(7): n is a, c, t, g, unknown, or other
  misc_feature (8)..(8): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (21)..(21): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (768)..(768): n is a, c, t, g, unknown, or other
  misc_feature (809)..(809): n is a, c, t, g, unknown, or other
  misc_feature (810)..(810): n is a, c, t, g, unknown, or other
aaaaaannaaaggggnnnccncccctnnnnnnnnnnnntcttnnnnnnccaaactggagctccccgcggtggcggccgctctagactagtggatcccccgggctgcaggaattcgtctcacccctagaaaaagcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcgcctccaggagctcgcccgcttccccgtccgatgaccccaaccctaaggcccttgctcttctggggttcgagaagcctgtgaagccccacacacaagtgggttgctgggcccgacctacttatccccccttttgaagcgccccgattggcgagggcggggaggctctccccaccccacacgcccgtgtacaaccccctcccgggaaatgggacgggaggtgcctcgcactccaggccgcgcggatgacgggggcttggttagcccggggatggcctgccgtcctccaagagcgcggccgccggggtgccccccgacagccccgtgccggaagcgtccgaggggcgctcggcgcccttcccgcacagttcccccctgtttgtcccgcgtcctcgctcccggctgccgtttcatccctcgcatgattcgtcttccttgtcgtatttttttgtatctcttggtcccgccctgggcggtctnattggctgacaacgcggggccttggtccgctaccatccccnnacttacacaccctctcgcggtcccccaccaaccagtactcgcctcgctgtatccc

SEQ ID NO: 55900 - protein, 33 aa, Zea mays
  misc_feature: Ceres CLONE 1491844
MANNTGTLVGGIQDVPGSENDLRLQELARFPVR

SEQ ID NO: 55901 - DNA, 725 bp, Zea mays
  misc_feature: Ceres CLONE 1491846
  misc_feature: Encodes the peptide sequence at SEQ ID NO. 55902
aaagctggagctccccgcggtggcggccgctctagactagtggatcccccgggctgcaggaattcgtctcacccctagaaaaatccgccttcgcctccaaccgcgtgcgctccacgcctcctccaggaaagcgagagcttctgcataagaacaacaaatcaaaagcttgatcagctcggtgccaacaaaacctcaacaaccaagtttcatgtctgatctcgacgtccagcttccatctgcctttgatccgtttgctgaggcaaatgctgaggactctggtgctggtcctggaacgaaggattatgtgcatgtgcgcatccagcagcgcaacggcagaaagagtctgactacagtccagggtctgaataaggagttcacctataacaagaggcgcagggatctgaagaatgaattctgctgcaatgggtactgaaatcaagacccaaagctaggccaggtcattcacctccaaggggaaccagcccaagaatgtttctaccttcccaagttcacgctgggaattgccaaaaaaaaaaaacctcatcattcaccgggtcctaagggacctgcaaatgcgctggcccccaaatttggcgggcccccccatattcgggaacctccaaaccatcgtccggctgctacggcatcgcccttccctcatgtcgaaaacaccacccgcgttcgccgtaaaagcaatcagtaggcgtccctcgcacccccctccc

SEQ ID NO: 55902 - protein, 74 aa, Zea mays
  misc_feature: Ceres CLONE 1491846
  misc_feature (27)..(75): Pfam Name: SUI1 Pfam Description: Translation initiation factor SUI1
MSDLDVQLPSAFDPFAEANAEDSGAGPGTKDYVHVRIQQRNGRKSLTTVQGLNKEFTYNKRRRDLKNEFCCNGY

SEQ ID NO: 55903 - DNA, 762 bp, Zea mays
  misc_feature: Ceres CLONE 1491847
  misc_feature: Encodes the peptide sequence at SEQ ID NO. 55904
  misc_feature (219)..(219): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (383)..(383): n is a, c, t, g, unknown, or other
  misc_feature (410)..(410): n is a, c, t, g, unknown, or other
ctagaactagtggatcccccgggctgcaggaattcgtctcacccctagaaaacgtagccgccgccggcctccaactctaaccccgtcgcttccggctcccgcagcgtcgccgaccttcacagccggttccttcatccgccaccatggggaagacacgtggtatgggagctgggcgcaagctcaagacccaccgcaggaaccagaggtgggctgacaaancatacaagaagagccacttgggcaatgagtggaaaaaaccttttgccggatcatctcacgccaagggcatcgcttctggataatattggtattgaggcccaccagcccaattccgtttttttttccccccccccccaggggaaaagaaagggggaaannnaaanaacaattcccccccctttgggggcgantgatgggtagacctcaactcctttccacgaacaaatgatggaggtttctaacttctttaccctttggccccctaagggcccccagccctcggggaaaaacattccccgggggggtcgggggttaccacggttattctaaggcggaccccggcgcggccccgctcccctgcccgcccttccccggacgaaagaagggagcacccccctcggtcttatacatccccctctctcggtagtggaccaacagggtcaaaaaacatgccgcaccgcccccaacctccgcagacgtccctgcctcatccatctccaggtcgcctccaattcctgcacattcgccccccggttgcgcccc

SEQ ID NO: 55904 - protein, 52 aa, Zea mays
  misc_feature: Ceres CLONE 1491847
  misc_feature (26)..(26): Xaa is any aa, unknown, or other
MGKTRGMGAGRKLKTHRRNQRWADKXYKKSHLGNEWKKPFAGSSHAKGIASG

SEQ ID NO: 55905 - DNA, 793 bp, Zea mays
  misc_feature: Ceres CLONE 1491849
  misc_feature: Encodes the peptide sequence at SEQ ID NO. 55906
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (47)..(47): n is a, c, t, g, unknown, or other
  misc_feature (50)..(50): n is a, c, t, g, unknown, or other
  misc_feature (51)..(51): n is a, c, t, g, unknown, or other
  misc_feature (59)..(59): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
nnnnnnnnnnnnnnnnnnnnnnnnnnnnnnnnnnnnnntttggtggnttnnttctcttnannnnacatgctggagctccccgcggtggcggccgctctagaactagtggatcccccgggctgcaggaattcgtctcacccctagaaaaagagctggggttttagcggcgaaaagagggaaaagaaagccagcgagagagacggaaaggggaagatgagccggagcctggggatcccggtgaagttgctccatgaggcagcgggtcacgtggtgacggtggagctcaagaccggcgaagtgtaccgggggtcattggtcgagtgcgaggataactggaattgccagctcgagaacataaccttcactgccaaggatgggaaggtttcgcagctggagcacgtcttcatcagaggaagcagagtgagatttatgattatacctgatatgctcaagaacgctcccatgttcaagcgcttggaagcgaggattaggggcaaaggatcagctattggagttggtcgtggacgtgctgttgcaatgcgtgctcgggctgctgctggtcggggtggtggtcctgttggacgaggtagcgcgcctcctgtgaggaggtaaattctaaatggcgggcttttctcgcctggctggaggttgttggcctgaactcaaggacgctggcctccgtagtaaaaaactgtccctaatgtaaaaattcaaccggcttaaaaggagtaatgccaccccggtggattggaaaggaaatggaattggaccgggattttgggttaccttggcc

SEQ ID NO: 55906 - protein, 132 aa, Zea mays
  misc_feature: Ceres CLONE 1491849
  misc_feature (10)..(75): Pfam Name: LSM Pfam Description: LSM domain
MSRSLGIPVKLLHEAAGHVVTVELKTGEVYRGSLVECEDNWNCQLENITFTAKDGKVSQLEHVFIRGSRVRFMIIPDMLKNAPMFKRLEARIRGKGSAIGVGRGRAVAMRARAAAGRGGGPVGRGSAPPVRR

SEQ ID NO: 55907 - DNA, 717 bp, Zea mays
  misc_feature: Ceres CLONE 1491853
  misc_feature: Encodes the peptide sequence at SEQ ID NO. 55908
aaagctggagctccccgcggtggcggccgctctagaactagtggatcccccgggctgcaggaattcgtctcacccctagaaaaatttatcgagcctgacccttaagccttccatcggggcgctcccgcgtacggcgctagtacgcgtacctcgcttcatttcgtgtcagacggatgaaaatgctggatggaaaggcacgaattgatgacaaatatgtgaaccgggcatagtgctgagcttgcgtacctcaatggacacgatggaggtctatctctattacaagtactattgccagttctgcggcaggctcgttgtgacgaagatagacgttggaatttgcggctgcaaggactgcgtgaaggtgaacgatgtcggtggttactccatgaacactgctagtgccttcatctacttgagcacgaaccgcctcctgatggaccacattgaagcatgatatagctctttatactattgcggcttcctgtactagctcttgaagtgtatgtcgatgaggccctgatctattggacaggtggatacactgtactgactgttttgtcgacacaatgctcacttatatgtgcggtcatgcatccatgatctaatacattgggcccatgctttgcgctcggttcaccagttctgaatctgacaagcgatactctcgtccgaaccaaaattcacccaaccagggcgctcgaagtaccccattttccc

SEQ ID NO: 55908 - protein, 67 aa, Zea mays
  misc_feature: Ceres CLONE 1491853
MDTMEVYLYYKYYCQFCGRLVVTKIDVGICGCKDCVKVNDVGGYSMNTASAFIYLSTNRLLMDHIEA

SEQ ID NO: 55909 - DNA, 838 bp, Zea mays
  misc_feature: Ceres CLONE 1491858
  misc_feature: Encodes the peptide sequence at SEQ ID NO. 55910
  misc_feature (27)..(27): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
  misc_feature (51)..(51): n is a, c, t, g, unknown, or other
  misc_feature (838)..(838): n is a, c, t, g, unknown, or other
ttttttttttttttttttttttttttngtttggtatgcccgccccnncncnccaagctggagctccccgcggtggcggccgctctagactagtggatcccccgggctgcaggaattcgtctcacccctagaaaacacgaaccgcccctcagtcccttgcacgccatggccgctgcctcagcttcgcttctccacctcgcgaccccgaccctgactcgctccactcgcctcgccgtccgcctccccagcgcccagctgtcgcgctggccatcgggggcacgcatcgccgccgcgcagccgccgcgggcgtacaaggtgacgatcgagcacggcggccaagccccggtggtggaggtggaggaggaccaaactatcctgtcccgcgcccatgacgagggcctggatcttgccgacgactgcaagctcggcgagtgcatgacgggccccatccccgcctggttccctgcaccgtgcaccccacctacccgcatgctttcttggcctaacctctctctcacggtggcacacctatgctcgtggggcacggtattcttgtgtcaggatggaggctctccgaactcgtcccccgggggaaagagctgggttaaagggccggtcgttaccacaccccaccaaaaatgaattaaacacataccttctatagagactcgggggaacggagcccggcctatgcctcatctccaacaccgcactccttaataagtactagtgcccgtgaaggttatggatcgaggagagtgtggcccgacccacttgaccccaaacaagcaaaaaagccacctttctcttaagaccaagagcaagtttacctccgccan

SEQ ID NO: 55910 - protein, 158 aa, Zea mays
  misc_feature: Ceres CLONE 1491858
MAAASASLLHLATPTLTRSTRLAVRLPSAQLSRWPSGARIAAAQPPRAYKVTIEHGGQAPVVEVEEDQTILSRAHDEGLDLADDCKLGECMTGPIPAWFPAPCTPPTRMLSWPNLSLTVAHLCSWGTVFLCQDGGSPNSSPGGKSWVKGPVVTTPHQK

SEQ ID NO: 55911 - DNA, 716 bp, Zea mays
  misc_feature: Ceres CLONE 1491859
  misc_feature: Encodes the peptide sequence at SEQ ID NO. 55912
aaagctggagctccccgcggtggcggccgctctagaactagtggatcccccgggctgcaggaattcgtctcacccctagaaaaaagcaacccccaacagcgccactgtccagtgcgcgcgtcaagcttgcttagctagccgccatggcctccctcgccgccgtctccgtgaagcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacgggctctgacgcgctcttcccccccccacccgcgagagaggggagggcttccagaactttcggggcctccgttcacccaagaaaagggcttgcggcctcaacttccctggctgcctgggcgggcggctcactttctgcccctacgtacagcgccgtcggccttctccgggacctcccggccgaatcagaaagggaaccccctggaacccgccggggacccgaccccccgcgggaaaacaccccacgcccagggtttctccagtggcgaaggcccctaaccccctttgtttttgtgccttctaccctcccgtctcctcccgcgggcccgcggtggggggagataagtgtcccaaaatgggg

SEQ ID NO: 55912 - protein, 73 aa, Zea mays
  misc_feature: Ceres CLONE 1491859
  misc_feature (5)..(73): Pfam Name: PSI_PsaH Pfam Description: Photosystem I reaction centre subunit VI
MASLAAVSVKPVAIKGLAGSSISGRKLAVARPSARSIRRPRAAAVVAKYGDKSVYFDLDDIGNTTGQWDLYGL

SEQ ID NO: 55913 - DNA, 854 bp, Zea mays
  misc_feature: Ceres CLONE 1491860
  misc_feature (414)..(414): n is a, c, t, g, unknown, or other
  misc_feature (852)..(852): n is a, c, t, g, unknown, or other
aaagctggagctccccgcggtggcggccgctctagaactagtggatcccccgggctgcaggaattcgtctcacccctagaaaaaacccaactccgtgccctctctcccagcccagatagatctttcccccgtcctccctcgccttcgcctcgccggcaggagatttccactaccaccgccggaccaccccgaccctccttccctctcgcgctatggcccacactgttgtgctcaaaggtgggatgtcctgtgagggctgtgttggaactgaacagcgtgtcctgggcaaaatgttaggcccccagcccatagaaattcactttttggcactttttgcccccgtgaaaaggcaaattagacatctggacgtttttttttcccccccccccccggggggggggggggagatttcanccttcgaaacttaatccctttttattagtgaaaactaccaaccaataacccgctccgcccccacggggagcgttccacctggtgttaccagttccccccccacaatacagtcgaaaggctcgcaacctcgggggccgcgccgcgccgccccgtcccgcgcccctgctgcgcggatgcgcccacctacctaccccccaccctctgcctacgctcgccacactctcctcgctcatttaactaggatgcgtagaagccgcatcctccacatcgtccaaggagcgtaccgccgggggcctccaacactccagcccggatgccctatatgggcgcaatattaatccttttccacaagagcagagccgggtgtgccccgggaatgactctctaccttcttgtctttctctaaacaacgtcctccttatcacgttcaatgagctnac

SEQ ID NO: 55914 - DNA, 710 bp, Zea mays
  misc_feature: Ceres CLONE 1491861
  misc_feature: Encodes the peptide sequence at SEQ ID NO. 55915
aagctggagctccccgcggtggcggccgctctagaactagtggatcccccgggctgcaggaattcgtctcacccctagaaaaaaaagaatcttcttctccatccctataccgtatctaccgccgccctctatccctaattttctccagccgccgcgctcctgatccttatctctgcgcgcgctgcatcggcgcccgccgggaggcggatcccgcccgcctcgtccatgccgtgggtccgcaatctccgccgcttcgtcgacacgggcgccggcctcggatccgaggccctcatggaactggagactaaaaggatattgcttgagattttcaaggagcggtagcggaagagtgccgaggctggttccatcccaagtttttacaagaagaaacctgaagaaggatccattagctctagagttcaaaggttggccaagtacaggtttctaaagaaacaatcagagcttctgctgaatgctgatgatcttgatgccatgtgggtttgtctaagagaaaattgtgttattgatgatgctactggtgctgaaaagatgaattatgaagatttctgccatatcgccacagtctgcacggagcagattggtcagaaatgcaaacgatttttcagcccttcaaacttcatgaagtctgcacggagcacttgcacagattgtttggctaattacaagattatctcaagtgtttggtttgg

SEQ ID NO: 55915 - protein, 72 aa, Zea mays
  misc_feature: Ceres CLONE 1491861
MWVCLRENCVIDDATGAEKMNYEDFCHIATVCTEQIGQKCKRFFSPSNFMKSARSTCTDCLANYKIISSVWF

SEQ ID NO: 55916 - DNA, 713 bp, Zea mays
  misc_feature: Ceres CLONE 1491862
  misc_feature: Encodes the peptide sequence at SEQ ID NO. 55917
  misc_feature (534)..(534): n is a, c, t, g, unknown, or other
  misc_feature (535)..(535): n is a, c, t, g, unknown, or other
  misc_feature (713)..(713): n is a, c, t, g, unknown, or other
aaagctggagctccccgcggtggcggccgctctagaactagtggatcccccgggctgcaggaattcgtctcacccctagaaaaagtgctttctcagaggtgggttggcttctcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggatacggtggcgggcgccgtgatggaggcggctacggcggtggcggtggaagctacggcggtggtcgtggaggctacggcggcnngtgggggatacgggggtgcaaaccgcgggcggcggctacggcaaccacgacggggaactggaggacctgagccggtggggtcggctgaggcctagttatcttggtcgcttctgctaccgtgttcaccctagtctagagggggttattcttcgtctgggggcgtctcctggccctatgn

SEQ ID NO: 55917 - protein, 146 aa, Zea mays
  misc_feature: Ceres CLONE 1491862
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (124)..(124): Xaa is any aa, unknown, or other
MAASDVEYRCFVGGLAWATDDHSLNNAFSTYGEVLESKIILDRETQRSRGFGFVTFSTEDAMRSAIEGMNGKELDGRNITVNEAQSRGGRGGGGGGYGGGRRDGGGYGGGGGSYGGGRGGYGGXWGIRGCKPRAAATATTTGNWRT

SEQ ID NO: 55918 - DNA, 709 bp, Zea mays
  misc_feature: Ceres CLONE 1491864
  misc_feature: Encodes the peptide sequence at SEQ ID NO. 55919
aaagctggagctccccgcggtggcggccgctctagaactagtggatcccccgggctgcaggaattcgtctcacccctagaaaaaataccgaccttccttgcattttctcaataccttgaacaactaagcaagtccaatgtctcatgcccagccccttcgtttacaggcccagtggaaacacgtcgatattcaggataaccaagccaatgctatgaaggaaccaggaaccagtggtgggtatggctccccaatgaaagatgacaagaacaaggatgtggatacaatagcttcgaacttcatcaagcttaagcacagggcttgggcactccagaagagcacaaccatgtaccaaccttccacttaaaggtgttgctagttcaataagtcaatactatatatacttatgcttgtctctatatagactataggtgcctagttcaaacagatgctgcttgccggcttggaaatttggggaacgaaccccttttgatagcatatggtaagaaagaatggaatccctggaaagggcgcattatgtgcaaattttttttccaacaaggaagccgggggccttttccggaaaaaaaaaaaaaaaacgaaaccctttggggccccatttcccccttttggggggcatttaacccccccactggggccttcttttcaacaccgggggggtgaaaacacctgggtttccccccttttcccg

SEQ ID NO: 55919 - protein, 75 aa, Zea mays
  misc_feature: Ceres CLONE 1491864
MSHAQPLRLQAQWKHVDIQDNQANAMKEPGTSGGYGSPMKDDKNKDVDTIASNFIKLKHRAWALQKSTTMYQPST

SEQ ID NO: 55920 - DNA, 740 bp, Zea mays
  misc_feature: Ceres CLONE 1492003
  misc_feature: Encodes the peptide sequence at SEQ ID NO. 55921
aaagctggagctccccgcggtggcggccgctctagaactagtggatcccccgggctgcaggaattcgtctcacccctagaaaaagacaagcaagaacagctgtcgatccaattgtcacttgctctccctccaacaagctaattaaggccggtcatccctcttctagctcgtttcattatccatggcggaggagaagcaccaccaccaccacctgttccaccacaagaaggacgaggagcaggaggagcagctcgccggcggcgggtacggcgagtccgccgagtacacggaggccacggtgacggaggtcgtgtccaccggcgagaacgagtacgacgagtacaagagggaggagaaacatcacaagccccaccccccacctggggggagggcggcgcccttcaccccccgagcccttttttattcttacgacaagcaacgaggctacaggaagggaccccggaagagagtcgcacccggtcccaaagaacccagggataaagggtcccggcgcggtgggccggcacgtcgggtttcacgggcgggtttcccgtttctccacggagtgcccgaggagccagaaaaaaaggggactcccaagggtcccccccaaccacaaatcccctccccgcaacaaaaaaccaaaacccctctcctcgcgacaccatatgactccccccccggcgaatggaccaagattcctccccgcgcacgccgagtcgtttcgaataatacacccg

SEQ ID NO: 55921 - protein, 186 aa, Zea mays
  misc_feature: Ceres CLONE 1492003
MAEEKHHHHHLFHHKKDEEQEEQLAGGGYGESAEYTEATVTEVVSTGENEYDEYKREEKHHKPHPPPGGRAAPFTPRALFYSYDKQRGYRKGPRKRVAPGPKEPRDKGSRRGGPARRVSRAGFPFLHGVPEEPEKKGTPKGPPQPQIPSPQQKTKTPLLATPYDSPPGEWTKIPPRARRVVSNNTP

SEQ ID NO: 55922 - DNA, 668 bp, Zea mays
  misc_feature: Ceres CLONE 1492005
  misc_feature: Encodes the peptide sequence at SEQ ID NO. 55923
  misc_feature (185)..(185): n is a, c, t, g, unknown, or other
caaagctggagctccccgcggtggcggccgctctagaactagtggatcccccgggctgcaggaattcgtctcacccctagaaaaaagcgagcgagagagacgcacatctatctgtcaagcgacgccgcggcctcgatcagagtcggaggcgaacacccccatggcggcggctggcggcggcgcangagggaaggtatccttcaagatcatcctcacctccgaccccaagctccctttcaaagtgttcagcgtgcccgaggcggcgccctttaccgcggtgctcaagtacgccgcggaggagttcaaggtcccgccccagaccagcgccatcatcaccaacgatggaattggcatcaacccccagccacaccgcacgcaacgggtgggctgaaacatggttcggaactgcctctcatccctcgcgatagggttggagctgtagtcctgtcttccggttagaggatatatacagtcccaatgcataatgagccaaacttgagagaaaataagcttttaatgttgggccttgcctgggctgtgaggatggtttttccaagggataataagccgcaccttaccggacaatgtcccaaggtggaatgcccctccggttggtttgggggaagatttcctattgcactaacaactgacacgcacgctgccccccg

SEQ ID NO: 55923 - protein, 76 aa, Zea mays
  misc_feature: Ceres CLONE 1492005
  misc_feature (10)..(76): Pfam Name: UPF0185 Pfam Description: Uncharacterised protein family (UPF0185)
  misc_feature (9)..(9): Xaa is any aa, unknown, or other
MAAAGGGAXGKVSFKIILTSDPKLPFKVFSVPEAAPFTAVLKYAAEEFKVPPQTSAIITNDGIGINPQPHRTQRVG

SEQ ID NO: 55924 - DNA, 646 bp, Zea mays
  misc_feature: Ceres CLONE 1492006
  misc_feature: Encodes the peptide sequence at SEQ ID NO. 55925
aaagctggagctccccgcggtggcggccgctctagaactagtggatcccccgggctgcaggaattcgtctcacccctagaaaaaacttccactcccacccacccacacgcacggccgcaggcagcagaaccatgtggtcggcagcaacagcggcggtggcgcgcgcagtgtccatatccccagtcccggcgccttcgctcctcagcggccggctgcgtggggtcgcgggtccgccggggatcagtgtcggtgcgcagcagtctgtgctacttcctgggctgccacctgctacggccagacctgggcaactggctggaccacgttgagaagcacaaggcactggccatctacccgccgcaagaaggcggctacgagggccgctacctgaaccgcctccgataccagggctactacttcctcgacctctccgcgcgggggctcggcgactcggagaccacgctcaccaatgtccaccacgtctgcccgcctagcctcggcaggcaaccggaggagctgtggtacttcacgacggaggtggactacatgctcaacctgctgcacccggacgccaaatgcctcatcgtctagatcatcgaagccaaggttctgatctaggttgatctgcagtatctggacatgctcccga

SEQ ID NO: 55925 - protein, 195 aa, Zea mays
  misc_feature: Ceres CLONE 1492006
KAGAPRGGGRSRTSGSPGLQEFVSPLEKTSTPTHPHARPQAAEPCGRQQQRRWRAQCPYPQSRRLRSSAAGCVGSRVRRGSVSVRSSLCYFLGCHLLRPDLGNWLDHVEKHKALAIYPPQEGGYEGRYLNRLRYQGYYFLDLSARGLGDSETTLTNVHHVCPPSLGRQPEELWYFTTEVDYMLNLLHPDAKCLIV

SEQ ID NO: 55926 - DNA, 770 bp, Zea mays
  misc_feature: Ceres CLONE 1492007
  misc_feature: Encodes the peptide sequence at SEQ ID NO. 55927
aaagctggagctccccgcggtggcggccgctctagaactagtggatcccccgggctgcaggaattcgtctcacccctagaaaaaaccgcagcagcgcgggagcaggcccggcaggcatgggcgtgcttcggagcacgcagagccttgaggcggaggtggacgagctgcgcgccgcgctcctggcgggcgggtggcgccgctcggcgggccacgcggacgctaagcgcgctccccggggcgacgccggagggggcgcggcgcgcgccgtgtgcgtaactggcggcatctcccttcgcgggttcgccgtcgtccaccgcctcctccggcacggggcccccggtcccgcctcgcgctgggagacccaagaagacctggaccaagcttgcgggagatggaagatgttcccgcaaatgaatagccccccccatgggggggggtgtccccccgggttaaccggcaaaaccgttgagtgggaccccctgaacgcggccctggcggcccccgccccttttccaaccggggtgggccccccccgactatttgtttcccaccacccttcccccgccttttccccccccaaaccccggcggggggtattgtttctgggcgctccccccgggcccggttgcgcccgcccctaaaaacctcccccctttcccccgagggacgccgtttctcccttctttctgtcgtgggcgggaaaattgcagggcgggttctaaaccactccgccccgggtgtgaagccgacccggggggctttccctctcg

SEQ ID NO: 55927 - protein, 174 aa, Zea mays
  misc_feature: Ceres CLONE 1492007
MGVLRSTQSLEAEVDELRAALLAGGWRRSAGHADAKRAPRGDAGGGAARAVCVTGGISLRGFAVVHRLLRHGAPGPASRWETQEDLDQACGRWKMFPQMNSPPHGGGCPPGLTGKTVEWDPLNAALAAPAPFPTGVGPPRLFVSHHPSPAFSPPKPRRGVLFLGAPPGPGCARP

SEQ ID NO: 55928 - DNA, 656 bp, Zea mays
  misc_feature: Ceres CLONE 1492010
  misc_feature: Encodes the peptide sequence at SEQ ID NO. 55929
caaagctggagctccccgcggtggcggccgctctagaactagtggatcccccgggctgcaggaattcgtctcacccctagaaaaaaccaccagtaccacaccactccgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtcggcgaaccgcaaggcgacggcggggctgaagctggaggcgcgcgactccggcctgcagacgggtgaccccgccgggttcaccctcgccgacacgctggcctgcggcgccgtcggccacatcctcggcgtcggcatcgtgctcgggctcaagaacacgggcgccctccaccagatcatcggctagatccctacgtcgtcgttggttaaaatcaaacttcaacagcctccattcgccccccccgggccggcaggccgcctgg

SEQ ID NO: 55929 - protein, 134 aa, Zea mays
  misc_feature: Ceres CLONE 1492010
  misc_feature (49)..(129): Pfam Name: PSI_PSAK Pfam Description: Photosystem I psaG / psaK
MASQLSAAVPRFHGLRGYAAPRSAVAALPSVRVGRKRSSSQGIRCDYIGSATNLIMVTTTTLMLFAGRFGLAPSANRKATAGLKLEARDSGLQTGDPAGFTLADTLACGAVGHILGVGIVLGLKNTGALHQIIG

SEQ ID NO: 55930 - DNA, 681 bp, Zea mays
  misc_feature: Ceres CLONE 1492012
  misc_feature: Encodes the peptide sequence at SEQ ID NO. 55931
cctaagctggagctcaccgcggtggcggccgctctagaactagtggatcccccgggctgcaggaattcgtctcacccctagaaaaaactacaaccagcggtagtggccggcatcatccgtctcgtctcgtctcgtctcgcctctcctctccttttcccccctccctgcacagcgccgctcaccgtcaccgtaccacagcagcgatcgatggctgaggtacacaacgagcggcccgtgatggtgggcgacgtccgggacgcgccggtgggccgcgagaacgacctcgaggccatcgagctcgcgcgcttcgcggtcgccgagcacaacagcaagaccaacgcgatgctggaattcgagaggctggtgaaggtgaggcaccaggtcgtggccgggaccctgcaccacttcaccgcccaggcgaaggaggccggcggcggcgaaaagaagctgtacgaggcccaagtgtgggaagaaggcgtgggagaacttcaagcacctgcagagctttgagctcgtccggaaactccccggtcgccctgaagcgcacaggctttttcgctggaagcctggaccacaaccatggacagaatttaacctgtcctccccccgggaaaaagtatgatataaatggataaacccagccgtccttaccccacatgttatttgaaaccccaaaaggaa

SEQ ID NO: 55931 - protein, 100 aa, Zea mays
  misc_feature: Ceres CLONE 1492012
  misc_feature (13)..(101): Pfam Name: Cystatin Pfam Description: Cystatin domain
MAEVHNERPVMVGDVRDAPVGRENDLEAIELARFAVAEHNSKTNAMLEFERLVKVRHQVVAGTLHHFTAQAKEAGGGEKKLYEAQVWEEGVGELQAPAEL

SEQ ID NO: 55932 - DNA, 705 bp, Zea mays
  misc_feature: Ceres CLONE 1492013
  misc_feature: Translation starting site: 154
ccaagctggagctcaccgcggtggcggccgctctagaactagtggatcccccgggctgcaggaattcgtctcacccctagaaaaaaaccccaccgcagcacagcgccggcaaccgccgccatcgatcgatcgcccggaaactgacctctaccgatgtctggagccggcgaggaggataagaagcccgcggagggcggcgcccacatcaaccttaaggtcaagggacaggatggcaatgaggtgttctttcgcataaagaggtccacccagctgaagaagctgatgaacgcctattgcgaccgccagtctgtggacatgaatgccattgcattcctgtttgatggccgcaggcttcgcggcgagcagacccctgatgagctgggagaggaggacggcgacaagatcgacgcctgcccccccccacccgaggcagcgttcctagccccccctaaaaccaccagctgcggaccctcgttttgcctctccgccctgcgtagccctaaacaaacgggaaaaacccttcttttaaggaacccgcgccggcccgggcccccttgtgccccttgcccgaggggaaatcccccaaccccttacctccccggcggaaggggttgccggaccctggctaccgccaacaccccccgctagatgccactcccccaaacctcgcgccgccacctacccttcccccccccacaaccaccc

SEQ ID NO: 55933 - DNA, 639 bp, Zea mays
  misc_feature: Ceres CLONE 1492016
  misc_feature: Encodes the peptide sequence at SEQ ID NO. 55934
aaagctggagctccccgcggtggcggccgctctagaactagtggatcccccgggctgcaggaattcgtctcacccctagaaaacatcgtttcgcgtccgcctcagcccgccgcaaggggaggtaagttcatgagacaccttcgagaagctgaaatggctcctaaagctgctcctgccaagaagggtgatgccaagacccaggccttgaaggttgccaaggctgtgaagtctggggcagccaagaagaccaagaagatccgcacatctgtgacatttcaccgcccccacgactcctgaagaaggctaggggaccccaagtacccaccgaatcagcacctacccggaaggaacaagctttgatcaggtaccaaatttctcaggtacccccccttacccacagaaatcagcggatgaagaaagaatggaagaataaacaacactcctggtctttcatttgttgaccccccagggcagacaagaaagaaaaacccagggctgcccgtccaagaaaaatgttatgaaaattccagggcaaaaaaaaaagccaaacaccctttgaattccaggccctgaattggggaaaaaaagaaagggctttacccggtggaaagctttaaaactccccccaaacttatttaa

SEQ ID NO: 55934 - protein, 47 aa, Zea mays
  misc_feature: Ceres CLONE 1492016
MAPKAAPAKKGDAKTQALKVAKAVKSGAAKKTKKIRTSVTFHRPHDS

SEQ ID NO: 55935 - DNA, 680 bp, Zea mays
  misc_feature: Ceres CLONE 1492017
  misc_feature: Encodes the peptide sequence at SEQ ID NO. 55936
agagctggagctccccgcggtggcggccgctctagaactagtggatcccccgggctgcaggaattcgtctcacccctagaaaaaaagcgcagagcagccaagcgccacacacacgccgacgcgaaccaaccaaccagctggtagtaggttcgccgcggcgccgcgctgacgatgatgcctcgccgcgcccttctcttcgccgcggtgctcctcgcggcctccgccgccgcggtctccgggtttcacctcggcggggacgagagcggtctcgtgaggggtgtgctcgccgcgctccgcgagcgggccgaggccgtggacgccgctcgcttcgccgtcgcccactacaacaagaaccagggcgccgctttggagtttactagggtgctcaaatcccagcggcaggtggtgaccgggaccctgcatgacctgatactggaggcagctgatgctggaaaaaagagtgtgtacagagcaaaggtttggggtgaaaccgttgggaatattccaggtctgccgtcaagttttccccttgttggaaaactctaaatctgaaacccgagccttctggtgctttctgaatgtagccttctgggcaagccaattgccaaacttctttcttgaagcaaaattttgtacaaaaagaaggctccccccggccccccatttggagaatgaatggg

SEQ ID NO: 55936 - protein, 124 aa, Zea mays
  misc_feature: Ceres CLONE 1492017
  misc_feature (36)..(113): Pfam Name: Cystatin Pfam Description: Cystatin domain
MMPRRALLFAAVLLAASAAAVSGFHLGGDESGLVRGVLAALRERAEAVDAARFAVAHYNKNQGAALEFTRVLKSQRQVVTGTLHDLILEAADAGKKSVYRAKVWGETVGNIPGLPSSFPLVGKL

SEQ ID NO: 55937 - DNA, 688 bp, Zea mays
  misc_feature: Ceres CLONE 1492018
  misc_feature: Encodes the peptide sequence at SEQ ID NO. 55938
ccccgcggtggcggccgctctttaactagtggatcccccgggctgcaggaattcgtctcacccctagaaaaaaccacctgcagaggacccgcgctcgccgctatcattcgtttctggagacccttctagccccgccgccaccacaccaccaccaccaatggcaggactcggatcaaaggccctcgccgtggtcgccgtcctggcggccgtcgtcctctcagtggcctccgcggccgaggcgcccgcgcccagccccgtctccgccgccgccggcgcgtcggcgccgttcgccgcggccctcgtcgcctcctccgccgccttcctcttcgccgccgtccgccactgagccgatggggcccttccaccgccgccgccgccgcctagatctatttattggagtggtattcagtagtactggtactagggagattttcttcgttggtgtcgtgtcgtcgtcgcattttggtcggatctggtgtccttggtgggtgaagggtttgtaccccgccgagggtgtcggtttgtggtgatcctgattcttaatcccccttgggaaaataaccctgcctaatctcccccgatgattcgctgcaattgaatgaattccccgttcttgggttcgcctaacccgaaaaaaaataaaaaaaaaaaaaacgcgcaggaccccgctcccgaagtgtcacccccg

SEQ ID NO: 55938 - protein, 62 aa, Zea mays
  misc_feature: Ceres CLONE 1492018
MAGLGSKALAVVAVLAAVVLSVASAAEAPAPSPVSAAAGASAPFAAALVASSAAFLFAAVRH

SEQ ID NO: 55939 - DNA, 668 bp, Zea mays
  misc_feature: Ceres CLONE 1492020
  misc_feature: Encodes the peptide sequence at SEQ ID NO. 55940
  misc_feature (647)..(647): n is a, c, t, g, unknown, or other
aaagctggagctccccgcggtggcggccgctctagaactagtggatcccccgggctgcaggaattcgtctcacccctagaaaaatgcattgcatgtcctgctggtgaggatatcgtcccactggcaggcaaccatccatgggtcctcctgatagtccatatgctggaggtgttttcttagtgaacattcatttccccccagactaccctttcaagcctccaaaggtatcttttaagacgaaggtcttccatccaaacatcaatagtaatggaagcatatgtctcgacattcttaacgagcactgcagccctgcttagacaatcactaacgttttgctttctatctgctcgctgcttactgatcccaaccaagacgatcctcttgaccctgagattgctcacgtgtacaagacggatcggcctacgtacgaggcaacagcccgcagctggacccataaatatgccatgggatgaaaatgaaatgaactcgaaactccatattcagcattactgcttaaatgcagacgattgtggtgttgccccatgaaactgtctgtagggacgtatgttcttcccatgcgttggcgcccgtgtgcattctgattcatctaaggatcgaatgctaatccaacatccacctaccattgncgaaccataatgagatgactt

SEQ ID NO: 55940 - protein, 59 aa, Zea mays
  misc_feature: Ceres CLONE 1492020
  misc_feature (1)..(60): Pfam Name: UQ_con Pfam Description: Ubiquitin-conjugating enzyme
  misc_feature: SWISSPROT Homolog: EC 6.3.2.19 Ubiquitin--protein ligase
MGPPDSPYAGGVFLVNIHFPPDYPFKPPKVSFKTKVFHPNINSNGSICLDILNEHCSPA

SEQ ID NO: 55941 - DNA, 619 bp, Zea mays
  misc_feature: Ceres CLONE 1492021
  misc_feature: Encodes the peptide sequence at SEQ ID NO. 55942
tctgtcctcgtggatcccccgggctgcaggaattcttctcacccctagaaaaaaccatcacacagcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgagttccacgagcgcagggagagcttcctcgccagggctaactgagccgcccggcggccggcatccacgcccgttcgtgcttgcctgcgtgccttatgtatgtctgtggttgactggttgtgcaggggcatcgtacttggctatcgtacgtgcacgcactcagcttcctgtaccaattacgaccataagctcgtgaccggaataaaacttctttcgtatttcctttaaagccccccccctaccaacacacag

SEQ ID NO: 55942 - protein, 93 aa, Zea mays; identical to SEQ ID NO: 55378
  misc_feature: Ceres CLONE 1492021

SEQ ID NO: 55943 - DNA, 666 bp, Zea mays
  misc_feature: Ceres CLONE 1492023
  misc_feature: Encodes the peptide sequence at SEQ ID NO. 55944
aaagctggagctccccgcggtggcggccgctctagaactagtggatcccccgggctgcaggaattcgtctcacccctagaaaaactctcgtggccttgtttcctggcggcgacggctggtcgagcggcgccgcccttggctaggtcttcgctgggttcttcgccggcgacgaacgtccatctggggtcgactgaactgagcaggcagtaggaagagacactatgttgttcttctcctacttcaaggagctggtggggaaggaggtgacagtggagctcaagaatgacttggcgatccgcgggacgctccactcggttgaccagtacctcaacatcaagctcgagaacacccgcgtagtcgaccaggacaagtatccccacatgctttcagtgcggaattgcttcatcagaggctcggtggtgcggtacgtgctgctcccgcaggacggcgtggacatcgacatcctccacgacgccacccagagggaggcgcgcggaagctgatccctgatgcgcacccgctccctcacctgctggctgctgcttcatccccgattgtacgaagcatgcatgtacgggtgtgtggtagacagatgcccccagttagttcctttggggcttgcctggacataaatttcccagggttggatgaagacctgaatccccg

SEQ ID NO: 55944 - protein, 93 aa, Zea mays
  misc_feature: Ceres CLONE 1492023
  misc_feature (5)..(72): Pfam Name: LSM Pfam Description: LSM domain
MLFFSYFKELVGKEVTVELKNDLAIRGTLHSVDQYLNIKLENTRVVDQDKYPHMLSVRNCFIRGSVVRYVLLPQDGVDIDILHDATQREARGS

SEQ ID NO: 55945 - DNA, 637 bp, Zea mays
  misc_feature: Ceres CLONE 1492024
  misc_feature: Encodes the peptide sequence at SEQ ID NO. 55946
aaagctggagctcaccgcggtggcggccgctctagaactagtggatcccccgggctgcaggaattcgtctcacccctagaaaaaacgggcgtagagagagagagagagagagagagagcgcgaagagggcgtgagagaggagggaggccaagccgtacgcgtcatctcctgctgtttcttcggttcttcccatccctttcctgcctcggcttgcaccttcaaccttgcttaaagctctgacctcaaactgaaaggggcgtgcgaagagttttcttgcggcagtgcaatggaggtgaacatctctgattccattttcatctgttgggtggcaagaaactaatcaaggagtctctctcttctcattctctgcgtggaggactgtttagctgtagctgagcggcatgctttccagaacataaattggtggaagagaagtttgatgctaccactttgcgagaaggaccgaaccagacacaataacatcaaactgagacactgcagtttaccaactttttcaatatggcagattgaagagcagcaagatcagcctcttccatatgcagtttgaagaaatccttttttaaaggtctattaaactagaatctttccggcaatcttgccttcccccaagcatgct

SEQ ID NO: 55946 - protein, 42 aa, Zea mays
  misc_feature: Ceres CLONE 1492024
MLPLCEKDRTRHNNIKLRHCSLPTFSIWQIEEQQDQPLPYAV

SEQ ID NO: 55947 - DNA, 685 bp, Zea mays
  misc_feature: Ceres CLONE 1492029
  misc_feature: Encodes the peptide sequence at SEQ ID NO. 55948
aagctggagctccccgcggtggcggccgctctagaactagtggatcccccgggctgcaggaattcgtctcacccctagaaaaaactcagcgagaagaaagagaccgagatctcgccgatagctagcatcatggcgtccaaggtgcttctcgtggtagcgctcctgctggccgccaccttcctcgccgcctccgctaacgagcaagcccaggcggctaaagaggagaagaaggcggaggtccaagactggcacggcggcggcggctacccgggtcacggcggcggcggcggcggctacccggggcacggcggcggcggcggcggcggctacccgcactgccggtggggctgctgcaaccgcgggtaccatggcggctgccggtgctgctcgcaccctgatcagatcccagagcccatgtaccgtcctgagctcctcgaggtcacaacaaaatagtataccggtacctatccccgatgggaaacaagaacacacgcgtagtaccctcgtcctagtagccaaaaaaaaagttggttcccatcccccgccatgaaaaaaaaaagtaaggagggttgttccccccccttttgtcttgcgtgccttgaaaaaaaaaaaaaaaaaaaaccaagaacccttccaagggaaccccaaattcccccccataagagggaggccccaaatttcaccc

SEQ ID NO: 55948 - protein, 107 aa, Zea mays
  misc_feature: Ceres CLONE 1492029
  misc_feature (1)..(83): Pfam Name: GRP Pfam Description: Glycine rich protein family
MASKVLLVVALLLAATFLAASANEQAQAAKEEKKAEVQDWHGGGGYPGHGGGGGGYPGHGGGGGGGYPHCRWGCCNRGYHGGCRCCSHPDQIPEPMYRPELLEVTTK

SEQ ID NO: 55949 - DNA, 706 bp, Zea mays
  misc_feature: Ceres CLONE 1492031
  misc_feature: Pfam Name: Ribosomal_L39 Pfam Description: Ribosomal L39 protein
  misc_feature (387)..(387): n is a, c, t, g, unknown, or other
  misc_feature (400)..(400): n is a, c, t, g, unknown, or other
tccccgcggtggcggccgctctagaactagtggatctcttgggctgcaggaattcgtctcacccctagaaaaacgcacctagggttttcgcgccgccgccgcagccgcaacaatgccgtcgcacaagaccttccggatcaagaagaagctggcgaagaagatgcgccagaaccgccccatcccctactggatccgcatgcgcactgacaataccatcaggtacaacgccaagcgcaggcactggcgccgcaccaagctcggcttccgagcgtcttgtttggccgggtggtggggccgaaggctagggcctaatagtttcctcctgtctccccatcgcccccgccttttttttttccccccccccccggggaaaagcaaagggggtanacatctttctcanttttaaccccccccccccacacccccccccacttggcccgcgcccccccggcgggcggggggacccctccctctcccccgcttccctctccctccttccccccacttccaataactaggcggcccccctcgatggcccccctctctgtcccctatctccgctacccgggcgatgtcggcccgcttccccccccccccgccccggaggctcactcgccgccccccccattttcatattccttcgcgcccacccttcggttgacccccccccgggctcgctatgtccctcgcctacttttccccctgc

SEQ ID NO: 55950 - DNA, 641 bp, Zea mays
  misc_feature: Ceres CLONE 1492033
  misc_feature: Encodes the peptide sequence at SEQ ID NO. 55951
  misc_feature (342)..(342): n is a, c, t, g, unknown, or other
  misc_feature (360)..(360): n is a, c, t, g, unknown, or other
aaagctggagctccccgcggtggcggccgctctagaactagtggatcccccgggctgcaggaattcgtctcacccctagaaaaaccaatatccctccattctcctaccaaaaatcgcagcgccgcccgcaccaatctcgaagtgttcgaaagtttccagacccccaaaaggcgaagcggcgatgagttccaccggaggcggcggccgcgggaaggcgaagcctgcgaccaagtcggtgtcgcggtcctccaaggctgggcttcagttccccgtcggtcgcatcgcgcggtacctcaagggccggagaagtatgcgggagcgcgtcggcgcccggggcctccntgtaccctcctccgccgntctcaaagtatctcaccccccgaagtgcttggaacccggccggggaaacgcttcctccgggacaaccaagaaagaaaccggtttccggggcccgggccaccatccaagtggggggggggccggaaaacacaccaggtacctcttacccaaaccttgtcgggggcacccgggtgccacaaatttccccgccccgggggggggcgtttatttttcccccaaaacactcttcccctttagaaaaacccccgggggggggcccccaaaaaaaaaatcctggggaa

SEQ ID NO: 55951 - protein, 153 aa, Zea mays
  misc_feature: Ceres CLONE 1492033
  misc_feature (54)..(54): Xaa is any aa, unknown, or other
  misc_feature (60)..(60): Xaa is any aa, unknown, or other
MSSTGGGGRGKAKPATKSVSRSSKAGLQFPVGRIARYLKGRRSMRERVGARGLXVPSSAXLKVSHPPKCLEPGRGNASSGTTKKETGFRGPGHHPSGGGAGKHTRYLLPKPCRGHPGATNFPAPGGGVYFSPKTLFPFRKTPGGGPPKKKSWG

SEQ ID NO: 55952 - DNA, 565 bp, Zea mays
  misc_feature: Ceres CLONE 1492034
  misc_feature: Encodes the peptide sequence at SEQ ID NO. 55953
  misc_feature (10)..(10): n is a, c, t, g, unknown, or other
  misc_feature (11)..(11): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (22)..(22): n is a, c, t, g, unknown, or other
  misc_feature (23)..(23): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (84)..(84): n is a, c, t, g, unknown, or other
  misc_feature (236)..(236): n is a, c, t, g, unknown, or other
caaaggccgnnggnnnnngggnncagccggctnnnnnntggggtttttgggggcnnncaaggggtgctcacttggaaacaatcnctctttccagtggacccccgggttgcaggggttcctctccccctagaaaaaacggagaaaaagaaagaggagctcggacaaggcagttccatcgttcggtttccttgctgaattcccgatcgctcgcccgctcgaaaagaaagaagctagcnttttagcatggcgtctctggcgttcggcagcaccgtagcggcggccgtggcggcgacctcggggaggacgcggccggcgcgccggtccgtgctggtcgtgccgcccgctgccagcaggggcggccccggcgcccggccaagaaagaaaaagggccctcgggggaaaacccaattcttcggggtttttttttttttttaaaaaggacccccccttggggggagaaaaaagaaaaccccccccccccttaaaaaaggggggggggggcccccccccccccccccgggggggggggccgcgggcgccctttccccccggcggcgcgaaaaaa

SEQ ID NO: 55953 - protein, 63 aa, Zea mays
  misc_feature: Ceres CLONE 1492034
MASLAFGSTVAAAVAATSGRTRPARRSVLVVPPAASRGGPGARPRKKKGPRGKTQFFGVFFFF

SEQ ID NO: 55954 - DNA, 790 bp, Zea mays
  misc_feature: Ceres CLONE 1492035
  misc_feature: Encodes the peptide sequence at SEQ ID NO. 55955
ttcccccccctttttgccttatattcccccgcagggatagagaaaaacacaaaacaaaaacaccccgggggggcggccgctcaatcctagaggagcccccgggctgcaggaattcctctcaggccgggaaaaaaaccaaacagcgagcgcaaggaagaaaggtcgaagcgtcgcctctctcggcacggagcctagtgcccggcctcgtgagatccgaaattcacaatcgaggatggcgacgaccgcgactaggcggcggtggaggcggcacgacggcggccatcatgacccacaccacttcgtccccatggacacccaagaccaagaagagctggtccggactctggaggctaagcaggcgcagcaaggacgccgcttggaggagccgacttcgcggggttcctccctaggttacgaggacatcccttgtccaacccagcatttcatcaatgctctggactacctagggaaactgcggctaccctggcctcacctacctggacagatcttccctgccactcaagtggtcaaacaattgcatgaaccgccgaaacgtagctacaacgcatgccctatctcgcccccccaaaggcgatcccaaaaaataaattctaaggcctcatcaaacgaaacaggcaaagggggaacttccgccgctaaagatcggcccatttaccccaccgaccacactggtttggaacacaaacagccactcctaggaggggttggccgaagagaactagcacaaggagtagtattaacctgcgctatccacattggaaggcaatat

SEQ ID NO: 55955 - protein, 186 aa, Zea mays
  misc_feature: Ceres CLONE 1492035
MATTATRRRWRRHDGGHHDPHHFVPMDTQDQEELVRTLEAKQAQQGRRLEEPTSRGSSLGYEDIPCPTQHFINALDYLGKLRLPWPHLPGQIFPATQVVKQLHEPPKRSYNACPISPPQRRSQKINSKASSNETGKGGTSAAKDRPIYPTDHTGLEHKQPLLGGVGRRELAQGVVLTCAIHIGRQY

SEQ ID NO: 55956 - DNA, 654 bp, Zea mays
  misc_feature: Ceres CLONE 1492037
  misc_feature: Encodes the peptide sequence at SEQ ID NO. 55957
aaagctggagctccccgcggtggcggccgctctagaactagtggatcccccgggctgcaggaattcgtctcacccctagaaaaagtttctgttcggacttccgccgcgcttcgccctctcgctccagccgcttcatagcgccgccgttcgtctctccgaccgccgcggagaatgccgatcaagaggttcgtgaagatcgggcgcgtgggcctggtgaactaccgcaaaaactatggacgcctcgtcgtcatcgtcaatgtggtcgaccagaacagggcacttgtggacgcccctgatatggtcaggtgccagattaacttcaaaccgctctcacttactgacatcaagattgacatcaaacgcgttcccaagaagtcaaccctgatcaaggctatggaggaagctgatgtgaagacgaactgggaaaacagctcatgaggcaagaagctgattgtccagattaggagggctgcactcactgactttgacagggtctaggtcatgctagcaaggatcatcagaggtgatgctatcaggcaagatctcgccaagctgcaagaagcactcacagcatgagtcccttttcgcgatggcatgtgagattttagtttcatgttgcatcccattatgtactgagtgtcgtcatatcagagt

SEQ ID NO: 55957 - protein, 88 aa, Zea mays
  misc_feature: Ceres CLONE 1492037
  misc_feature (44)..(89): Pfam Name: Ribosomal_L14e Pfam Description: Ribosomal protein L14
MPIKRFVKIGRVGLVNYRKNYGRLVVIVNVVDQNRALVDAPDMVRCQINFKPLSLTDIKIDIKRVPKKSTLIKAMEEADVKTNWENSS

SEQ ID NO: 55958 - DNA, 663 bp, Zea mays
  misc_feature: Ceres CLONE 1492039
  misc_feature: Encodes the peptide sequence at SEQ ID NO. 55959
  misc_feature (663)..(663): n is a, c, t, g, unknown, or other
aaagctggagctccccgcggtggcggccgctctagaactagtggatcccccgggctgcaggaattcgtctcacccctagaaaaagatcaagcgcctcccgcctccagcactcttaactcaggggacacgatcgccatggccgccacatcgaccgccgccgccgtgctgtgcccgccgtccgtggccgggctccgcctggcgccgtctcccggccgggcgcgcgtgtcgttccgcgcggcgccggcgccggcgcggcggtccgtggcggcgcgcgcggagctgagctcggcgctggtgatcagcctgagcacgggcgtgtcgctcttcctgggccgcttcgtcttcttcaacttccagcgggagaacgtggcgaagcaggtgcccgcgcagaacggcaagacgcacttcgacgccggcgacgagcgcgccaaggagttcgcggccctgctcaagtccaacgaccccgtgggcttcaacctcgtcgacgtcctcgcctggggctcgctcggccacatcgtcgcctactacatcctcgccacctccagcaacggatacgaccccaacttcttctgagcggtcgtcggggatgtactctacagacagccgtgtgcgtgtgcttgtcatgtatccgatcaaagtttggttaatttgggacagtagtgn

SEQ ID NO: 55959 - protein, 145 aa, Zea mays
  misc_feature: Ceres CLONE 1492039
  misc_feature (48)..(142): Pfam Name: PSI_PSAK Pfam Description: Photosystem I psaG / psaK
MAATSTAAAVLCPPSVAGLRLAPSPGRARVSFRAAPAPARRSVAARAELSSALVISLSTGVSLFLGRFVFFNFQRENVAKQVPAQNGKTHFDAGDERAKEFAALLKSNDPVGFNLVDVLAWGSLGHIVAYYILATSSNGYDPNFF

SEQ ID NO: 55960 - DNA, 615 bp, Zea mays
  misc_feature: Ceres CLONE 1492040
  misc_feature: Encodes the peptide sequence at SEQ ID NO. 55961
gctctttcctaatggatgccccgggctgcaggaattcctctcacccctagaaaaaatctcacggctagctagcacaagcatagtgcaggggcttgccacctaagtaagggccgcctgagagccatggcatccaaggacgtcctcttcttggctctcaacctcctgttcttcacggtggccaacgcctgcggcaactgcccgaccccaacgcccccggtcgagccaccgccgccgcctcctgctgctaccccacccccttcgtccagcggcaagtgcccgctgaacgcgctcaagttcggagtgagcgccgatgtgctcagactcgtcaaaggcgaggctaggaaagtgcctgccgagccatgctgtaccctcatcaaaagccttgcagacttagaggcctccgtctgcctctgcacggccatcaagggcaacgagctcggcgtcgtcatccatgtccccatcatgctcagcgccctcgtcaactactgtggcaagtgcgtgcccaagggctacttgtgcgagctaacagcttccggctgtaacacaatcagatctgttcacgtacgagattacatatgcacaacaccgtgcatgagcacaatgcatgacatgtgt

SEQ ID NO: 55961 - protein, 164 aa, Zea mays
  misc_feature: Ceres CLONE 1492040
  misc_feature (51)..(132): Pfam Name: Tryp_alpha_amyl Pfam Description: Protease inhibitor/seed storage/LTP family
MASKDVLFLALNLLFFTVANACGNCPTPTPPVEPPPPPPAATPPPSSSGKCPLNALKFGVSADVLRLVKGEARKVPAEPCCTLIKSLADLEASVCLCTAIKGNELGVVIHVPIMLSALVNYCGKCVPKGYLCELTASGCNTIRSVHVRDYICTTPCMSTMHDMC

SEQ ID NO: 55962 - DNA, 636 bp, Zea mays
  misc_feature: Ceres CLONE 1492042
aaagctggagctccccgcggtggcggccgctctagaactagtggatcccccgggctgcaggaattcgtctcacccctagaaaaaacactcttcagctcatatcagatgggctgctaagatagtcgtccaaaactataccgtctggttgctaaccttattttcccatggggtcagctaagctgcgcagctttccttgccgtcgctgccgtctgctagattgttgccgtcacatcggatgtggcttaatactccgggggcacgaccatgctaaaaagtttgcagactggtctcgtgtacttcgacaactgccatgtccgtgatgagatccgcgggcagtgctgtatctgactccagagccgcgagtgcctctgcagtctgaagcgggaggtggccctgcccatcgaacagcgacttctgctgcactgatactggtccatcgagagctcgacttcgggcacggcatacctcgccaaggtgatcaggcctcgcatgcttctacatctcaagtgctagcaggcattgcgagtacatatatctgtttagtgccggggtgctagggacctgttcacgattgtgccccgatactggtgcctcccaataagcgggaactggaagcagcccccgttgcttgtgctg

SEQ ID NO: 55963 - DNA, 739 bp, Zea mays
  misc_feature: Ceres CLONE 1492042-R
tccaccagaaccgattgggtactcgagcgtctcgtttttttttttttttttcaaaacgttctttaagagcacgcaaggtaattctcaacggacaagcacaggtacctacttccatagcaggctgaatggaaataaacagtaacaaggaacaattgtgaaacaaacaaaagcgcacgtacacaaaacataaatacgaactcgtaacggctcctagcacttgagtgtcttgaagcatgggaggcgctgcagctcggccagcttcaccgaccgtggaggcgacccttccttggagcatctgccttgatggtggcgatgcatgctgcagggcagcgccacctcccgattcagctggtagaggcactcgcggctctcgaccacgctacagaactgcccgcggatctcatcacgggccagggcagttggtgaagtacatgaatttgcgttctggcacctttactgggggcggcctttgccccccggaattcttctcctcggaaacccggtggggaacgggtaaaaaaggttaggaaaaccgtttttttaaaaggccaagggaaaaggtttggaaagccttcccttttggggccccattgggggaaaaataaagggggtttcccccctcccccgcggcgggggaaaaattattttttggggggggcaaaaaaattctcttttttataacaaaggtgggtctttctggaaaaatttgggggccgccgaaaaaaaaaaaaagtttttc

SEQ ID NO: 55964 - DNA, 667 bp, Zea mays
  misc_feature: Ceres CLONE 1492044
  misc_feature: Encodes the peptide sequence at SEQ ID NO. 55965
  misc_feature (174)..(174): n is a, c, t, g, unknown, or other
  misc_feature (389)..(389): n is a, c, t, g, unknown, or other
  misc_feature (390)..(390): n is a, c, t, g, unknown, or other
  misc_feature (409)..(409): n is a, c, t, g, unknown, or other
  misc_feature (416)..(416): n is a, c, t, g, unknown, or other
tccccgcggtggcggccgctctagaactagtggatcccccgggctgcaggaattcgtctcacccctagaaaaagaggcgaagggcggtcggggccagggaagtgcggaaggcgtcggtcggcggcagctctgctcggtcacagcgcttgaggggcggtgtagaggccgccgganggagtgaagagggagatggctccggccagcgggtggggccgggcggtggggaacacccggtcgttcgtgggcaacgcgctgggcggcctccgcgggtggagcaacctcgcctcctggagcgtcgccggaaccctcgcctactacctctgggggaagcccgcgcgccagctcctttttttttcccccccccccgggggacagtagggggggaaacnnatccttattctttacttcnaaaaacnaaaacccaaatcctaatcccccggggggtggggcgggtctttgggaaaaaaaaatggaacctccccaatttccaaaattcactagccgcccctgggccctttttttcccaaaggggcccgcccttttttgtgccacaatttcccggaaggggttcttcgctctcctccgggaaactctcgccacattttttttctttgtaaattgtttcctgtttggtgcggacgaaaaagcggcgctcgtataaaagcca

SEQ ID NO: 55965 - protein, 62 aa, Zea mays
  misc_feature: Ceres CLONE 1492044
MAPASGWGRAVGNTRSFVGNALGGLRGWSNLASWSVAGTLAYYLWGKPARQLLFFSPPPGGQ

SEQ ID NO: 55966 - DNA, 492 bp, Zea mays
  misc_feature: Ceres CLONE 1492045
  misc_feature (185)..(185): n is a, c, t, g, unknown, or other
  misc_feature (196)..(196): n is a, c, t, g, unknown, or other
aactggactccccgcggtggcggccgctctagaactagtggatcccccgggctgcaggaattcgtctcacccctagaaaaagatccctaatcccagcgcagcacaaacaaacaccgcgccgccgccacagctttgccctacagaatccttttactccgaagattctcaagacgcccctgatggcntccccgcgtcngcctccgctctggctcttcgtcggtggcccgtccctcggtggccctcccgcggggcggggcaagggagtcccttggggggcccgccgtttgggctccccggggccccggggaaccgggttcccctttgaggggggggccctcccccttttccggggggcttccccccttttttggggggccccccccggggggggttgttttttctcccccgcccccccgggggggggccccccccccccccctttttaaagaggggaggcgcccccccccccctcttttatggggacagggacac

SEQ ID NO: 55967 - DNA, 646 bp, Zea mays
  misc_feature: Ceres CLONE 1492046
  misc_feature: Encodes the peptide sequence at SEQ ID NO. 55968
aaaactggagctccccgcggtggcggccgctctagaactagtggatcccccgggctgcaggaattcgtctcacccctagaaaaaattcgttgcagtagtcgcagctgacggacgactgaaccaccgacagacaacatggccgcctccgcctccaccgtctccggcctcgccggcgcctccctggccagccgcccggcgttctccaccagcttcacgcggggcagccgggtgtcggcgaggaaccccctgatgaccaggaacctggagaggaatggcaggatcacctgcatgacgtttccccgggactggctgcggagggacctgagcgtcatcggcttcgggctcatcggctggatggggccgtccagcgtcccggccatcaacggcaacagcctcacggggctcttcttctccagcatcggccaggagctggcccacttccccacgcccccgcccgtcacctcccagttctggctgtggctagtgacatggcacctggggcctgttcatcgtgctcaccttcggccagatcggattccagggcaaggaccaaggactatttccaagaagtgaagccggttatgatccggatccctcatcgctgggtgctgcctttgcctgcgtggcctgcccgcaatcgaaaccc

SEQ ID NO: 55968 - protein, 145 aa, Zea mays
  misc_feature: Ceres CLONE 1492046
MAASASTVSGLAGASLASRPAFSTSFTRGSRVSARNPLMTRNLERNGRITCMTFPRDWLRRDLSVIGFGLIGWMGPSSVPAINGNSLTGLFFSSIGQELAHFPTPPPVTSQFWLWLVTWHLGPVHRAHLRPDRIPGQGPRTISKK

SEQ ID NO: 55969 - DNA, 825 bp, Zea mays
  misc_feature: Ceres CLONE 1492056
  misc_feature (220)..(220): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
aaagctggagctccccgcggtggcggccgctctagaactagtggatcccccgggctgcaggaattcgtctcacccctagaaaaaatagttgggacgatgttgccaaaagaactgagattgtttatgatcgtgcaatggaatctccaacaacaaatttactagatcgccttccccggtatcttacttgtggatcttgggctggaaaactgttttgcctaantttaatggaattccatccaaatttaccctactatggcgccttttaaaaatttctaccggcctgggcctgggnnntttaagccgcataaaacccacctaccaaattcgtatcatttaacccgctctcccccgcaaccccgccctttcccccttcccatcactgaccccattcccgtccccccaataccccataataccgcctataatctaacccccctctcttcttccttcccccttcacctgcacttcccttctttcttgcttcggcacttacctccattttaatccctcaatcctctcccccgtccccattacctcgccacccatctctattcccccatcaatcccttcctcttcctcttccatcttgatttatatcgccctttgttttctatacccccttttttccatcatgtccgcccgttaccccattcgccctgatttttcccccaatccttttaataaccggccccaactagtgcccttaataacccactttcctattcttgacgacctttaccccccgcccaactagctgatataaagataacttccgattccccaccgcaatgcttttaaactaagtttattattctaccacacatc

SEQ ID NO: 55970 - DNA, 849 bp, Zea mays
  misc_feature: Ceres CLONE 1492058
  misc_feature: Encodes the peptide sequence at SEQ ID NO. 55971
  misc_feature (27)..(27): n is a, c, t, g, unknown, or other
  misc_feature (37)..(37): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (849)..(849): n is a, c, t, g, unknown, or other
tttcccttcctctatttgatcccatantggaaatttntttnnnnnnnnnnnccaaactggagctccaccgcggtggcggccgctctagactagtggatcccccgggctgcaggaattcgtctcacccctagaaaaacgccgaagccgcgcgacggaaaccccaaacccaacctcatctcttttctcggcctctaccgccccctcgatcggtcggccggtcagctatgacgccgggaagctcggccgccggatccggcgtcgtcgttcctcggaacttcaggctcctagaagagcttgaacgtggagagaagggcattggagatgggacagtgagctatggcaaggatgacgccaaagacatctccctgccaaccatggactggggccctatttattgggccttcataaaaaacggttttataggggccccccccccaccgagggggggggttgtcccgccccacaaccacccccccctggtgagaggcccgtcgtccggttccgagttctcatgtcctcgaatataaaccctctcacattgccctcttcccctcaccacaaaccccggggagttgggttggtcgaccacccgctagagatcatcgccccccttccttatgggcgtcgaaccgggcccggccgatggcaccccccccgcctccgagataagagcctgcctatatttccggaatcctgccgataataagaaggatcctattattccgcttcctccaaactatgttctgccttccctttcctctcctcttcaaaagagagaaccccgcctccgcctaccgatcatggaagacgtccatacgcacgcctatccccccgaggaaattctccccn

SEQ ID NO: 55971 - protein, 100 aa, Zea mays
  misc_feature: Ceres CLONE 1492058
MTPGSSAAGSGVVVPRNFRLLEELERGEKGIGDGTVSYGKDDAKDISLPTMDWGPIYWAFIKNGFIGAPPPPRGGVVPPHNHPPLVRGPSSGSEFSCPRI

SEQ ID NO: 55972 - DNA, 828 bp, Zea mays
  misc_feature: Ceres CLONE 1492164-R
  misc_feature: Encodes the peptide sequence at SEQ ID NO. 55973
ccgcggtggcggccgctctagaactagtggatcccccgggctgcaggaattcccagagctctggttttttttttttttttttaattaaaccaaacatttttttttgcgaacacttattactcttagttcgccaaacaaaacaagttggcagcccggatatcgaggttgaaattacaggttttagcaggtaagcaagcaagctgcacatgtatcaaaacttggaaataaagtcgtaaatgtgctggctgacctcgtcggccttctcctgctggacaaagtggccggccccgggaataacaacaaccctttcgagccccgggacgtcggcctcaaacccgcccttggggatgtagccctggatgcccgggtaggggtaggtgaggcccccccccccaacaataaacctggggggcacccgcaccttggggtccgcccacggggcccccagctcccagttgcggtccatgttgcggtagtatttgatgggccccgtgaagcctgtccgctcgaactccgacgcgaaggggctcacgtcctcctccgtcagccacgggggcagcggctcctcctcggcggcgtccgccgccggcggtttgtcttccccggccgccaaggaggtgaagcggttgcacaggatccgcttcatcaggtacccggcgttggccgggaagaactccttctctgcgacaccgggctcctgcagttcacttagttgtaacttgtaaggaaggagatccaaaaaacccccgatctccatatgcctacatgatacatgcccaaaaaaaaagatttcggttccatgatccctcccgctctctaaaaatggta

SEQ ID NO: 55973 - protein, 80 aa, Zea mays
  misc_feature: Ceres CLONE 1492164-R
MGPVKPVRSNSDAKGLTSSSVSHGGSGSSSAASAAGGLSSPAAKEVKRLHRIRFIRYPALAGKNSFSATPGSCSSLSCNL

SEQ ID NO: 55974 - DNA, 669 bp, Zea mays
  misc_feature: Ceres CLONE 1492169
  misc_feature: Encodes the peptide sequence at SEQ ID NO. 55975
cgattgggtaccgggcccccctcgagccctgcagtggtaaagggctcgctccctccctccctccctcccgcgcggatcacagaagggctcacggtcacggccggcctcccaattcgcaacctcgcctccgcctctcctcctaccccctccgaaaagcaagctccggccgggccgccaccaccaccaccgcgcgcgcgtgcacgcgctcccacacacagacagacagacagacagacagagtgagagacgcacggtggttcggggtctcccttctgccaggcgcacgaggagccatggcgcagcgcgacaagaaggaggagcccacggagctccgggcgccggagatcacgctgtgcgccaacaactgcgggttcccgggtaacccggccacgcagaacctgtgccagagctgcttctcggcgtcgaggtcgccgtcgtcccctacctcctcctcctcttccctggcgtccgcggcgtcgcagccgaggccagcagcgctcgtcgtagacgcggcagcggtggaggcgctggccgctccggcggccgcggccgcgggccagggccaggctacggaagccgcggcgagggcgtccgcgagccggtgctccagctgccggaagcgcgtggggctgacggggttccggtgccgctgcggcgagctcttctgcg

SEQ ID NO: 55975 - protein, 125 aa, Zea mays
  misc_feature: Ceres CLONE 1492169
MAQRDKKEEPTELRAPEITLCANNCGFPGNPATQNLCQSCFSASRSPSSPTSSSSSLASAASQPRPAALVVDAAAVEALAAPAAAAAGQGQATEAAARASASRCSSCRKRVGLTGFRCRCGELFC

SEQ ID NO: 55976 - DNA, 702 bp, Zea mays
  misc_feature: Ceres CLONE 1492173
  misc_feature: Encodes the peptide sequence at SEQ ID NO. 55977
  misc_feature (451)..(451): n is a, c, t, g, unknown, or other
  misc_feature (452)..(452): n is a, c, t, g, unknown, or other
cgattgggtaccgggccccccctcgagccactgctgtggtaaagggcgtataccacccccgtgacttcccgatctccggcgatggccgcgcggcgcctcggatcccccgcatctaggtggctgcgcccgtctgcgctgctcctcctggtcgcctctgctctcctctcggccccgtcgccggcccgggccctccggttcgacctcgagtccggccacaccaagtgcgtctccgacgagatcaaggtcaacgccatggccgtcggaaagtaccacatcgtcgggcccgaccccaactcacccgacgcccagctccccgaatcgcaccgcatctccctcagggtgacgtcgtcgtacgggaacagcatgcactacgcggagaacgtgcagtcgggccacttcgccttcacggcggcggaggccggcgactacctggcctgcttctgggctcccnngacacagcctccggtcaccatcgggttcgagttcgactggaggagcggcgtctcccgcaaggactatcccaccgtccccaagaaagccaggtccaatttgatgaattgggacctgaaaaaccttggggaaccttttaaaatttccttgaaaaatgctttttttccgtttaaagggaaaaaaaaatggggagtgttaaaagggaaaaaaaccccgggggggggtgtggggggggtctccccccccgggggg

SEQ ID NO: 55977 - protein, 207 aa, Zea mays
  misc_feature: Ceres CLONE 1492173
  misc_feature (76)..(137): Pfam Name: EMP24_GP25L Pfam Description: emp24/gp25L/p24 family/GOLD
  misc_feature (124)..(124): Xaa is any aa, unknown, or other
MAARRLGSPASRWLRPSALLLLVASALLSAPSPARALRFDLESGHTKCVSDEIKVNAMAVGKYHIVGPDPNSPDAQLPESHRISLRVTSSYGNSMHYAENVQSGHFAFTAAEAGDYLACFWAPXTQPPVTIGFEFDWRSGVSRKDYPTVPKKARSNLMNWDLKNLGEPFKISLKNAFFPFKGKKKWGVLKGKKTPGGGVGGVSPPGG

SEQ ID NO: 55978 - DNA, 662 bp, Zea mays
  misc_feature: Ceres CLONE 1492179
  misc_feature: Encodes the peptide sequence at SEQ ID NO. 55979
  misc_feature (388)..(388): n is a, c, t, g, unknown, or other
tcgagccctgcagtggtaaaggggtgtcgctccactgctcagctagcgtccacctccacttcctatcgccatctctccccctttcgtcatccttctctctcctctgccatcgcgtccgccgccccaccgccatccgcgccgaagctgaagtgcggcctccgctacctgtctccgcggcggagtcagagccccctgacgccggcgctgtggaagccgaaggtcagggacccgtggagctccgcgctccgacgctcttctcgactgatgacaatcccaccccgctccagactgccaccagtctcctcctcaccggcgccatctcggtcttcctcttccgcgccctccgccgccgcggccgcggcgccaaggagttcaaagtgcggtccancggtttgaaaaaccccacaatctcccgaggaggccctggagagggtgaaattgatgaccgcctcccgatcgaaaccgaaaaggcaacttccccccctccaggcctctgcttcggcgggattgccgcggggggtcctcccccttcctcctctacaagttcaccacccccgtcgaaggctggcccctcaaccctacaaaccaacttccaaaggctttcttcgggttcctccagatttccaatcaccaataagaaacaatttggccacgggggcctg

SEQ ID NO: 55979 - protein, 220 aa, Zea mays
  misc_feature: Ceres CLONE 1492179
  misc_feature (129)..(129): Xaa is any aa, unknown, or other
EPCSGKGVSLHCSASVHLHFLSPSLPLSSSFSLLCHRVRRPTAIRAEAEVRPPLPVSAAESEPPDAGAVEAEGQGPVELRAPTLFSTDDNPTPLQTATSLLLTGAISVFLFRALRRRGRGAKEFKVRSXGLKNPTISRGGPGEGEIDDRLPIETEKATSPPPGLCFGGIAAGGPPPSSSTSSPPPSKAGPSTLQTNFQRLSSGSSRFPITNKKQFGHGGL

SEQ ID NO: 55980 - DNA, 685 bp, Zea mays
  misc_feature: Ceres CLONE 1492185
  misc_feature: Encodes the peptide sequence at SEQ ID NO. 55981
  misc_feature (474)..(474): n is a, c, t, g, unknown, or other
cgattgggtaccgggccccccctcgagccctgcagtggtaaagggttgaccgcgccaccgcggccttgggcggagcaatccaggtggagtgggccgagaagcggccgcctgatcgagccgaaccaacggccgacgcggcgcacgccatggtagcagctggcaatccacctccaaaaccgtgggaacgtgcaggaaattcatctggcccagtgccttttaagccgccctctggtggtagcaccagtgatgttgttgaagcttctgggacagcaaaacatggagaagttgtttctgcttctggaaacaatgttgcctccaatgtaaacagcacaatttcaatgcctgtgcccccaaggccttggcagcagcaaggctatgaaaactcttatgggggttatggctccagtatgtatagctcttaccgtggatatagtggaccctatgaaataacatgtactcaggttatgaaggaangttatggcggtatgaattgaagttccgggaaagtattggtgaaccaaggtttacggggggattggaagaaccctatgggggttttgggatagggcataaaccctttaaaccgggacccgattttattggggccccccaccccccccccgggtttcggggggccctcccaaaaaagaaaacagggggtttgaaaaattcttggggggaggtt

SEQ ID NO: 55981 - protein, 115 aa, Zea mays
  misc_feature: Ceres CLONE 1492185
  misc_feature (110)..(110): Xaa is any aa, unknown, or other
MVAAGNPPPKPWERAGNSSGPVPFKPPSGGSTSDVVEASGTAKHGEVVSASGNNVASNVNSTISMPVPPRPWQQQGYENSYGGYGSSMYSSYRGYSGPYEITCTQVMKEXYGGMN

SEQ ID NO: 55982 - DNA, 640 bp, Zea mays
  misc_feature: Ceres CLONE 1492187
  misc_feature: Encodes the peptide sequence at SEQ ID NO. 55983
tcgagccctgcagtggtaaaggctcgagcctgacccttacgccttcgctcgcgccgccgccgccgccgccgctacgccccgcacctcgcttcatttcgtgtccccaagatgacaaagcgcactaagaaggcacgaattgttggcaaatatggaaccaggtatggtgctagcttgcgtaaccaaatcaagaagatggaggtatctcaccattccaagtacttttgcaagttctgtgggaagtttgctgtgaagaggaaagcagttgcaatttgggggtgcaaggactgtgggaacgtgaaggctggtggtgcttacaccatgaacactgctagtgcggtcaccgtcaggagcacgatccgccgcctgagggagcagactgaagcatgatatagctcttaacattattggggtttcctgtagttgctcttgtcacgcaagttgtgggcgccttatctaatgcaaatgtggaatcactgtactggctgttttgccgagacaatgctccttatatttggtttatgctctaagatctcaaagttgtgttgctgagatttgccctcggttacggatctgaatctcacaaatgatatttgatcctgtgccgtcttactccaaaaaaacaagaaccagacctctgggg

SEQ ID NO: 55983 - protein, 92 aa, Zea mays
  misc_feature: Ceres CLONE 1492187
  misc_feature (2)..(91): Pfam Name: Ribosomal_L37ae Pfam Description: Ribosomal L37ae protein family
MTKRTKKARIVGKYGTRYGASLRNQIKKMEVSHHSKYFCKFCGKFAVKRKAVAIWGCKDCGNVKAGGAYTMNTASAVTVRSTIRRLREQTEA

SEQ ID NO: 55984 - DNA, 658 bp, Zea mays
  misc_feature: Ceres CLONE 1492191
  misc_feature: Encodes the peptide sequence at SEQ ID NO. 55985
cgattgggtaccgggccccccctcgagccactgcagtggtaaaggagtcagtccatccaccaaaccagcactcgcttcgctccaccaccagctcgaaacccatggaagcggaggcgttcccgatacggttcacgcggggcgtgcgcgcctactggcggcgccaaaagtaccaccgcctggcgggcgccgacggcaagcagccccgctcgcggcagctgggctccggcggcggcggcggcgcgcgcgtgcggcgaccggtgcgcgtgctcctgtcgggcccgcggcgcgcgctggcgcgggcgcgagacgcgtacgtgggcggcatgctggatctggacaggcgcgcgtcggcgctcgcgctgccgggcgccgtccaggcgctctgggccaagggggtgccgcgccataatcagcaggaccaccatctcccggcgcccggcaacggctagcccacggagttcgagcagcgcctcatcttggagatctacaagtctctcgtcccgtcgaaggagctgagcaccatgctccactcctccgccgcgcacctgcggcccgccgcctcggcggcgggcctcccgtcgcaccacctcctcgacatgtgatgagccgcgccgctggatggacaacgataaagaacgacgccccccaccttatcatt

SEQ ID NO: 55985 - protein, 115 aa, Zea mays
  misc_feature: Ceres CLONE 1492191
MEAEAFPIRFTRGVRAYWRRQKYHRLAGADGKQPRSRQLGSGGGGGARVRRPVRVLLSGPRRALARARDAYVGGMLDLDRRASALALPGAVQALWAKGVPRHNQQDHHLPAPGNG

SEQ ID NO: 55986 - DNA, 683 bp, Zea mays
  misc_feature: Ceres CLONE 1492197
  misc_feature: Encodes the peptide sequence at SEQ ID NO. 55987
  misc_feature (377)..(377): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (634)..(634): n is a, c, t, g, unknown, or other
  misc_feature (647)..(647): n is a, c, t, g, unknown, or other
  misc_feature (654)..(654): n is a, c, t, g, unknown, or other
  misc_feature (668)..(668): n is a, c, t, g, unknown, or other
  misc_feature (669)..(669): n is a, c, t, g, unknown, or other
  misc_feature (682)..(682): n is a, c, t, g, unknown, or other
cgattgggtacgggccccccctcgagccctgcagtggtaaaggcgcctgccttaaccattcctcccaacaccacctcgcctgcgatcttcgtagcctccgtcgcgtcgagcatcgatcatgtcggcctactgcggaaagtacaaggatgagctcatcaagaatgctgcctacattggcacccctggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaaccaaaaagggnaattgggggggnnnnnnnaaaaaaaaaaaaaagaagtggtgggagatgtgatttaattataaaataaagaagtttttaataaaattataaaaaataaatatttataaatattgtgtttttaaatttttaataatattttatttaatttatgggggttttattagagaggaagattataattttttttgtgtgtggtgggaggggaaaaatagaagtattagtatattaatgttgtgttgtagtgtttttgtattggnttgtgggtattanactcttntcctaatgtctccnnccccgacctcctnc

SEQ ID NO: 55987 - protein, 104 aa, Zea mays
  misc_feature: Ceres CLONE 1492197
  misc_feature (11)..(104): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature (87)..(87): Xaa is any aa, unknown, or other
  misc_feature (91)..(91): Xaa is any aa, unknown, or other
  misc_feature (92)..(92): Xaa is any aa, unknown, or other
  misc_feature (93)..(93): Xaa is any aa, unknown, or other
MSAYCGKYKDELIKNAAYIGTPGKGILAADESTGTIGKRLSSINVENVEENRRALRELLFCCPGALQYISGVILFEETLYQKNQKGXLGGXXXKKKKEVVGDVI

SEQ ID NO: 55988 - DNA, 740 bp, Zea mays
  misc_feature: Ceres CLONE 1492202
  misc_feature: Encodes the peptide sequence at SEQ ID NO. 55989
cgattgggtccgggccccccctcgagccactgcagtggtaaagggtagtaattagtttgtgcccgtgtccgtgtttggttgaataataaattgacgaaagagggccaagtatagcttagagagagaagctagctagctgaaatggaggctagcagccgccgccgcgtctctcttgtgccactgctggtggtgatcatcgggtgctgtgcctgccgcgcccagatcccgatcccggcgaggacggacgggttcgtgtacggcgggaagccgccggcgtggggcgagacggtggtggtagaggcgttcttggacccagtgtgccccgacagccgcgacgcgtggccggcgctcaagatggtcgtctagcactacccctcacgcggtgtggggggcggcgttcacctcttcccgctgcctttaccacagttatggccttcattgcgtgcccggccaattccttgcggtggaacaaacttaaatcccgtcgttccggggaccccctcctgctggaaaaattccttttaaatacccggaacacgttacttataaatccccccaacattacgaaaaaatctaagagcccaccggtgggtttgatagaaaaccaccaaaaaacccttggttggggctcacccatccgctgggaagttaaatttcgggggggcctttcacaagccaggttttccccccactaccccatttcctggactcgggcgtacccgggcatctcctttcttgaa

SEQ ID NO: 55989 - protein, 74 aa, Zea mays
  misc_feature: Ceres CLONE 1492202
MEASSRRRVSLVPLLVVIIGCCACRAQIPIPARTDGFVYGGKPPAWGETVVVEAFLDPVCPDSRDAWPALKMVV

SEQ ID NO: 55990 - DNA, 678 bp, Zea mays
  misc_feature: Ceres CLONE 1492208
  misc_feature: Encodes the peptide sequence at SEQ ID NO. 55991
cgattgggtaccgggccccccctcgagccctgcagtggtaaaggaagcaacccagccgcccattgccggcattgctcgcagcgctagcttcttgcgctcatcactcgtctccgaccaagatcagcaaggacggcatggctctcgaagcagcgtacgactacctgcacgtcgccgtcgtccagtgcacgcccacacaagcagcagcagtcctcggcgtcctcctcctcctcgccatccggctagccgcggcggcgaggagctcgtccgcgacgtcccccaaatggaagcagcacaggctgccgccgacgcctccggggaagctccccatcatcgggcacctccacctcatcggctcccacccgcacgtctccttccgcgacctccacgccaagtacggccacaacgggctgatgctggtgcaggtcggcgccgtgcccaccatcgtggtgtccacgccgcaagccgccgaggccgtgctccgcacgcacgaccacgtgctggcgtcccgcccgcggaaccccgtccccgacatcatccgctacaactccccggaagtgggcctttcgcgccctaacggcgaagtactgggcgcaacggtgcggaaaagtggtcaaaaaagcaccttgcttcagcgaccaagaatgggtctttctcccaagccggcggggaaccgggaag

SEQ ID NO: 55991 - protein, 181 aa, Zea mays
  misc_feature: Ceres CLONE 1492208
  misc_feature: SWISSPROT Homolog: EC 1.14.13.68 4-hydroxyphenylacetaldehyde oxime monooxygenase
MALEAAYDYLHVAVVQCTPTQAAAVLGVLLLLAIRLAAAARSSSATSPKWKQHRLPPTPPGKLPIIGHLHLIGSHPHVSFRDLHAKYGHNGLMLVQVGAVPTIVVSTPQAAEAVLRTHDHVLASRPRNPVPDIIRYNSPEVGLSRPNGEVLGATVRKSGQKSTLLQRPRMGLSPKPAGNRE

SEQ ID NO: 55992 - DNA, 670 bp, Zea mays
  misc_feature: Ceres CLONE 1492212
  misc_feature: Encodes the peptide sequence at SEQ ID NO. 55993
cgattgggtccgggcccccctcgagccctgcagtggtaaagggctgtcgccactcgctacctcacgcgcttccgctacctctcgttgtgtctcgtcctctctctcttctattccattcccaacttggctgcccaacccttgcgtcggtagacggcggccgcggcgaggatagagggttccctgaggaggcagtgatggagaccatggctaagtacaaccgaagcaacccggcagtgaagcggatcctgcaggaggttaaggagatgcagtccaacccctcacccgacttcatggccctccccctcgaggaagacatcttcgagtggcaatttgctatccttggcccgagagacagcgagtttgagggtggaatctatcatggcaggatccagcttccctcggattatccattcaagccgccgtccttcatgctactcacgccaagtggacgctttgagattcagaagaagatttgtttgagcatatccaattatcaccctgagcactggcagccatcatggagtgtgcgcacagcgttggtggccttgattgcattcatgccaaccaaccctggtggggcattgggctcattggattacaaaaggaagatagacgggcacttggtataaaatcacgtgaagcaccgcccaaatttgggtcccccagaacg

SEQ ID NO: 55993 - protein, 144 aa, Zea mays
  misc_feature: Ceres CLONE 1492212
  misc_feature (16)..(143): Pfam Name: UQ_con Pfam Description: Ubiquitin-conjugating enzyme
  misc_feature: SWISSPROT Homolog: EC 6.3.2.19 Ubiquitin--protein ligase
METMAKYNRSNPAVKRILQEVKEMQSNPSPDFMALPLEEDIFEWQFAILGPRDSEFEGGIYHGRIQLPSDYPFKPPSFMLLTPSGRFEIQKKICLSISNYHPEHWQPSWSVRTALVALIAFMPTNPGGALGSLDYKRKIDGHLV

SEQ ID NO: 55994 - DNA, 677 bp, Zea mays
  misc_feature: Ceres CLONE 1492215
  misc_feature: Encodes the peptide sequence at SEQ ID NO. 55995
  misc_feature (428)..(428): n is a, c, t, g, unknown, or other
cgattgggtacgggccccccctcgagccactgcagtggtaaaggtgtgacttgtgcgccatcacacacaagacacaaccccactcacccggcagggaggccctcttcgtcggcggaggccatggtttccctcaagccgcagaagaggctcgccgcgggagtcctaaaatgtggcaaggggaaggtgtggcttgaccccaacgaggtctacgagatctcgatggctaactcgcgtcagaacattcgtaagctggtgaaggatggattcataattaagaagccacagaaaatccactcaaggtcccgggcaaggagggcccatgaggccaagcagaaggggaggcactctggttacggtaagcgcaggggtaccagggaggctaggctccccaccaagatcctttggatgcgcaggatgcgtgtcctcangcgtctgctgcgcaagtatcgtgaagcaaagaaatcgacaacacatgtaccacgatatgtatatgaaagtaaaaggaacatgtttaaaaataagagggtactcatggagagcatccacaagtcaaaggccgagaagccagaagagagactctcctcgatcagttttgagccagcgagccagaacaaggctcccgtggaaaaaaaatggcaaggagggaagaaaaatttgctcaagccccagggaaactg

SEQ ID NO: 55995 - protein, 185 aa, Zea mays
  misc_feature: Ceres CLONE 1492215
  misc_feature (2)..(148): Pfam Name: Ribosomal_L19e Pfam Description: Ribosomal protein L19e
  misc_feature (103)..(103): Xaa is any aa, unknown, or other
MVSLKPQKRLAAGVLKCGKGKVWLDPNEVYEISMANSRQNIRKLVKDGFIIKKPQKIHSRSRARRAHEAKQKGRHSGYGKRRGTREARLPTKILWMRRMRVLXRLLRKYREAKKSTTHVPRYVYESKRNMFKNKRVLMESIHKSKAEKPEERLSSISFEPASQNKAPVEKKWQGGKKNLLKPQGN

SEQ ID NO: 55996 - DNA, 669 bp, Zea mays
  misc_feature: Ceres CLONE 1492220
  misc_feature: Encodes the peptide sequence at SEQ ID NO. 55997
  misc_feature (248)..(248): n is a, c, t, g, unknown, or other
  misc_feature (604)..(604): n is a, c, t, g, unknown, or other
  misc_feature (626)..(626): n is a, c, t, g, unknown, or other
  misc_feature (632)..(632): n is a, c, t, g, unknown, or other
  misc_feature (633)..(633): n is a, c, t, g, unknown, or other
  misc_feature (669)..(669): n is a, c, t, g, unknown, or other
tcgagccctgcagtggtaaagatgggtatcggtcgctgcacactgtcgtcatgggcgaaggcgtccatccgttcgaggtccagatccgcacgagggagatgcatctgcaggccgagtacgggttcgcggcgcactggaggtacaaggagggcacctgcaggcactcgttcgtgctccggatggtggagtgggcaaggtgggtgctcacatggcagtgcgaggcgatggacagaagaaaaaccgggggnaaaaccccccggggccccccctttttccccccccctttttttggggggggcccacaaaaggttttgggaaaaatatgggaaaaccggggggcaaaaaccctggggttggaaaaacccccgtttgtgaaaaaggggggcccccacccccaaaaccccccaagagcccaaatgggggcccccccccggttttttcccccccccccccccaaagcacaaattttgttcccaaaaaaagggaaaaaattttgtccccccccccacaaataaaaatcccctccctataaaaaaaaaaccccccccccccccaataatggtggacccacccccccctcttttgtagttagggggagaacccnccggttttttttttcctcctcnttcctnntcccccccttctttttgtgaaaaaaccccggggccn

SEQ ID NO: 55997 - protein, 170 aa, Zea mays
  misc_feature: Ceres CLONE 1492220
  misc_feature (1)..(51): Pfam Name: RelA_SpoT Pfam Description: Region found in RelA / SpoT proteins
  misc_feature: SWISSPROT Homolog: EC 2.7.6.5 GTP diphosphokinase
EPCSGKDGYRSLHTVVMGEGVHPFEVQIRTREMHLQAEYGFAAHWRYKEGTCRHSFVLRMVEWARWVLTWQCEAMDRRKTGGKTPRGPPFFPPPFFGGGPQKVLGKIWENRGAKTLGLEKPPFVKKGGPHPQNPPRAQMGAPPRFFPPPPPKAQILFPKKGKKFCPPPHK

SEQ ID NO: 55998 - DNA, 644 bp, Zea mays
  misc_feature: Ceres CLONE 1492223
  misc_feature: Encodes the peptide sequence at SEQ ID NO. 55999
  misc_feature (644)..(644): n is a, c, t, g, unknown, or other
cgattgggtccgggccccccctcgagccactgcagtggtaaaggttagaccttatctccgttgttactgcggttccttctctgctcttatgttgcatgtccccttacctctcttggtttcatgtatcaatttcatccgacggcttgctggactacaaggctactggtcatgaaccagaagcacgaactgctgtgtgtagccctgtcctcctgaacattgaggaatgagttgtgatagcggcaaaggcggctcttgtttccactgctctgctaattcatgatctgcttcagatcgctgttatttttctgaaccaccccaaagtagtagcctcttcttatgtacccattcgttctttccttgttcatactgactcaccttgtgatgatatacatgatccttttcgacatctacatcgcccctcatctccttctgcgagctaactatatgcacatctcgagggatgtgtgatcattcatgcgtgattactgtacgatttgttgtctatcgatcgtggctggatgtcttatagagagacgaacctggccctggacctgagtgctctgtgctacctcgtcatacagatcatatgtggagatcatggaaatcatattcatgggtgagtgactcgatgatctcgatgattn

SEQ ID NO: 55999 - protein, 43 aa, Zea mays
  misc_feature: Ceres CLONE 1492223
MSPYLSWFHVSISSDGLLDYKATGHEPEARTAVCSPVLLNIEE

SEQ ID NO: 56000 - DNA, 630 bp, Zea mays
  misc_feature: Ceres CLONE 1492225
  misc_feature: Encodes the peptide sequence at SEQ ID NO. 56001
cgattgggtaccgggccccccctcgagccactgcagtggtaaagggcgcacctgcaagcctcgagtggagctcttccacggccgcggtggagatggcggcgaatctggaggacgtgccgtcactggatctgatgcacgagctgctccgccgcatgaagtgcagctccaagcccgacaagcgcctcatcctcatcggtccacctggctctggaaagggaactcagtctcctattatcaaggatgaatattgcttgtgccatttagccaccggtgatatgctgagggctgctgtggcggccaagacacctctaggtatcaaagctaaagaagctatgaataagggagagcttgtttcagatgatttggttgtgggcattattgatgaagctatgaagaaaccctcatgccagaaaggtttcattcttgatggctttcctagaactgtcactcaagcacagaagcttgatgaaatgttggcaaagcaaggtgccatgttgacaaagtcctgaactttgcaattgatgatgctgtattggaagaacggatactggtccgtggatcactcagccatggtaggacttaccactcaaaatttgcactccaagtcctcaggagttgatgatgaactgg

SEQ ID NO: 56001 - protein, 138 aa, Zea mays
  misc_feature: Ceres CLONE 1492225
  misc_feature (33)..(139): Pfam Name: ADK Pfam Description: Adenylate kinase
  misc_feature: SWISSPROT Homolog: EC 2.7.4.3 Adenylate kinase
MAANLEDVPSLDLMHELLRRMKCSSKPDKRLILIGPPGSGKGTQSPIIKDEYCLCHLATGDMLRAAVAAKTPLGIKAKEAMNKGELVSDDLVVGIIDEAMKKPSCQKGFILDGFPRTVTQAQKLDEMLAKQGAMLTKS

SEQ ID NO: 56002 - DNA, 668 bp, Zea mays
  misc_feature: Ceres CLONE 1492226
  misc_feature: Encodes the peptide sequence at SEQ ID NO. 56003
  misc_feature (619)..(619): n is a, c, t, g, unknown, or other
  misc_feature (623)..(623): n is a, c, t, g, unknown, or other
  misc_feature (661)..(661): n is a, c, t, g, unknown, or other
caattgggtaccgggccccccctcgagccctgcagtggtaaagggcgtggtgagcttataagcgagatttcccctcctctcacagcccgggttttgagagcgagtgaaggggctcgcttgtgttagcccacgagcaccggaaacgcccaaaggtgtagcgttgagtgggctgggccgggaaggtcgctgacatggacctgcgccacctcgaggagaacctcaagagcgccgtcaagagctgcgtgatggcggtggccaggaaggtgctgaccaccagcctcggcggcgacctccacagcgcgcgcttcagcgagaaggccctgctcaccgccatcgaccgcgaggcggtgtacgggtactacgacgacccctgcagcgccaactcgcccctgatgaagaagatccgggccgtgctggtggaccacgccctcgccagcggcgaggccgagaaggacgccagcgcgtccgtgttctccaagatcaacaggttcgaggaggagctgcgcgaggcgctgcccagggagatggaagccgcccgcgtggccttcgagaccggcgccgcgccgatcgccaacaggatcaaggagagccggtcgtacccgctgtaccgcttcatccngcanggactcggcgccgtgtacctgaccggcgagaagctcangtccccc

SEQ ID NO: 56003 - protein, 159 aa, Zea mays
  misc_feature: Ceres CLONE 1492226
  misc_feature: SWISSPROT Homolog: EC 4.3.1.5 Phenylalanine ammonia-lyase
  misc_feature (143)..(143): Xaa is any aa, unknown, or other
  misc_feature (144)..(144): Xaa is any aa, unknown, or other
  misc_feature (157)..(157): Xaa is any aa, unknown, or other
MDLRHLEENLKSAVKSCVMAVARKVLTTSLGGDLHSARFSEKALLTAIDREAVYGYYDDPCSANSPLMKKIRAVLVDHALASGEAEKDASASVFSKINRFEEELREALPREMEAARVAFETGAAPIANRIKESRSYPLYRFIXXGLGAVYLTGEKLXSP

SEQ ID NO: 56004 - DNA, 671 bp, Zea mays
  misc_feature: Ceres CLONE 1492228
  misc_feature: Encodes the peptide sequence at SEQ ID NO. 56005
  misc_feature (671)..(671): n is a, c, t, g, unknown, or other
cgattgggtaccgggccccccctcgagccactgcagtggtaaaggagctcgaggtagcagctccccccgcaaaaaccctagctttacctccccacaagcgcctccaagatgaagctcgtcaggttcttgatgaagctgaacaacgaaacggtgaccatcgagcttaagaacggcaccgtcgtacacggaaccattaccggtgttgacatcagcatgaatactcatctgaagactgtgaagctgacactaaaagggaaaaatcctgttacccttgatcaccttagtgtgaggggaaacaacatccgctattatatccttcctgacagcctaaacctggagactttgctggttgaggaaacaccaagggtcaagcctaagaagcctacttctgggaagcccttgggccgtgggcgtggccgtggtcgtgggcgcggtcggggtcggggacgttgagcatgctagctgcttttggaaattgcattgcgtgcatctgcagtgtaatctacattcctatcaattgtacgaagtatgcctttgattatgcaaccatgtatcaattgtttttttttgccgtggatttatgttgatgaggttaccatgtgatcatatgttctttccctagaacttttaagaacattaaatactatctttaagacttctctagacaaaan

SEQ ID NO: 56005 - protein, 114 aa, Zea mays; identical to SEQ ID NO: 37056
  misc_feature: Ceres CLONE 1492228
  misc_feature (5)..(70): Pfam Name: LSM Pfam Description: LSM domain

SEQ ID NO: 56006 - DNA, 668 bp, Zea mays
  misc_feature: Ceres CLONE 1492231
  misc_feature: Encodes the peptide sequence at SEQ ID NO. 56007
  misc_feature (624)..(624): n is a, c, t, g, unknown, or other
cgattgggtaccgggccccccctcgagccctgcagtggtaaaggcccagctggaggtctcgctgttcccttcacgatacgcccccccaaagcggatcaaaccctagatctcgtcttgtcgccccgttcctccgatcccatcctatccgatcctcatggattcctcctcgtccagcctcagccagcagcccgagttcgactacctcttcaagctactccttatcggcgactccggcgtcggcaagagcagcctcctcctccgcttcaccgccgactccttcgatgacctctcccctaccataggtgatctctttgacttcgattatattccccgatctgaccgcttcaccgccgactccttcgatgacctctcccctaccataggtgttgacttcaaggtgaagatggttagcattggtggcaaaaaactcaagcttgccatctgggacacagctggacaagagaggtttaggaccttgaccagctcttactacagaggggcacaggggatcattatggtgtatgatgtcagtcgacgagagacgttcaccaatctttctgatatatgggccaaggaaattgacctgtattcacccaacaggactgtgtaaagatgcttgttggnaaataaagtagacaggaaagtgagagggctgtcacgaaaaagga

SEQ ID NO: 56007 - protein, 151 aa, Zea mays
  misc_feature: Ceres CLONE 1492231
  misc_feature (19)..(152): Pfam Name: Ras Pfam Description: Ras family
MDSSSSSLSQQPEFDYLFKLLLIGDSGVGKSSLLLRFTADSFDDLSPTIGDLFDFDYIPRSDRFTADSFDDLSPTIGVDFKVKMVSIGGKKLKLAIWDTAGQERFRTLTSSYYRGAQGIIMVYDVSRRETFTNLSDIWAKEIDLYSPNRTV

SEQ ID NO: 56008 - DNA, 720 bp, Zea mays
  misc_feature: Ceres CLONE 1492232
  misc_feature: Encodes the peptide sequence at SEQ ID NO. 56009
  misc_feature (685)..(685): n is a, c, t, g, unknown, or other
cgattgggtaccgggccccccctcgagccctgcagtggtaaaggctgtgctagtataggctatatataatacaccaacacaccgagagggttcttccagttcgcaagggtttcccagccaaagaaccagcatcctggttgtgaaaatggggggtgtgcgtagctacttcttcatcatcgccgccgcggtcgttgccgtcgtcctcgcgcttctcccggccggcgccacaggtgccggccctcaggtcggcttctacagcaagacatgcccgtcggcggagtccctggtgcagcaggcggtggctgcccgccttcaggaacacagcggcatcgccgccggactcatccgcctgcacttccatgactgcttcctcaggggctgcaaacgctcgttgctgatcgactctcacgggaaacaacccggggaaaaagggccccgccccaaaaaaacccgagcctgggggggtttcagaggtccttccaccccccccccaaaaaggggggggggaaaggacacgggggcccccaaaaaagggggctcggggcccaaaaatccttgggggttcccgggccgcggacaaatttccggctggggggggaaaaaaactctgacataaaggcccccccccgggggggccccaaacgggggggggtttcccggggaaaaggaaaccccaaaaaaaaantcccccccttcgcgggtttttaccacgggggggag

SEQ ID NO: 56009 - protein, 156 aa, Zea mays
  misc_feature: Ceres CLONE 1492232
  misc_feature: SWISSPROT Homolog: EC 1.11.1.7 Peroxidase
MGGVRSYFFIIAAAVVAVVLALLPAGATGAGPQVGFYSKTCPSAESLVQQAVAARLQEHSGIAAGLIRLHFHDCFLRGCKRSLLIDSHGKQPGEKGPRPKKTRAWGGFRGPSTPPPKRGGGKDTGAPKKGGSGPKNPWGFPGRGQISGWGGKKTLT

SEQ ID NO: 56010 - DNA, 658 bp, Zea mays
  misc_feature: Ceres CLONE 1492233
  misc_feature: Encodes the peptide sequence at SEQ ID NO. 56011
  misc_feature (448)..(448): n is a, c, t, g, unknown, or other
  misc_feature (527)..(527): n is a, c, t, g, unknown, or other
  misc_feature (543)..(543): n is a, c, t, g, unknown, or other
cgattgggtccgggccccccctcgagccctgcggtggtatagggggagaccctatcgatcagcatacccccgccccgtgcgccatgttcctgcggcggctgagaacgtccgccgccctccgccggggcgcgaccgccggcggagtcctggccgccgtccgcgccgagctggccaacgagctctcctcctcggctccccctccattccgttccgagctggcgcccgacttcgacaccgtgtctgacgccccgcgcgcgcaggacgtgctcctgcgccgccgggccggggccgggtccgagcccgaggaggtcctcgtgtcggcgctgctcgccccgctgcggttcgtgggccgagacccgctgcccagggccgcgctcgtcaaggtcttcgtcagtaagcctggcgcggcgcccgtcctgcacttcgactgccgtgcgtcttgggtggnggaggaaagagcgcgcggcggccctgctgactacgctatcaacgctgtccggtaccactcctctcctggcggcggtgangaagacgagtacgaanggcccggcgttcagagatctggatcctcggctacaggctgctttacgagatgtatctggtagcgagaggcttcaactccaagctggggcagtcgattcttcaacacctcgtcaga

SEQ ID NO: 56011 - protein, 173 aa, Zea mays
  misc_feature: Ceres CLONE 1492233
  misc_feature (122)..(122): Xaa is any aa, unknown, or other
  misc_feature (148)..(148): Xaa is any aa, unknown, or other
  misc_feature (154)..(154): Xaa is any aa, unknown, or other
MFLRRLRTSAALRRGATAGGVLAAVRAELANELSSSAPPPFRSELAPDFDTVSDAPRAQDVLLRRRAGAGSEPEEVLVSALLAPLRFVGRDPLPRAALVKVFVSKPGAAPVLHFDCRASWVXEERARGGPADYAINAVRYHSSPGGGXEDEYEXPGVQRSGSSATGCFTRCIW

SEQ ID NO: 56012 - DNA, 664 bp, Zea mays
  misc_feature: Ceres CLONE 1492234
  misc_feature: Encodes the peptide sequence at SEQ ID NO. 56013
  misc_feature (249)..(249): n is a, c, t, g, unknown, or other
  misc_feature (416)..(416): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (579)..(579): n is a, c, t, g, unknown, or other
  misc_feature (581)..(581): n is a, c, t, g, unknown, or other
cgattgggtaccgggccccccctcgagccactgcagtggtaaaggagggcctcttgatcatcagtcgccagaggagctgttgatcgaggtgagtgaggttgaaaagcaggcggcgaacaaaggcaccatcgtcatggacggcggatactacggcggccgcgatcagcgctacagcggcgggtactacggcggcggtggcatcgcgacgccggggtacgctcccggcggtcccgtacggggatgtcgcangtgaacatcgagggcaacgggtgcgggcgggcgctgccgccgcagccgaccgtgaaggtgtactgccgcgccaaccccccactacgcatgagcgtccgcgacgggaaggtgggtgctgcgccggcaaaccccaaggacgagtaccagcactggatcaaggacatgcngtggagcacgagcatcaaggacgaagaaagttacccgnnncgtcgcgctgtgaacaggcgacgggggagccatcaagcactcgctggggcagtcccaccccgtgcgcctggtgccctacaacccggacttcctggacaaatcggtgctgtggacggaaagccncnacctcggcaacgcttcccgctgcgtccgcatggtcaacacatctacctcaatttcgatgccctcaaggggacaaggggcacgg

SEQ ID NO: 56013 - protein, 141 aa, Zea mays
  misc_feature: Ceres CLONE 1492234
  misc_feature (3)..(3): Xaa is any aa, unknown, or other
  misc_feature (59)..(59): Xaa is any aa, unknown, or other
  misc_feature (72)..(72): Xaa is any aa, unknown, or other
  misc_feature (114)..(114): Xaa is any aa, unknown, or other
MSXVNIEGNGCGRALPPQPTVKVYCRANPPLRMSVRDGKVGAAPANPKDEYQHWIKDMXWSTSIKDEESYPXRRAVNRRRGSHQALAGAVPPRAPGALQPGLPGQIGAVDGKPXPRQRFPLRPHGQHIYLNFDALKGTRGT

SEQ ID NO: 56014 - DNA, 694 bp, Zea mays
  misc_feature: Ceres CLONE 1492235
  misc_feature: Encodes the peptide sequence at SEQ ID NO. 56015
  misc_feature (1)..(1): n is a, c, t, g, unknown, or other
  misc_feature (232)..(232): n is a, c, t, g, unknown, or other
  misc_feature (276)..(276): n is a, c, t, g, unknown, or other
  misc_feature (295)..(295): n is a, c, t, g, unknown, or other
  misc_feature (382)..(382): n is a, c, t, g, unknown, or other
ncgattgggtaccgggccccccctcgagccctgcagtggtaaagttgatatgagggacaagctcacaaccttcattctgaaaaacccaccagaacagaagaagggcggaaaagacaagaaggccatgaggagagctgagaaggaacggctgaaggaaggtgaggctgctgatgaggagcaaaagaaactgaagaaggatgcaaagaagaagggttccaaggattccactgcntagggtttgaagaagaaggctactactgctactggctctgatgnagatcactcatcctctccnactcgcagccatgatggtgacaaagcagctgcagatgatgatgacgatgatgtccagtggcagactgacacttcaattgacgctgcnaagcagcgcatgcaaaagcagctgaatgcacccactgctgaaatggtgatgctgtccactggagaaactgaaaaaaaatgaaaccggcacccccccagaatggaaccctttttggttccccaaaaaaattccttagggaaaagccggcctccccaaacccttcccccttgaaaaacttttttggagaactccggggttccccaggagagtccccccccccccccccgccgggggggggggggggggcttaaaccccttccccccccaaaaagaaaagaaaccccccccgggcgtctccttgtgggggggggg

SEQ ID NO: 56015 - protein, 77 aa, Zea mays
  misc_feature: Ceres CLONE 1492235
RLGTGPPLEPCSGKVDMRDKLTTFILKNPPEQKKGGKDKKAMRRAEKERLKEGEAADEEQKKLKKDAKKKGSKDSTA

SEQ ID NO: 56016 - DNA, 656 bp, Zea mays
  misc_feature: Ceres CLONE 1492237
  misc_feature: Encodes the peptide sequence at SEQ ID NO. 56017
  misc_feature (352)..(352): n is a, c, t, g, unknown, or other
  misc_feature (473)..(473): n is a, c, t, g, unknown, or other
  misc_feature (498)..(498): n is a, c, t, g, unknown, or other
  misc_feature (499)..(499): n is a, c, t, g, unknown, or other
cgattgggtaccgggccccccctcgagccctgcagtggtaaaggagagggagagggggacccgagcccagtcatcacaagcaagcaaacgcgctcgcctcggtttatatacgaacacgtacgtgcgcataaggctggaatttttagttcgctggagctgcagaaccagcaaaacgtcggtttgatctctcgatggtcatgacgcttacgagagacgaagcggaggggagcaaggatatgcagggcgtccgggcgcacgccgaggagctgttcacgctgtcggcggcggcggcgggcaccgacggcacgccgcggccgccgtcctcgggcgccgcagcccgcagggccatggncgccgagggcgtgttcaagtgcaagacgtgcagcaagcgcttcccgtcgttccaggcgctcggcgggcaccgcaccagcaacacgcggctgcaggcgccgacgatgctcaacgacccagcnggcggcccggccgaaaaggacaggnncgcggcccacgagtgccccttctgcggcctcaagtccccatggcccaggccctcgggggacccttgcccccccaagggggaagggccccccccaacccggaaaccggggaacggggaattcccgacctaacctgccccccttgaacaaaaaaaaagc

SEQ ID NO: 56017 - protein, 145 aa, Zea mays
  misc_feature: Ceres CLONE 1492237
  misc_feature (54)..(54): Xaa is any aa, unknown, or other
  misc_feature (103)..(103): Xaa is any aa, unknown, or other
MVMTLTRDEAEGSKDMQGVRAHAEELFTLSAAAAGTDGTPRPPSSGAAARRAMXAEGVFKCKTCSKRFPSFQALGGHRTSNTRLQAPTMLNDPAGGPAEKDRXAAHECPFCGLKSPWPRPSGDPCPPKGEGPPPTRKPGNGEFPT

SEQ ID NO: 56018 - DNA, 736 bp, Zea mays
  misc_feature: Ceres CLONE 1492238
  misc_feature: Encodes the peptide sequence at SEQ ID NO. 56019
  misc_feature (1)..(1): n is a, c, t, g, unknown, or other
  misc_feature (2)..(2): n is a, c, t, g, unknown, or other
  misc_feature (19)..(19): n is a, c, t, g, unknown, or other
  misc_feature (20)..(20): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (499)..(499): n is a, c, t, g, unknown, or other
  misc_feature (507)..(507): n is a, c, t, g, unknown, or other
nntttttttttcccctttnnttnnnnnnnnnnnnnnnttcaaannnnaaacgattgggtccgggccccccctcgagccactgcagtggtaaaggaggcgtcgccaagaaccacagccaccgcgatggcgcagatcatcgatggcaaggccatcgccgccgacgtccgccgcgaggtcgccgccgatgtggccgcgctctcgtcagcccacggactcgtgccggggctggccgtggtcatcgtggggagcaggaaagactcgcagacgtacgtgaacatgaagcgcaaggcgtgcgccgaggtcggcatctgctccatcgacgtcgacctcccgggagacatctccgagaccgcgctcgtcgccgaggttcatcgccctcacgctgaccccgcagtgcacgggatccttgtccagcttccacttccctagcatatcaacgaagagaagatactgagcgagatttccatcgagaaagatgtggatggcttccatcctctcnacattggncagcttgcaatgaaaagcagagagccactgttcgtaccatgtacgccaagggggtgcatgaacctctttgtcaggaagcggattcactgtttaagggtaaacgggcagtttgtggttgttcccaacaacatcggcgggctaccctgtatccctgcttcttctggagggcagatgccacccgtttcttgttgggccctccgcggactcctgattctgaaaagctttgcct

SEQ ID NO: 56019 - protein, 101 aa, Zea mays
  misc_feature: Ceres CLONE 1492238
  misc_feature (3)..(101): Pfam Name: THF_DHG_CYH Pfam Description: Tetrahydrofolate dehydrogenase/cyclohydrolase, catalytic domain
MAQIIDGKAIAADVRREVAADVAALSSAHGLVPGLAVVIVGSRKDSQTYVNMKRKACAEVGICSIDVDLPGDISETALVAEVHRPHADPAVHGILVQLPLP

SEQ ID NO: 56020 - DNA, 669 bp, Zea mays
  misc_feature: Ceres CLONE 1492242
  misc_feature: Encodes the peptide sequence at SEQ ID NO. 56021
  misc_feature (1)..(1): n is a, c, t, g, unknown, or other
  misc_feature (264)..(264): n is a, c, t, g, unknown, or other
  misc_feature (275)..(275): n is a, c, t, g, unknown, or other
  misc_feature (342)..(342): n is a, c, t, g, unknown, or other
  misc_feature (352)..(352): n is a, c, t, g, unknown, or other
  misc_feature (400)..(400): n is a, c, t, g, unknown, or other
  misc_feature (401)..(401): n is a, c, t, g, unknown, or other
  misc_feature (597)..(597): n is a, c, t, g, unknown, or other
ncgattgggtaccgggccccccctcgagccactgcagtggtaaaggggtcgctccccaaatcggatctccaggccggcagaagttgagcggactgactggtcactgtagttcgatcgaatccgagtagggctgatacagttcgattcggcgggaggcatggcgtccgaaaagcacttcaagtacgtcatcctcggcggcggcgtcgcggcggggtacgcggcgcgggagttcgccaagcagggagttaagcctggggagcttgncatcatctccnagggagctgtggctccttacgagcgtcctgccctaagcaaaggttacctctttcctacgaatgctgncagactcccnagattttatgtatgtgtgggaagtggtggagagaagctattgcctganntgtactcagagaaaggcattgagctgatccttagtacagaaattgtcaaagctgatctttccaccagactctgactagtgcagctggagcaaactttacatatgagatcttgctcattgctactggctcctcggtcataaagctcaccgattttggcacacaagagctgatttctacaacattctatatctaaggnaaattgatgatgctgaccagctggttgcacctatcaggcaaagaaaggtggcaaggccatggttgttagaag

SEQ ID NO: 56021 - protein, 105 aa, Zea mays
  misc_feature: Ceres CLONE 1492242
  misc_feature: SWISSPROT Homolog: EC 1.6.5.4 Monodehydroascorbate reductase (NADH)
  misc_feature (36)..(36): Xaa is any aa, unknown, or other
  misc_feature (40)..(40): Xaa is any aa, unknown, or other
  misc_feature (62)..(62): Xaa is any aa, unknown, or other
  misc_feature (81)..(81): Xaa is any aa, unknown, or other
  misc_feature (82)..(82): Xaa is any aa, unknown, or other
MASEKHFKYVILGGGVAAGYAAREFAKQGVKPGELXIISXGAVAPYERPALSKGYLFPTNAXRLPRFYVCVGSGGEKLLPXXYSEKGIELILSTEIVKADLSTRL

SEQ ID NO: 56022 - DNA, 670 bp, Zea mays
  misc_feature: Ceres CLONE 1492246
  misc_feature (394)..(394): n is a, c, t, g, unknown, or other
cgattgggtaccgggccccccctcgagccctgcagtggtaaaggggctccgctgctaggctagggtttggactttggattggagccgcaccgccgcaccggcaccgcagccgccgcagtgccgcacagccaccactcccatcttggtcttgcggctagtcgccctcggacctcggccatcgaccccttgcccgcttgccgagacgccgagtaagcgtcgaccgtcgtcgctgtcgtcaccgaggtccagcgcccacagcccggcttcaagccctcagcatcggcgcccgccctcctcccgcgagacgccgagtgccaagcgccccaagcaccccagtccccagcgcctaacaggctagcaggctgcaggtatgcactcttttgtgatgcgtccnaggagttgagctcaatgcccagcaggctgcaaaaactgagggaaaggcggcattcaggacccggatgagttctattttaaaatgatcaacagtaggactgttggttggatttcatagacctaagcctgaagataataagtatactggaagatgaacttcttctgttgaaaaataaagatatgggattatatctttcgaaccgttcaaagtgaaaaaaaggttactgaattggaaccggggaaaaatccataaagtgctgaaaactaaagtggatcg

SEQ ID NO: 56023 - DNA, 731 bp, Zea mays
  misc_feature: Ceres CLONE 1492247
  misc_feature: Encodes the peptide sequence at SEQ ID NO. 56024
  misc_feature (266)..(266): n is a, c, t, g, unknown, or other
  misc_feature (466)..(466): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (476)..(476): n is a, c, t, g, unknown, or other
  misc_feature (482)..(482): n is a, c, t, g, unknown, or other
  misc_feature (483)..(483): n is a, c, t, g, unknown, or other
aacgggccccccctcgagccactggagtggtaaaggcaacttccctgcggtgctggcacgggcgcggcgacacctcgcccctcgacgtcatcgccatcaaggacaccggcggtgtcaagcaggcgtcccacctgctcaagtacgactccacgctcgggatcggggaggccgacgtcaagcccgtccgggaaaaacaccttctccgtcgaaggcaaggtcttcaaggtcgtgtcccaacacccacccccccaacctggccggggggngaaactcccccatttttctttccccccccagaagggggggcgggggcttgcctttcccacggaattctttttttttgccacccccccaccaaagatacacaccctctatgtgcggcgggccccaccaaaaattttttttttttcccccccccccccccccccctttggggggggggaagaaggggggggggaaaatcttnttttnnnntnttttanntataactacaccctctacccattcctcaattactctcctctcctccctttcccattatacaatacaccccccgttccccttttccattccccccctcctatctcccccttctcccactcgtttgcctttcccccgccctcccccccctctctccttatatcccccctcccatcttcctccccctttctcccccctctctattctcgtttttccatctctattcgttatatattcctctcttaccctcg

SEQ ID NO: 56024 - protein, 159 aa, Zea mays
  misc_feature: Ceres CLONE 1492247
  misc_feature: SWISSPROT Homolog: EC 1.2.1.13 Glyceraldehyde-3-phosphate dehydrogenase (NADP(+)) (phosphorylating)
  misc_feature (155)..(155): Xaa is any aa, unknown, or other
  misc_feature (157)..(157): Xaa is any aa, unknown, or other
  misc_feature (158)..(158): Xaa is any aa, unknown, or other
RAPPRATGVVKATSLRCWHGRGDTSPLDVIAIKDTGGVKQASHLLKYDSTLGIGEADVKPVREKHLLRRRQGLQGRVPTPTPPTWPGGETPPFFFPPPEGGAGACLSHGILFFCHPPTKDTHPLCAAGPTKNFFFFPPPPPPLWGGGRRGGGKSXFXXF

SEQ ID NO: 56025 - DNA, 646 bp, Zea mays
  misc_feature: Ceres CLONE 1492256
  misc_feature: Encodes the peptide sequence at SEQ ID NO. 56026
  misc_feature (550)..(550): n is a, c, t, g, unknown, or other
cgattgggtaccgggccccccctcgagccactgcagtggtaaaggtacagaggcgtcaccctgcacaagtgcggccgctgggaggcgcgcatggggcagttcctcggcaagaagtacatataccttgggctattcgacagcgaagtagaggctgcaagagcctacgacaaggccgccatcaaatgcaatggcagagaggccgtgacgaacttcgagccgagcacgtatcacggggagctgccgactgaagttgctgatgtcgatctgaacctgagcatatctcagccgagcccccaaagagacaagaacagctgcctaggtctgcagctccaccacggaccattcgagggctccgaactgaagaaaaccaagatcgacgatgctccctctgagctaccgggccgccctcgtcagctgtctcctctcgtggctgagcatccgccggcctggcctgcgcagccgcctcaccccttcttcgtcttcacaaaccatgagatgagtgcatcaggagatctccacaggaggcctgcaggggctgttcccagctggncatggcaggtggcagcagcagctcctcctccctgcgccctgccgtcgtccgctgcagcatcatcaggattctccaacaccgccacgacagctgcca

SEQ ID NO: 56026 - protein, 185 aa, Zea mays
  misc_feature: Ceres CLONE 1492256
  misc_feature: The sequence is a functional homolog of SEQ ID NO 467 in the 10/374,780 US patent application
  misc_feature (154)..(154): Xaa is any aa, unknown, or other
MGQFLGKKYIYLGLFDSEVEAARAYDKAAIKCNGREAVTNFEPSTYHGELPTEVADVDLNLSISQPSPQRDKNSCLGLQLHHGPFEGSELKKTKIDDAPSELPGRPRQLSPLVAEHPPAWPAQPPHPFFVFTNHEMSASGDLHRRPAGAVPSWXWQVAAAAPPPCALPSSAAASSGFSNTATTAA

SEQ ID NO: 56027 - DNA, 667 bp, Zea mays
  misc_feature: Ceres CLONE 1492259
  misc_feature: Encodes the peptide sequence at SEQ ID NO. 56028
  misc_feature (1)..(1): n is a, c, t, g, unknown, or other
ncgattgggtaccgggccccccctcgagctattgcattggtaaagggccgttgctggaaaatttatattgataactttttattccgttgctacaggcgtttgattatgttagcgaccatggtcatccgcagtgtaatacctagcgctccaaaagaaacgaggtcctttgggacatacaaccccgcatcaaaaactctttaatacagttgttgcaacaaaagccctagtgcacctctcactgaacaacagccgatcgacaagaaagcccgcgtctccgcgcgcctctcctttgaggagaggcagcgcctcctcctcagcggcgccaacgccctgagctcggccgggggcgacgacgactccgacgtcatcgcgctcaataactacatgaacgcgcagtactttggggagatcggcgtcaggacgccgccgcagaagttcaccgtattcttcgacaccggaagcttcaacctctgggtgccgtcctccaagtgctatttctcgatcgcttgctactaccactcgcgctacatgtctgggcagtcaagtacttataagaagaacggaccacctgctgccattcaatatggaaccggtgccattgctggttttttcagtgaagatagcgttaaattacgtgatctggatgtgaatgatcaggaattgatta

SEQ ID NO: 56028 - protein, 94 aa, Zea mays
  misc_feature: Ceres CLONE 1492259
  misc_feature: SWISSPROT Homolog: EC 3.4.23.40 Phytepsin
MNAQYFGEIGVRTPPQKFTVFFDTGSFNLWVPSSKCYFSIACYYHSRYMSGQSSTYKKNGPPAAIQYGTGAIAGFFSEDSVKLRDLDVNDQELI

SEQ ID NO: 56029 - DNA, 673 bp, Zea mays
  misc_feature: Ceres CLONE 1492265
  misc_feature: Encodes the peptide sequence at SEQ ID NO. 56030
  misc_feature (390)..(390): n is a, c, t, g, unknown, or other
  misc_feature (466)..(466): n is a, c, t, g, unknown, or other
  misc_feature (509)..(509): n is a, c, t, g, unknown, or other
  misc_feature (603)..(603): n is a, c, t, g, unknown, or other
cgattgggtaccgggccccccctcgagccctgcagtggtaaaggagagtccagtccccagacgagcggttggagcttcgacgtgcggtttccatttcctgccctgctctgatggccgtcgccgaagtggcgatcgagattctcccgcagcagcagcagcagcagccgccgccgccgccgcgggaaccggcggtagtgcctccgaacctctccgtgccgagagtgctccagtatctgtacctcttgagcgcgtgggtcgcctgcgcgggcgtggctgccgggaccgtggcgcgccgggccttgggcgactcttccccgttggtctacgggttcctcaaagtctcgatcggagccctcgtttttcccgcgctgctcatcctcgtcttcgccntgcgggtcttgcgcgccatgctttgcgtggggttcagacggtcactccgcactcacgccagggagattcagatccnagccacgaagatatttagagcgttaacgtggaaggtgctgcangaccctatttgtgctgcgtgcctcgcatctttgcttttcatcctgcttcttgcaacaagtgttctgggtgtttgtgggacttctaccaatggangagtctcgcagagaaaggattggtttatgcgctctctgatgtggggggtatggggtgccatggcaatgtt

SEQ ID NO: 56030 - protein, 187 aa, Zea mays
  misc_feature: Ceres CLONE 1492265
  misc_feature (94)..(94): Xaa is any aa, unknown, or other
  misc_feature (119)..(119): Xaa is any aa, unknown, or other
  misc_feature (133)..(133): Xaa is any aa, unknown, or other
  misc_feature (165)..(165): Xaa is any aa, unknown, or other
MAVAEVAIEILPQQQQQQPPPPPREPAVVPPNLSVPRVLQYLYLLSAWVACAGVAAGTVARRALGDSSPLVYGFLKVSIGALVFPALLILVFAXRVLRAMLCVGFRRSLRTHAREIQIXATKIFRALTWKVLXDPICAACLASLLFILLLATSVLGVCGTSTNGXVSQRKDWFMRSLMWGVWGAMAM

SEQ ID NO: 56031 - DNA, 660 bp, Zea mays
  misc_feature: Ceres CLONE 1492276
  misc_feature: Encodes the peptide sequence at SEQ ID NO. 56032
  misc_feature (489)..(489): n is a, c, t, g, unknown, or other
  misc_feature (490)..(490): n is a, c, t, g, unknown, or other
  misc_feature (506)..(506): n is a, c, t, g, unknown, or other
  misc_feature (577)..(577): n is a, c, t, g, unknown, or other
  misc_feature (621)..(621): n is a, c, t, g, unknown, or other
  misc_feature (633)..(633): n is a, c, t, g, unknown, or other
  misc_feature (656)..(656): n is a, c, t, g, unknown, or other
cgattgggtaccgggccccccctcgagccctgcagtggtaaagggttcttcttttaacgcaagaaagaaagaaagaaaaggggcaggaagaaatcgagcctcactcgatccatcgtctcgccgcagcgcacacgaggccggcggcgccatgaccatgaagctggacatgtctgcgctcgagaccaacttcgccaacctgaccgcctccgccggcgacgacacgtacttctccgccgaggcccccgacgtgccgtccatggtgctccccatctgcgacgacttcgacggcttccaggcggccaccaaggatatggtgaagaataagaaggggacgaccacgcttgccttcatcttcgacaagggcgtcatcgtcgccgctgattccagggccagcatgggcggttatatatcctcaccaaccgtgaggaaaattattgaaataatccttacatgctggggacaatggctgggagtgctgctgattgccannttttgcatagacctangaaaccagtgtcgtctccatgagctttcaaacaagcgaaggatctctattgctggtgcttccaaactggtnggctacatcctttatcatatcgtgggatgggactgtcgattggntacatgatcgcntggatggaatgaaagggtcttgncttg

SEQ ID NO: 56032 - protein, 157 aa, Zea mays
  misc_feature: Ceres CLONE 1492276
  misc_feature: SWISSPROT Homolog: EC 3.4.25.1 Proteasome endopeptidase complex
  misc_feature (112)..(112): Xaa is any aa, unknown, or other
  misc_feature (118)..(118): Xaa is any aa, unknown, or other
  misc_feature (156)..(156): Xaa is any aa, unknown, or other
MKLDMSALETNFANLTASAGDDTYFSAEAPDVPSMVLPICDDFDGFQAATKDMVKNKKGTTTLAFIFDKGVIVAADSRASMGGYISSPTVRKIIEIILTCWGQWLGVLLIAXFCIDLXNQCRLHELSNKRRISIAGASKLVGYILYHIVGWDCRLXT

SEQ ID NO: 56033 - DNA, 662 bp, Zea mays
  misc_feature: Ceres CLONE 1492279
  misc_feature: Encodes the peptide sequence at SEQ ID NO. 56034
  misc_feature (219)..(219): n is a, c, t, g, unknown, or other
  misc_feature (254)..(254): n is a, c, t, g, unknown, or other
  misc_feature (271)..(271): n is a, c, t, g, unknown, or other
  misc_feature (283)..(283): n is a, c, t, g, unknown, or other
  misc_feature (284)..(284): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (364)..(364): n is a, c, t, g, unknown, or other
  misc_feature (377)..(377): n is a, c, t, g, unknown, or other
  misc_feature (507)..(507): n is a, c, t, g, unknown, or other
  misc_feature (662)..(662): n is a, c, t, g, unknown, or other
ccgattgggtaccgggccccccctcgagccactgcagtggtaaagggtactagactgcgccgccgttgccgtctcctcctccgtcccatcactctctgctcgcgcactctcacctgcccgcgccgtcttcgaccgccaccaagatgaacaaggagaggctcatgaagatggccggcgccgtccgcaccggcggcaagggcaccatgcgcaggaagaagnggctgtacacaagacggtcaccacggacgacaagnagctgcagggcactctncagagagtaggnngtcacaccatccctgcannntcgagagtgaacatatttcaggacgatctcgtcatccagttcttgaaccccaaagtgcangcttccatcccancaaacacatgggtggtcagtggatctccacagacgaaaaagctacaggatgttctccctgggatcattaaccagcttggccctgacaacatggagcacctgaagaggattgccaaggaaatgcaaaaacnggtggctgctgccggtgccgcaccacaggtcaaggaaaaacacgatgaccattgtccagaagcttgttcctggagaaaacttttgaaaaatacctcaggaaacaaaagcctgatcatagcctctaaatagtgaaatgttactgccccaatgctgn

SEQ ID NO: 56034 - protein, 56 aa, Zea mays
  misc_feature: Ceres CLONE 1492279
  misc_feature (14)..(14): Xaa is any aa, unknown, or other
MEHLKRIAKEMQKXVAAAGAAPQVKEKHDDHCPEACSWRKLLKNTSGNKSLIIASK

SEQ ID NO: 56035 - DNA, 660 bp, Zea mays
  misc_feature: Ceres CLONE 1492281
  misc_feature: Encodes the peptide sequence at SEQ ID NO. 56036
  misc_feature (1)..(1): n is a, c, t, g, unknown, or other
  misc_feature (297)..(297): n is a, c, t, g, unknown, or other
  misc_feature (461)..(461): n is a, c, t, g, unknown, or other
  misc_feature (660)..(660): n is a, c, t, g, unknown, or other
ncgattgggtaccgggccccccctcgagccctgcagtggtaaaggtcaaatccacgcgaccgcgattgctctcagaaggcactagcacgcaaaaaccccacgagagagacgaatcttccgaatctctcggtggcgatggcgctctccgaccgctcccgcgagtcgctcctcccgagcttcctctacgcctcctcggcgcgctctttcgctgccacaggagccgccgcgcgcctccctgtctcctccccagcgcctgccacggctggagcaggaggcggcgtgccgttctcgatccangcgcccaagagaagatcgagatgtactcgccggccttctatgccgcctgcactgccggaagaatcgccagctgcgggctcacccccatggccgtcacgcctctcgacctccgtcagtgcattatgcagattgacccagcgaaatacaagagtatctcatctggnatttgtatcctgttaaaggagcaggggccaggggtttcttccggggagggtgcctacttttcttggttacagtgctcagggggcttgcagtttggcttctatgattcctttaaaagtattcctcggactttggcgggcctgattatgccccaaagtccaaaatctaatctaccccccaggatctgcctcctggtgaggn

SEQ ID NO: 56036 - protein, 114 aa, Zea mays
  misc_feature: Ceres CLONE 1492281
MYSPAFYAACTAGRIASCGLTPMAVTPLDLRQCIMQIDPAKYKSISSGICILLKEQGPGVSSGEGAYFSWLQCSGGLQFGFYDSFKSIPRTLAGLIMPQSPKSNLPPRICLLVR

SEQ ID NO: 56037 - DNA, 671 bp, Zea mays
  misc_feature: Ceres CLONE 1492282
  misc_feature: Translation starting site: 167
  misc_feature (305)..(305): n is a, c, t, g, unknown, or other
  misc_feature (444)..(444): n is a, c, t, g, unknown, or other
cgattgggtccgggccccccctcgagccactgcagtggtaaaggggtgttgatcgctcagcacaaagcgtcgtacttggataggagaaaacaattctagacagtcgacagagagagagaaaaaaaaaatagagaactgagagatcgaggacaaagggggagaggagatgtctcggggcggtagccacggggagctgggccagaggatcgattacgtcttcaaggtggtgctcatcggtgactccgctgtgggcaagtcgcagctgctcgcgcgcttcgcccgcaaccagttcaacctcgactccnaggcaccatcggagtcgagttccagacccgcacccctcacatcgacgcccgcacgtcaaggcacagatctgggacaccgcaggccagaaaggtaccgagcagtaacagtggctactacggggggcagtgggactatgtnattatttgacataaccaagcgccgtcccttgatcatgggctagggggcttgagaacctcgggccctgctgaaaaaactttgtttctggcttaggggaaaaaatttgtattggggcccttttgggccccccatttgaagaaacaaagggtttttctaacccaaaaaccctttttttgggaaacccccgcccttgggggtttccccgttaaaacccttttttgtggtgt

SEQ ID NO: 56038 - DNA, 688 bp, Zea mays
  misc_feature: Ceres CLONE 1492284
  misc_feature: Translation starting site: 138
  misc_feature (1)..(1): n is a, c, t, g, unknown, or other
  misc_feature (102)..(102): n is a, c, t, g, unknown, or other
  misc_feature (222)..(222): n is a, c, t, g, unknown, or other
  misc_feature (269)..(269): n is a, c, t, g, unknown, or other
  misc_feature (270)..(270): n is a, c, t, g, unknown, or other
ncgattgggtaccgggccccccctcgagccctgcagtggtaaaggcgggaagcgcgtgcgccccgcgctgtgcctggccgcgtgcgccgtggtgggcggccnggatccctgggcatgccggcccgcgcggcgtcgagatgtgcacacatgtcgctcgtcacgacaacctccctgcatggagacgacgacctcccgcgcgcaggcccactgcacgtcgtctanggcgagccatcgccgtcctcgcgggacgcgctgctctcgctctcttnncaacacatggcagcgtcgggtcctaccctccggacgtggacccggagaagcaccccgcccgcgtcgtccgagccatggggaagctcgcgcgctgcatcgggatcggagggactccttcccgggcaagtttgtcaatcccaaaatgacgggcacatcaggagacggtgccccttcgaaacgcctcgaggtacatcccccttccaaaaaaaccgccgcattggttcgaagccctcggttggtgattgggggccaatcatcgaagggcggcccggaacaaccaaatcaaaagggttgccgaaattaccccgagggtctaatcgggcttgctgtttccaggggggccaaaaaaatttcttccatggtcccccagttcttcaaaaggaactctcgaaaaaacggcggggaaaaggaccttgca

SEQ ID NO: 56039 - DNA, 701 bp, Zea mays
  misc_feature: Ceres CLONE 1492285
  misc_feature: Encodes the peptide sequence at SEQ ID NO. 56040
  misc_feature (254)..(254): n is a, c, t, g, unknown, or other
  misc_feature (288)..(288): n is a, c, t, g, unknown, or other
  misc_feature (289)..(289): n is a, c, t, g, unknown, or other
  misc_feature (358)..(358): n is a, c, t, g, unknown, or other
cgattgggtaccgggccccccctcgagccactgcagtggtaaagggcttgctagtctttggtgttgtaggtgttcgattcctgattccaaattccagactccaaactcggttcttcaatcgacagattccgatttacatcccaaagctcttcggattgaaatccagccgcgacccaagagataagagtatttgggattagtagataggatagtagaatagaagaggaacactttcgctgatgattacgggcgangagaagaagccccgaaagggaggggagaggaganngcaaccccgcgcgcggaggcttttctggagatcatctgccgcgtcccggcgggggaggtggaagcggcnctgtccgcttgcggcatcggccccacgggcgagtcgaggaactgttgctcaagtcccgcacatgctacaagccccctaagtccgccgttcgcttcttccggtggggggggcagcccgtgtcccacaccgcctacgcatgggaacttccttggtcaattcctccggcaaagccccccttggttccaacccctgggggtgcccccctccccccccccagaaaacaggggagggcggggggcggggttttgtctcctgcccccccccttttcgcctccgggtttttcccccctccaaagggggggcgggtggggggaaactttcaaaaaaaagcgccgctccccgg

SEQ ID NO: 56040 - protein, 69 aa, Zea mays
  misc_feature: Ceres CLONE 1492285
MGTSLVNSSGKAPLGSNPWGCPPPPPQKTGEGGGRGFVSCPPPFRLRVFPPSKGGAGGGKLSKKSAAPR

SEQ ID NO: 56041 - DNA, 673 bp, Zea mays
  misc_feature: Ceres CLONE 1492288
  misc_feature: Encodes the peptide sequence at SEQ ID NO. 56042
cgattgggtaccgggccccccctcgagccactgcagtggtaaagggtcgcgccgccgctcctctcacaacccagtcgctcaaaaccctagagctctcgcctgctcgcctccgccgccggagcgagctccccatcttcatccgtcaaccatggcgacccagatcagcaagaagaagaagttcgtcagcgacggtgttttctacgccgagctcaatgagatgctgacgcgggagctggcggaggatggctactctggcgtggaggtgcgcgtcacgccgatgcgcacggagatcatcatccgcgccacgcgcacgcagaacgtgctcggcgagaagggccgcaggatcagggagcttacctccgtcgtccagaagaagttcaacttcccctgagaatggcgtcgagctttacgccgagaaggtcgtcaaccgtgggctctgtgccatcgcgcaggccgagtcccctccgttacaagctcctcggaggcctttgccgtccgcagggcttgctatggtgttctccgttatgttaaggaaagtggtgccaagggttgtgaggtgattgtgagtggaaagtttagggccccaaagccaagtccatgaagttcaggatgggtacttgatctcatcgggccgcccgtgaacgaataccttggctcggctgtgaaaccactt

SEQ ID NO: 56042 - protein, 80 aa, Zea mays
  misc_feature: Ceres CLONE 1492288
MATQISKKKKFVSDGVFYAELNEMLTRELAEDGYSGVEVRVTPMRTEIIIRATRTQNVLGEKGRRIRELTSVVQKKFNFP

SEQ ID NO: 56043 - DNA, 664 bp, Zea mays
  misc_feature: Ceres CLONE 1493653
  misc_feature: Translation starting site: 52
cgattgggtaccgggccccccctcgagccactgcagtggtaaaggtcattgatgtcccagatctcagagatggacagcgaggaggtcggagggagcagcccagaggctgccggcggaggcagggggtacatccctgggtacccaatgggttctggttctgggtgggaggactcatcggcgctcatgtcagacaatttgtctggcctgaaacgcccccgggactcgtcggagcctggccaggtgcgcgcgggggttactctattaccacttcccatttcttgtaatacatctacgtggcgaactgacggtgcagtcagtgcagagccgcatcacgcaccagttcagcctgcccaagacgtcgtctgagatggcaagtattgataaattcctccagttccaggacgcggtgccttgtaagatccgtgccaagcggggatgcgccacccatccgcgcagcatcgccgagagggtgaggagaacaaagatcagtgagcgaatccgaaagctgcaagaactcgttccgaacatggacaaggtactcgcctttctgcagccacggcaacaccgataggcagtagctaggacattgtgtgtgtgtggttagcaaattttctgtgtgaggaccactccatcatgcacttgtctgcaacctgcgcttccattt

SEQ ID NO: 56044 - DNA, 628 bp, Zea mays
  misc_feature: Ceres CLONE 1493660
  misc_feature: Encodes the peptide sequence at SEQ ID NO. 56045
  misc_feature (562)..(562): n is a, c, t, g, unknown, or other
cgattgggtccgggccccccctcgagccactgcagtggtaaaggaggcctgtgtacactcgtactcgtctcttcttcgccacacacacacacggctgctagtgtacacagaggcacagcagcaggaggatggccgtagtgccggcggcgccggtggttcttggagtggccatggtgctcgtcgtcctggccgccagcgccggcgcggccgggcagctcaggatggggttctacgccgagagctgcccgggcgtggagcgcgtggtgggcgacttcgtccggcagcacgtccgccgcgtgcccaccgtcgccgccgcgttgctccggctgcacttccacgactgcttcgtcaggggctgcgacgcctccgtcctgctcaactccaccgccggcagcgtggccgagaaggacgcgccgccgaacctgacgctgcgcggcttcgacctcgtcgaccgcgtcaaggcgctcgtcgaggatgcatgctctcgcgtcgtctcctgcgacgacgtcctcgcgctcgccgaccgggacgcggtcgtcgtcatctgcgggcattcgtggcncatggcgacggggaggacgcacggtcacgtgtccgacatgcatgatgcgctcgacgacatccctag

SEQ ID NO: 56045 - protein, 166 aa, Zea mays
  misc_feature: Ceres CLONE 1493660
  misc_feature (46)..(166): Pfam Name: peroxidase Pfam Description: Peroxidase
  misc_feature: SWISSPROT Homolog: EC 1.11.1.7 Peroxidase
  misc_feature (145)..(145): Xaa is any aa, unknown, or other
MAVVPAAPVVLGVAMVLVVLAASAGAAGQLRMGFYAESCPGVERVVGDFVRQHVRRVPTVAAALLRLHFHDCFVRGCDASVLLNSTAGSVAEKDAPPNLTLRGFDLVDRVKALVEDACSRVVSCDDVLALADRDAVVVICGHSWXMATGRTHGHVSDMHDALDDIP

SEQ ID NO: 56046 - DNA, 708 bp, Zea mays
  misc_feature: Ceres CLONE 1493663
  misc_feature: Encodes the peptide sequence at SEQ ID NO. 56047
  misc_feature (252)..(252): n is a, c, t, g, unknown, or other
  misc_feature (338)..(338): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
cgattgggtaccgggccccccctcgagccctgcagtggtaaaggtcagtgcctctcgatcgctcatcagtcgccagaggagtagttgatcgaggtgagtgaggttgaaaagcaggcggcgaacaaaggcaccatcgtcatggacggcggatactacggcggccgcgatcagcgctacagcggcgggtactacggcggcggtggcatcgcgacgccggggtacgctccggcggtcccgtacgggatgtcgcangtgaacatcgagggcaacgggtgcgggcgggcgctgcccgcgcagccgaccgtgaaggtgtactggcgcgccaacccccactacgncatgagcgtcgcaacgggaaggtggtgctggccccggccaaacccaaggacaagtaccagccctggatcaaggacatgcggtggaccccagcttcaggaccaagaaggttccccggggttcccctgggaaaaaagggaccggggaaggccttaaaacctccggggggggaaccccccccgggggccgggggccccaccctttttgaaatggtggagaacaacacaaaaaaatttctccctaaaaaaaaccctcctccccccccaaagggggggggcgcccccctttcttcggggggggggcaacaaaccccccccccccaaaaaaaacccccccccctcttatcaaaaaaaaaaannnngggcggnnnna

SEQ ID NO: 56047 - protein, 117 aa, Zea mays
  misc_feature: Ceres CLONE 1493663
  misc_feature (38)..(38): Xaa is any aa, unknown, or other
  misc_feature (67)..(67): Xaa is any aa, unknown, or other
MDGGYYGGRDQRYSGGYYGGGGIATPGYAPAVPYGMSXVNIEGNGCGRALPAQPTVKVYWRANPHYXMSVATGRWCWPRPNPRTSTSPGSRTCGGPQLQDQEGSPGFPWEKRDRGRP

SEQ ID NO: 56048 - DNA, 669 bp, Zea mays
  misc_feature: Ceres CLONE 1493666
  misc_feature: Encodes the peptide sequence at SEQ ID NO. 56049
  misc_feature (426)..(426): n is a, c, t, g, unknown, or other
  misc_feature (669)..(669): n is a, c, t, g, unknown, or other
cgattgggtaccgggccccccctcgagccctgcagtggtaaagggtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcgacgaggcccattcccgcggcggccgtggaggcggcggcngtgggtacggtggtggccgtggaggcggcggctactgcggtggcgggcgccctgatggcggcggcggctaccgcggtggcggcggcggctacggtggccggcggcggctacggtgggggggggccgcggcttccggcggtggccaccctgggcggcgggttccggcaaactccaacggggaattggaggaaaccggacccgggggggtcccccccggcccaaattttatcctggtctctcacn

SEQ ID NO: 56049 - protein, 175 aa, Zea mays
  misc_feature: Ceres CLONE 1493666
  misc_feature (10)..(81): Pfam Name: RRM_1 Pfam Description: RNA recognition motif. (a.k.a. RRM, RBD, or RNP domain)
  misc_feature (48)..(147): Pfam Name: GRP Pfam Description: Glycine rich protein family
  misc_feature: SWISSPROT Homolog: EC 5.2.1.8 Peptidylprolyl isomerase
  misc_feature (95)..(95): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVDEAHSRGGRGGGGXGYGGGRGGGGYCGGGRPDGGGGYRGGGGGYGGRRRLRWGGAAASGGGHPGRRVPANSNGELEETGPGGVPPGPNFILVSH

SEQ ID NO: 56050 - DNA, 639 bp, Zea mays
  misc_feature: Ceres CLONE 1493667
  misc_feature: Encodes the peptide sequence at SEQ ID NO. 56051
cgattgggaccgggccccccctcgagccactgcagtggtaaaggctcttcttcaacacgaagaaagaagggcgtggcacggtgcgttgcttctaacgggggcagcaagacggctgcagcggcaccgtcgcgcctcgccatgccccctagcttccagagtagcgtcgccagcctgtctggctccgacgtgtcaaagatgtacagaggaggcttggatcagcaccttctggcgccgcacttctacacccccctgccacccatcatggacgacggcgaccacggtaggccccccagccgcatctcctcctccttcactgggcagcaagcgacggctactgcgatctactcatgaatgaaccgacgatgacgaggggatggatactcacaccaacggccttctccccgatggctggttcactgtaagcaaatcattcttgggctggtccgcatagggggggaaccccatgcacatcgtctacttacccggggggggccgtaccccccggtccctgaaacaggtattggggtaacgggggccttcctggggtgggtgaaagaaagttacgggccctcccccccctttggattggggttaaaaaaaattcttaagccaaatcggatggattttggactgtgggtg

SEQ ID NO: 56051 - protein, 116 aa, Zea mays
  misc_feature: Ceres CLONE 1493667
RLGPGPPSSHCSGKGSSSTRRKKGVARCVASNGGSKTAAAAPSRLAMPPSFQSSVASLSGSDVSKMYRGGLDQHLLAPHFYTPLPPIMDDGDHGRPPSRISSSFTGQQATATAIYS

SEQ ID NO: 56052 - DNA, 666 bp, Zea mays
  misc_feature: Ceres CLONE 1493668
  misc_feature: SWISSPROT Homolog: EC 1.11.1.6 Catalase
cgattgggtaccgggccccccctcgagccactgcagtggtaaaggtactactttaccactgcagtggctcgagccactgcagtggtaaaggggttggctcgatggttggcatattcagccccatcgataaagatactgtttagcattgcgcaagaggagccatcgtttataccatgcactaaattctggtagttttgtagttggaccttctatctacttggattaacaaaaggtggttttaagctggtgtcaaaaaaaaaaaaaaaaaaccagagctctgggaattcctgcagcccgggggatccactagttctagagcggccgccaccgcggtggagctccagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcga

SEQ ID NO: 56053 - DNA, 672 bp, Zea mays
  misc_feature: Ceres CLONE 1493676
  misc_feature: Encodes the peptide sequence at SEQ ID NO. 56054
cgattgggtaccgggccccccctcgagccctgcagtggtaaagggtcttttctcctcttcgtgcatccggttgcgcgtgcctttcccgacctactcttgcggttctcgccagcgagtcaagggtttctgtcccggggtgcttatcctcccccgtcggacatgtctgagcttggacggaaggccaagccgatgaaggtgccgaaggccgacaacaaggagtatcaccagactgatcttgcttatctgcgaaagacgaatgatgaggaaaaaccactcaacgatcttaacgccaaggcacataacgtcccgattggtgcctctggtctgaagaacagtggaaagaaatgagactggtctctcgtctccaatacctatatgatgataaagcagctgtctatctgtgttgcgcttcactaagtgcgattgtcacagagacacctcgtgtgatctgtgttccgcgatcttgcacatggtagcttgatccaaagatgtatcgacctcccatctgctagctatgatagagatggtcccctagatataatgctgacatgttctgagaaaaaaatataaagaatggcttgagctcttggaattcatgagggccggggggatccactaaattcatgagtctcccgccaccgtcgaagaagctccatcttttcgtgcctgttg

SEQ ID NO: 56054 - protein, 62 aa, Zea mays
  misc_feature: Ceres CLONE 1493676
  misc_feature (1)..(62): Pfam Name: TMA7 Pfam Description: Translation machinery associated TMA7
MSELGRKAKPMKVPKADNKEYHQTDLAYLRKTNDEEKPLNDLNAKAHNVPIGASGLKNSGKK

SEQ ID NO: 56055 - DNA, 784 bp, Zea mays
  misc_feature: Ceres CLONE 1493682
  misc_feature: Encodes the peptide sequence at SEQ ID NO. 56056
  misc_feature (54)..(54): n is a, c, t, g, unknown, or other
cgggttgtagtggggcgacttcctctaccccgcgaatgtgttttatcatcattnacccgaatgggtacgggccccccctcgagccctgcagtggtaaagggcgccctgtgctccccctcagtcaaaacgctagtcttctttccctaaagctcggagaccgccggaagcgagcgatggcgtgcaagacgaagagcctgctgttggcgctctgcgtggcggcgctgctcgcggcgcgctcagagtcccaccgcctaggcgacttcccgagcggaggcgaagcgacgacgacacccgagatgcataccttcttcaagccccaggccgcggcggcgctcccggaggccctcgacgcctccctgccagccaagccggacgcggcggcggccacggtgctcccggccacgacggccgccgcgacacttgccggtacggcgccgtccgacaccccgcgtaagcccctattcctaggccgacgggccgggacttgcgcgcatgggcggaacgcggtacgggggtccagccgcagaagccccaacatggccttatactccgtagcgcgccccggatagcgccccgtaaatgacgcggcaaggttcggattactacccccagggagccccccttcaggcgcccctcgggaatagggcccttacccccctccttttgggaaccctggctacaagggcgcgtctcttctaacctcttccccaaatttttgcggttttcccccccaaatatttcccccctcgttcccccccctttagatgcacgccggtcactcccc

SEQ ID NO: 56056 - protein, 131 aa, Zea mays
  misc_feature: Ceres CLONE 1493682
MACKTKSLLLALCVAALLAARSESHRLGDFPSGGEATTTPEMHTFFKPQAAAALPEALDASLPAKPDAAAATVLPATTAAATLAGTAPSDTPRKPLFLGRRAGTCAHGRNAVRGSSRRSPNMALYSVARPG

SEQ ID NO: 56057 - DNA, 667 bp, Zea mays
  misc_feature: Ceres CLONE 1493683
  misc_feature: Encodes the peptide sequence at SEQ ID NO. 56058
  misc_feature (641)..(641): n is a, c, t, g, unknown, or other
cgattgggtaccgggccccccctcgagccctgcagtggtaaaggggcttatatccacacctgagtcccctccgccgcctgccgcactctcccgcgacgccaccaccacacgttcacggtagcgagagcttatcgtcgtcggcggcgaagatggtgtcgctgaagctgcagaagcggctcgccgcgagcgtcctcaagtgtgggaaaggcaaagtctggcttgaccccaatgaagtcagcgagatctccatggctaactcccgccagaacatccggaagttggttaaggatgggtttatcatcaggaagcctcagaaggttcactctaggtcccgtgcaagaagggcacatgaggccaagcagaagggaaggcactctggatatggcaagcgcaggggtaccagggaggctaggctccccaccaagattctgtggatgaggaggatgcgtgttctgaggcgcctgctctgcaagtaccgtgaggccaagaagatcgacaagcacatgtatcatgacatgtacatgaaggtcaagggtaatatgtttaagaacaagagggtgcttatggagagtatccacaagtccaaggctgagaaggccagagagaagacactttctgatcagtttgaggccaagcgtgcnaagagcaaggcaagcgtgagaggaag

SEQ ID NO: 56058 - protein, 172 aa, Zea mays
  misc_feature: Ceres CLONE 1493683
  misc_feature (2)..(149): Pfam Name: Ribosomal_L19e Pfam Description: Ribosomal protein L19e
MVSLKLQKRLAASVLKCGKGKVWLDPNEVSEISMANSRQNIRKLVKDGFIIRKPQKVHSRSRARRAHEAKQKGRHSGYGKRRGTREARLPTKILWMRRMRVLRRLLCKYREAKKIDKHMYHDMYMKVKGNMFKNKRVLMESIHKSKAEKAREKTLSDQFEAKRAKSKASVRG

SEQ ID NO: 56059 - DNA, 747 bp, Zea mays
  misc_feature: Ceres CLONE 1493684
  misc_feature: Encodes the peptide sequence at SEQ ID NO. 56060
  misc_feature (21)..(21): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (47)..(47): n is a, c, t, g, unknown, or other
  misc_feature (48)..(48): n is a, c, t, g, unknown, or other
tccgttttttttcggctgctnctataccctctaaattnnnaaaaaannaaaaaacgattgcgtacgggccccccctcgagccactgcagtggtaaagggcgccctgtgctccccctcagtcacaaacgctagtcttctttccctaaagctcggagaccgccggaagcgagcgatggcgtgcaagacgaagagcctgctgttggcgctctgcgtggcggcgctgctcgcggcgcgctcggagtcccacggcctaggcgacttcacgagcggcggcgaggcgacgacgacgccggagatgctgaccttcttcaagccccaggccgcggcggcgctcccggaggccctcgacgcctccatgccagccaagccggaggcggcggcggccacggcgctcccggccacgacggccgcagcgacaacggacggtacggcgccgacagccacgccgcgcaggtccgtgtccgtggccgcccgcatggcctgccgcatggaggacgtggcccgtcccccgccccctatgcctccgctgacgtacctccgtgctcgccaagcgcgcccgggaaccggaagtttcatttccgggctccctccccccggtgaaggccccattccggggccccgttgttgaaaagggcccaatcctcccgttgcttacaaggtccctgcggtttaaagaccgccgcccgccatataaatcccctccccgccagacccactccttaggctcttccaaggccgccccccccc

SEQ ID NO: 56060 - protein, 151 aa, Zea mays
  misc_feature: Ceres CLONE 1493684
MACKTKSLLLALCVAALLAARSESHGLGDFTSGGEATTTPEMLTFFKPQAAAALPEALDASMPAKPEAAAATALPATTAAATTDGTAPTATPRRSVSVAARMACRMEDVARPPPPMPPLTYLRARQARPGTGSFISGLPPPGEGPIPGPRC

SEQ ID NO: 56061 - DNA, 678 bp, Zea mays
  misc_feature: Ceres CLONE 1493697
  misc_feature: Encodes the peptide sequence at SEQ ID NO. 56062
  misc_feature (395)..(395): n is a, c, t, g, unknown, or other
  misc_feature (398)..(398): n is a, c, t, g, unknown, or other
cgattgggtaccgggccccccctcgagccctgcagtggtaaaggacgtgggggaggaggaggtcgagagcaagctcaaggagggtgatgtgctcggctgcttggacgcgctcgaggactccttgccgatcaagaagggcctctcgagcttctactccggcaagtctaagtcgttcaccagcctcgccgaggccacagcggcggcggcggcggtcaaggaggtgctggccaagccggagaagcccttcaacaagcgccgccgcatcctggccaactggtccaggagagcctcctgcagctcgctggccacggccacctacctgcctcagctcttgggccccgaccacgccgtggccgaaggggaccacggcgaggaggacgacgccgacgacgacntgnagtacatccaggtgccgcaccacggcaaaacgtcagggacccgccgacatcgccactgccgctccctagactcggggggggtggccgcatgcaaaggaagaaccgcctttgggagcttccaatctcctaggtccttctcgctggttgatctcccgcaaagcagcggttgaagggaggggattcaccggccacagaatttggcctggcacctcctggccttcccccgggcgctataacccgaaaaaggctattaccccttcctgcctttgcgggtattccg

SEQ ID NO: 56062 - protein, 188 aa, Zea mays
  misc_feature: Ceres CLONE 1493697
  misc_feature (132)..(132): Xaa is any aa, unknown, or other
  misc_feature (133)..(133): Xaa is any aa, unknown, or other
DWVPGPPSSPAVVKDVGEEEVESKLKEGDVLGCLDALEDSLPIKKGLSSFYSGKSKSFTSLAEATAAAAAVKEVLAKPEKPFNKRRRILANWSRRASCSSLATATYLPQLLGPDHAVAEGDHGEEDDADDDXXYIQVPHHGKTSGTRRHRHCRSLDSGGVAACKGRTAFGSFQSPRSFSLVDLPQSSG

SEQ ID NO: 56063 - DNA, 666 bp, Zea mays
  misc_feature: Ceres CLONE 1493699
  misc_feature: Encodes the peptide sequence at SEQ ID NO. 56064
cgattgggtccgggcccccctcgagccactgcagtggtaaaggccgctggggcgggcgggcggtggagggcgagtgaagacgaggtgcttgcctcgctcggctcacaccccttttcgtctcttctctgcctttcctccgcaatcacagagcgcaagaggagagagagagagtgagaggggagagagagggctagggttttgtgccccccacgcctcacgcatcgaatccgagccgggtcggggttgctgcgaatcgccggcggtgcttgatgattcaggcctgtgtggtaggtgccgtgcttgctcgtcctaggcgattttagggtggtcgtccttgtcgctgtgagctggttgggggctgtgtggatttggttttctggacgcgggaattcaaaggctgtgattccattgcaatggcatctgaaactgatgagaaagctaagatggagagtttgacatctgctgcagcctttgtggagggtggcattcaggatgcatgcaacatttgccttgaggccttctgtgagagtgacccttctgcagatcaaccaaaatggatggatcaacacatgagtcaccaaaatccaccacccaacccaatcggtatccaatcaaatactgtagacttagatgctgaagactctgttccatcaagctttacttcga

SEQ ID NO: 56064 - protein, 84 aa, Zea mays
  misc_feature: Ceres CLONE 1493699
MASETDEKAKMESLTSAAAFVEGGIQDACNICLEAFCESDPSADQPKWMDQHMSHQNPPPNPIGIQSNTVDLDAEDSVPSSFTS

SEQ ID NO: 56065 - DNA, 629 bp, Zea mays
  misc_feature: Ceres CLONE 1493705
  misc_feature: Encodes the peptide sequence at SEQ ID NO. 56066
atagctggagctccccgcggtggcggccgctctagaactagtggatcccccgggctgcaggaattcgcacgagaccattacctagaacatcctaatcgaaaaaagtcgagcaacaggccaaacccccagccgccggaagccgctaccgctagcacctccgatcgagtcggcgccatggaagacgtcatcaccgacgtgccgccgccttcccgcttttcccctgacgacctcgacaacttcgccgctccgccagcgcagcccacccccatcttcgtcgtttccccgaaccctagcccaccggccccgcgcctcctcgtcgtcttcatctcccccacctccctcgcgctcctcgcctccccgccgccgctccacgcatccctgctcctcccggacctgcccctactcccgcacgcgcccatgcgcgtgtacctccacccctccggcgcgctcctcgccgcggcgcacggcgccttccccgcccagagggcgggcggctgctaaaagggtccaggctccggtctcaccccggagcatgtgggactgtctcacgccctccgtactcgcacgattgccggatcccctgcacggcgaccagcacgttggtgacaaggtcgacacacgcgaggccc

SEQ ID NO: 56066 - protein, 108 aa, Zea mays
  misc_feature: Ceres CLONE 1493705
MEDVITDVPPPSRFSPDDLDNFAAPPAQPTPIFVVSPNPSPPAPRLLVVFISPTSLALLASPPPLHASLLLPDLPLLPHAPMRVYLHPSGALLAAAHGAFPAQRAGGC

SEQ ID NO: 56067 - DNA, 609 bp, Zea mays
  misc_feature: Ceres CLONE 1493711
  misc_feature: Encodes the peptide sequence at SEQ ID NO. 56068
  misc_feature (586)..(586): n is a, c, t, g, unknown, or other
catagctggagctccccgcggtggcggccgctctagaactagtggatcccccgggctgcaggaattcgcacgagaccattacctagaacatcctaatcgaaaaatcaaccgcagtacacggcgtatcattcccagcgaccacgagagactagctagccaagtgcatgcaaccagccatgcaggccgggaagacggcagtggaggcgacgaaggaggccgcggccaacgtcggggcctcggcgaacgccggcatgcagaagacccgtgccgccgtgcaaggccaggtggagaaggccacggcgcgcaacgcgtcggacaaggtcgcggccgaggagcgccagcgggagcgcgtgcgcgccgcggagctggagaagcaggacgccgtgcgcgccaacgcggccgcgaaggagcgcgccattggcggcgcggccacgtaccagcaccagcacccgtcgcaaggcgcgccccgggatccggcgcccaacaaggattttggggggccggaaaaaaaccccccccccccggggggggggcccccccaaaagcccgccccgtcccccaaaaaaaaaccacccccccccccccntttttgtgggaggggggggcgcc

SEQ ID NO: 56068 - protein, 144 aa, Zea mays
  misc_feature: Ceres CLONE 1493711
  misc_feature (8)..(80): Pfam Name: LEA_1 Pfam Description: Late embryogenesis abundant (LEA) group 1
  misc_feature (137)..(137): Xaa is any aa, unknown, or other
MQAGKTAVEATKEAAANVGASANAGMQKTRAAVQGQVEKATARNASDKVAAEERQRERVRAAELEKQDAVRANAAAKERAIGGAATYQHQHPSQGAPRDPAPNKDFGGPEKNPPPPGGGPPQKPAPSPKKKPPPPPXFCGRGGR

SEQ ID NO: 56069 - DNA, 594 bp, Zea mays
  misc_feature: Ceres CLONE 1493719
  misc_feature (234)..(234): n is a, c, t, g, unknown, or other
  misc_feature (292)..(292): n is a, c, t, g, unknown, or other
  misc_feature (466)..(466): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (542)..(542): n is a, c, t, g, unknown, or other
  misc_feature (550)..(550): n is a, c, t, g, unknown, or other
  misc_feature (551)..(551): n is a, c, t, g, unknown, or other
  misc_feature (559)..(559): n is a, c, t, g, unknown, or other
  misc_feature (560)..(560): n is a, c, t, g, unknown, or other
  misc_feature (571)..(571): n is a, c, t, g, unknown, or other
  misc_feature (573)..(573): n is a, c, t, g, unknown, or other
catagctggagctccccgcggtggcggccgctctagaactagtggatcccccgggctgcaggaattcgcacgagaccattacctagaacatcctaatcgaaaaaaggaaaccctccgctcctcccacgtctcccatggccgccgccggctcagccgcagcgccgctccgccggctgctcctccgcctccgtgacccgccgccgctgccctgttaacacgctgcctatgcccgcnctgcgcgcccatctatgctgcatgcaagggccccccaccccctaaggcccccccatgncacccaagcccccccggggcttccctttgggccaaccctttcccccccggagaaaacccccctccgcagaaaacacccccccccggggggggcccccccccaaaaaaaaaaaacgccccccccccatttttctccccccggggggggggggggggggaaaaaaatatatttttntttcccccccccccccccnnnnnnncccgccggacgaaaaaaaaaaaccccccccggggggnnngggggccgcccncgcccccnnccccccgnntcccccccccncnccctctcgccctgcggttttt

SEQ ID NO: 56070 - DNA, 671 bp, Zea mays
  misc_feature: Ceres CLONE 1493742
  misc_feature (47)..(47): n is a, c, t, g, unknown, or other
  misc_feature (560)..(560): n is a, c, t, g, unknown, or other
  misc_feature (603)..(603): n is a, c, t, g, unknown, or other
  misc_feature (613)..(613): n is a, c, t, g, unknown, or other
atagctggagctccccgcggtggcggccgctctagaactagtggatnccccgggctgcaggaattcgcacgagaccattacctagaacatcctaatcgaaaagaaatgggttcttttggcctttttcttctgcggcccatttacctgcacacgtccatacccagtaagtgagacttgtcgtccattctgaagtccggcggcggcggcagcggcgagggcgaggcctctgcgacttccagatctccccgacgaggaggaagtctctacagcggaggggagggagatgtcctacatgcggggtgacctgctgacgaggatgcctaagccggtagaaaggcctccaccaggccccaaatccttttttccccccccccctaggaggggggggggggggggcttctttttcctcccccccaaaacgtcaaaaacaaagaaacaaaaaaacacttccctaaaagagtaggaggagggcggacaattacaaaaaaaataaataccccagtcagctggagcgcaggaggcagctagaagggaaaggggattagaaaaaacaagggcanagggagagagggcggcggaggcggagcgcgggggggggagggngcacccaggnagtcgaccgacgaggtcctggcaggcgccccccccagacagggagaggcacacccacg

SEQ ID NO: 56071 - DNA, 653 bp, Zea mays
  misc_feature: Ceres CLONE 1493755
  misc_feature: Encodes the peptide sequence at SEQ ID NO. 56072
atagctggagctccccgcggtggcggccgctctagaactagtggatcccccgggctgcaggaattcgcacgagaccattacctagaacatcctaatcgaaaaaacccactagggttgatctcctatcgacgcagcctcctccgaagccaagagatgagctcggttaaaggaggtcctctgacatgtaggagaacaaccgcgcccccgggccccgcaaggacgaggtggtgaccctcgagtactccgtcgacctccacaagcgcctccatggatgcgccttcgagaacaagagacatatggcatcgaggagatcaggaagtttgcacagaaggccatgggaaccaacgatgtccgcattgacgtgaagctcaacaagcacatctggagcagcggcatcaggagtgtccctaggagagtccgtgtcaggattgcccgcaagaggaacgacgaggaggatgctaaggaggagctgtactctctggtcacagttgctgaagtcccccaggaaggtcttaaaggtttgggtaccaaggttgtggaggatgaggactaaaccccctgtctgtcgtatcgatcagttagaacttaatacatatctgctgagagcatattgggaagtcttgctttagcttattgttatctactgttcatga

SEQ ID NO: 56072 - protein, 93 aa, Zea mays
  misc_feature: Ceres CLONE 1493755
  misc_feature (2)..(75): Pfam Name: Ribosomal_L31e Pfam Description: Ribosomal protein L31e
MRLREQETYGIEEIRKFAQKAMGTNDVRIDVKLNKHIWSSGIRSVPRRVRVRIARKRNDEEDAKEELYSLVTVAEVPQEGLKGLGTKVVEDED

SEQ ID NO: 56073 - DNA, 635 bp, Zea mays
  misc_feature: Ceres CLONE 1493758
  misc_feature: Encodes the peptide sequence at SEQ ID NO. 56074
aagctggagctccccgcggtggcggccgctctagaactagtggatcccccgggctgcaggaattcgcacgagaccattacctagaacatcctaatcgaaaaattttgccatccctagctccacagcaccacttgctcctgcctcctgctgcttcttcccgagttcccgtgccgccgcgagcgctcccaaccaagcaacgagacaacaacaacaaccctgcaccgccgcagcacttgcgccgtccggtcctgtcctcccgcggtctcgacgccgccccctaccgtcctaccttatcgcgcaccgctccatggccgccaagtgggcccagaagaccgtcgttatcccggcgcatcggcggggctgccacctcatcacccccaagattctgagggagatcgagggcgacctggccgggttcaagtgcggtctcgcgcatttcttccttcagcacacaagcgcatcgctgaccatcaacgagaactatgactctgatgtgcaggctgacactgagacttttcttaacagaattgttccagagggccacaatgctccttggaaacacactatggaaggacctgatgacatgccagcacatattaaatcttctatgtttggttgttccctaacgattccta

SEQ ID NO: 56074 - protein, 109 aa, Zea mays
  misc_feature: Ceres CLONE 1493758
  misc_feature (19)..(109): Pfam Name: UPF0047 Pfam Description: Uncharacterised protein family UPF0047
MAAKWAQKTVVIPAHRRGCHLITPKILREIEGDLAGFKCGLAHFFLQHTSASLTINENYDSDVQADTETFLNRIVPEGHNAPWKHTMEGPDDMPAHIKSSMFGCSLTIP

SEQ ID NO: 56075 - DNA, 709 bp, Zea mays
  misc_feature: Ceres CLONE 1493761
  misc_feature: Encodes the peptide sequence at SEQ ID NO. 56076
  misc_feature (306)..(306): n is a, c, t, g, unknown, or other
  misc_feature (394)..(394): n is a, c, t, g, unknown, or other
  misc_feature (400)..(400): n is a, c, t, g, unknown, or other
  misc_feature (709)..(709): n is a, c, t, g, unknown, or other
gtggagctccaccgcggtggcggccgctctagaactagtggatcccccgggctgcaggaattcgcacgagaccattacctagaacatcctaatcgaaaactccccttgcacgacgtctccaccactacaccacacctcaagtccacaacaccaccagcctcgtctcagccgcttcagcataccacaccgcacgcaaacccaccgcgcgctacgaccaccaccgtcaccatggccgccgcgcgctacgacgtggagaagggcgggaggaataacggggatgggaagccttcgccgccgccgccgggncacctgtacccgcattcgcgacggggaaagggaatgggtgccctgcttggttttttttcccccccccccgggggaaagaaaacgggcncccccncccaactacctcaaaatttgttcgggccaaaccagcctcggtctctccgcggcgggggcccggaacatacccaccccccccggctccctccaccggtttcttgttccaaaccctttcacgtagaaaacttctaccctccggccgcgcgggttggctctcccttcaaaaaacttgcgcaaattcccgcccccgacccccaaatcttccccccgcccctccattattggtgggggagcgccgtaacgtcccgtaccggtgaatcccccggattccttatggggaccccgacctctgcccccacaaccctcn

SEQ ID NO: 56076 - protein, 160 aa, Zea mays
  misc_feature: Ceres CLONE 1493761
  misc_feature (56)..(56): Xaa is any aa, unknown, or other
  misc_feature (58)..(58): Xaa is any aa, unknown, or other
MAAARYDVEKGGRNNGDGKPSPPPPGHLYPHSRRGKGMGALLGFFSPPPGGKKTGXPXQLPQNLFGPNQPRSLRGGGPEHTHPPRLPPPVSCSKPFHVENFYPPAARVGSPFKKLAQIPAPDPQIFPPPLHYWWGSAVTSRTGESPGFLMGTPTSAPTTL

SEQ ID NO: 56077 - DNA, 739 bp, Zea mays
  misc_feature: Ceres CLONE 1493763
  misc_feature: Encodes the peptide sequence at SEQ ID NO. 56078
ctggagctccccgcggtggcggccgctctagaactagtggatcccccgggctgcaggaattcgcacgagaccattacctagaacatcctaatcgaaaacaaaaccctagccctcgcgccgccgccgccgtgcccagcgctcgagctcctcgcctgccgcgagctcgcgccgcaacgccaccatgaagttcaacatcgcgaacccgtctaccgggtgccagaagaagctggaaatcgatgacgaccagaaactacgtgccttttatgaccgaaggatctcccaggaggtcagtggtgatgctctgggtgaggagtttaagggttatgtcttcaagatcatgggtggatgtgacaaacaaggccccccaatgaaagcaaggagttctgacttctggttcggtccggccttctgcctccaaaaaggcactcccctgcttcccccggttatgggaagggcttaatggttgaaccccaggaagaaaaccctgccccgggttttttttgggaacccaaaaaccaatttttttttcaaccttggaaattgtttaaaaaagggggaaaaacatatccccccgggtttcacccccacccggaaaacccccagggagaagagggcccccaaaagggcccccccaaaaaaaaagaactttttctttttttaaaaaaaaaaaaaaaccccccaaaaatctctaaaaaaccccccctaggatttttccccccaagagaggggggaggggggg

SEQ ID NO: 56078 - protein, 92 aa, Zea mays
  misc_feature: Ceres CLONE 1493763
  misc_feature (1)..(91): Pfam Name: Ribosomal_S6e Pfam Description: Ribosomal protein S6e
MKFNIANPSTGCQKKLEIDDDQKLRAFYDRRISQEVSGDALGEEFKGYVFKIMGGCDKQGPPMKARSSDFWFGPAFCLQKGTPLLPPVMGRA

SEQ ID NO: 56079 - DNA, 662 bp, Zea mays
  misc_feature: Ceres CLONE 1493769
  misc_feature: Encodes the peptide sequence at SEQ ID NO. 56080
  misc_feature (48)..(48): n is a, c, t, g, unknown, or other
  misc_feature (55)..(55): n is a, c, t, g, unknown, or other
  misc_feature (344)..(344): n is a, c, t, g, unknown, or other
  misc_feature (376)..(376): n is a, c, t, g, unknown, or other
  misc_feature (402)..(402): n is a, c, t, g, unknown, or other
  misc_feature (404)..(404): n is a, c, t, g, unknown, or other
  misc_feature (405)..(405): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (440)..(440): n is a, c, t, g, unknown, or other
  misc_feature (441)..(441): n is a, c, t, g, unknown, or other
  misc_feature (458)..(458): n is a, c, t, g, unknown, or other
  misc_feature (459)..(459): n is a, c, t, g, unknown, or other
  misc_feature (470)..(470): n is a, c, t, g, unknown, or other
  misc_feature (471)..(471): n is a, c, t, g, unknown, or other
  misc_feature (482)..(482): n is a, c, t, g, unknown, or other
  misc_feature (483)..(483): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (547)..(547): n is a, c, t, g, unknown, or other
  misc_feature (574)..(574): n is a, c, t, g, unknown, or other
  misc_feature (575)..(575): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
aaaagctggagctcaccgcggtggcggccgctctagaactagtggatntctgcgnctgcaggtattcgcacgagaccattacctagaacatcctaatcgaaaaaaaaattggcacttccgtaccccgaccccggccaccgtgtggaaacagaaacagcaatggcggggaggctggtgccgagcacgaagaaggcgatggagcaccgggaggagaagcccaaggtgccgtcgagcgacccgggctccgaccccgacctggtgcagctggtggccgggcagcagccgcccaacatctcgcagatgaagccgctgacgcgggaggcgttacggcggctggatgtacncggccgaggaggagggcggccggcggaagggncccgcgcgggggcccgcgagcccctngnngagtggcgaccgcccccaggnnnagggcgttgggnngaggcccggtcgcccgnnggccccgaccnncgatcgaccgnnacctccatattaccttccttttcttaatnnnnnacccccactttctatttgccccatcacctcnccttcctctcaccggcccaccccccannccctaccttgctcaccccgccgatggtctccactcctcctccccctggnnnaccccccccccccccccctcccctacaataaacttg

SEQ ID NO: 56080 - protein, 116 aa, Zea mays
  misc_feature: Ceres CLONE 1493769
  misc_feature (62)..(62): Xaa is any aa, unknown, or other
  misc_feature (73)..(73): Xaa is any aa, unknown, or other
  misc_feature (82)..(82): Xaa is any aa, unknown, or other
  misc_feature (90)..(90): Xaa is any aa, unknown, or other
  misc_feature (94)..(94): Xaa is any aa, unknown, or other
  misc_feature (100)..(100): Xaa is any aa, unknown, or other
  misc_feature (104)..(104): Xaa is any aa, unknown, or other
  misc_feature (108)..(108): Xaa is any aa, unknown, or other
MAGRLVPSTKKAMEHREEKPKVPSSDPGSDPDLVQLVAGQQPPNISQMKPLTREALRRLDVXGRGGGRPAEGXRAGAREPLXEWRPPPGXGRWXEARSPXGPDXRSTXTSILPSFS

SEQ ID NO: 56081 - DNA, 659 bp, Zea mays
  misc_feature: Ceres CLONE 1493782
  misc_feature: Translation starting site: 174
  misc_feature: SWISSPROT Homolog: EC 3.2.1.23 Beta-galactosidase
aagctggagctccccgcggtggcggccgctctagaactagtggatcccccgggctgcaggaattcgcacgagaccattacctagaacatcctaatcgaaaaaaaatcatcttcctcctcttctctcctctcctcttactcttccccaccaacgccaccaaaaccaacactccgatggatgttttcaccaagcaactcctccccatgcctcaccagcgggaccccaactacccttcctcttccacctcttcctcctcgtcgtcgtcctcctccacgcccccatctcgccctcaccaccgtgcgcaaccccaaccccaaccccacaacctcccccagtccccgagacccgtcgccgtaccgtccgtccttgtttcgtgaggtgcttgctttgctgttctccttgatcgacgccgtatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaaa

SEQ ID NO: 56082 - DNA, 622 bp, Zea mays
  misc_feature: Ceres CLONE 1493783
  misc_feature: Encodes the peptide sequence at SEQ ID NO. 56083
aatgctggagctccccgcggtggcggccgctctagaactagtggatcccccgggctgcaggaattcgcacgagaccattacctagaaaatcctaatcgaaaaatagatataccgcccgcgcatcgctccatggcggtcggcggcgacgacgacagcatggagcgggacttcgccgccaggctgcgcctcgcgcattcgccctccccggccacgcctgccgccgccgcctcatcctcccccaccgccgctggggggatcgccttccgcgcgccgcaggagcagttcaccgccgacgacttcgtactcggcaagatctacggcgtcggctcgtactccaaggtggtgcgggccaagaagaaggacactggtcgcgtctacgcgcttaagatcatggacaagaagttcatcaccaaggagaacaagatctcctacgtcaagatggagcgtattgtactcgaccagctcgaccaccctggcgtcatcaggctcttcttcactttccaggaaacatactcccctctactggcgctcgagtcgtgcgagggcggggagtttttccaaccaaattggtcggaaaaggcgggctctctgaagaacaagcacggttccttgccggctgaaa

SEQ ID NO: 56083 - protein, 164 aa, Zea mays
  misc_feature: Ceres CLONE 1493783
  misc_feature: SWISSPROT Homolog: EC 2.7.11.1 Non-specific serine/threonine protein kinase
MAVGGDDDSMERDFAARLRLAHSPSPATPAAAASSSPTAAGGIAFRAPQEQFTADDFVLGKIYGVGSYSKVVRAKKKDTGRVYALKIMDKKFITKENKISYVKMERIVLDQLDHPGVIRLFFTFQETYSPLLALESCEGGEFFQPNWSEKAGSLKNKHGSLPAE

SEQ ID NO: 56084 - DNA, 663 bp, Zea mays
  misc_feature: Ceres CLONE 1493789
  misc_feature: Encodes the peptide sequence at SEQ ID NO. 56085
atagctggagctccccgcggtggcggccgctctagaactagtggatcccccgggctgcaggaattcgcacgagaccattacctagaaaatcctaatcgaaaaatagatataccgcccgcgcatcgctccatggcggtcggcggcgacgacgacagcatggagcgggacttcgccgccaggctgcgcctcgcgcattcgccctccccggccacgcctgccgccgccgcctcatcctcccccaccgccgctggggggatcgccttccgcgcgccgcaggagcagttcaccgccgacgacttcgtactcggcaagatctacggcgtcggctcgtactccaaggtggtgcgggccaagaagaaggacaatggtcgcgtctacgcgcttaagatcatggacaagaagttcatcaccaaccccaacgagatctcctacgtcaagatggagcgtattgtactcgaccagctcgaccacccctggcgtcaacaggctcttcttcactttccaggacacattctcccctctacatgggtgctccgagtccttgccaaagcggcggacggatttcgacccaaatttgttcgggaaaagctcggctcttcctgacgacggaggcaccgggtcctttggcggcctgaacatctgttgagaattacccgcgggacc

SEQ ID NO: 56085 - protein, 157 aa, Zea mays
  misc_feature: Ceres CLONE 1493789
  misc_feature: SWISSPROT Homolog: EC 2.7.11.1 Non-specific serine/threonine protein kinase
MAVGGDDDSMERDFAARLRLAHSPSPATPAAAASSSPTAAGGIAFRAPQEQFTADDFVLGKIYGVGSYSKVVRAKKKDNGRVYALKIMDKKFITNPNEISYVKMERIVLDQLDHPWRQQALLHFPGHILPSTWVLRVLAKAADGFRPKFVREKLGSS

SEQ ID NO: 56086 - DNA, 722 bp, Zea mays
  misc_feature: Ceres CLONE 1493791
  misc_feature (35)..(35): n is a, c, t, g, unknown, or other
ccccgcggtggcggccgctctagaactagtggatnccccgcgctgcaggaattcgcacgagaccattacctagaacatcctaatcgaaaaaaccttctaattagcctttgacccacccccccgccggccgccgctgcagaccatggagcacgcgtccgccttcctcgcgcgcgcgctcaccactccgcttccggcatccgccgctctcccgccagtccgcctgggtcgcgtggcctttcccccccctttttctcactttttgccctcattcttcctccctttctcctattttttttttcaatacactctaattgacaacattatgtccattttttgccccgctattcccagtgattcccccgccctctttcaagccccctcccgccaagtctctaattacgattatttccttctttgtccccccattttttataccaccctagctcaatattatccccttttcatataataacccccatacactaatgcttaataatagcccgatcttacgcccggccttgagaattacggcatattatcggtgtcttttttcttcgctcccttatactcaagccttcatgtttatctttttttaggcgtgactgtctttcacttcgacaccgttttttcttctcccatcgcttttctactcccattttatatccccacctcatattactcattatttataaccaccaatattccctctattctattttact

SEQ ID NO: 56087 - DNA, 628 bp, Zea mays
  misc_feature: Ceres CLONE 1493796
  misc_feature: Encodes the peptide sequence at SEQ ID NO. 56088
aaagctggagctccccgcggtggcggccgctctagaactagtggatcccccgggctgcaggaattcgcacgagaccattacctagaacatcctaatcgaaaaaaccaggaaagcaaagcgcttcgcaagcacaggcagtgatcggcaaccaaatccggacagtcttgagctctctcagtctcagcatttcagttcccagattcacatagccccagccccacaagtagcgaaatggcagctgctccgttcgcgattgccggccggctctcccccgttgcgcgcctcccggtccgcgcctggaggccggcgcacgggtctgcatcatccaggagagcccgctcgctcgccgtggcgtccgcggcgcacgagaacagggacaacagtgtcgacgtacaggttagccagaacggcggcaacatgcagcagggtcacgccttgcaacgccgcccgcgcccaggggacagggttcgaaattatccccattcccgttcgggttaagtttatcccgatttccccccatgcgggacaatacccgaaaaagccctgcacacaatgggacagggtttgttcaaaaaacccccgggggggtccccccttggggaaaaacggaggggccccccgagaaacc

SEQ ID NO: 56088 - protein, 88 aa, Zea mays
  misc_feature: Ceres CLONE 1493796
MAAAPFAIAGRLSPVARLPVRAWRPAHGSASSRRARSLAVASAAHENRDNSVDVQVSQNGGNMQQGHALQRRPRPGDRVRNYPHSRSG

SEQ ID NO: 56089 - DNA, 646 bp, Zea mays
  misc_feature: Ceres CLONE 1493804
  misc_feature: Encodes the peptide sequence at SEQ ID NO. 56090
aaagctggagctccccgcggtggcggccgctctagaactagtggatcccccgggctgcaggaattcgcacgagaccattacctagaacatcctaatcgaaaatcatcctccgcaagggcctcatcgccggcgtcgagtaccccctgctcgccgagcacatggccgactacatggccaagaccctcttcttcacctccctcctctacaactccaccaccgagcacaagaagcaagttgctcgctactgcgagaacgtggagatgtgcaggctcacggagcaggtcgtgttctcggacccatacatggtctccaaatacaatcgctggaactcgcctctcctcgacaaggacgccgaagccgttcgagaggacgatgggctgaagttggagattgctgaattgaagtcgatgtttattgagagagcgcaggctctgattcatggagatctccataccggttccatcatggtgaccccagattccactcaagtgattgatccggagtttgccttctacgcgccgatgggttacgacattggggccttcttggggaacctgattctcgcatactttgcacaggatgggcatgctgatcaagcaaatgaccgtaaagcttataagcaatggatattgaagaccatcgaaga

SEQ ID NO: 56090 - protein, 162 aa, Zea mays
  misc_feature: Ceres CLONE 1493804
  misc_feature: SWISSPROT Homolog: EC 2.7.1.100 S-methyl-5-thioribose kinase
MADYMAKTLFFTSLLYNSTTEHKKQVARYCENVEMCRLTEQVVFSDPYMVSKYNRWNSPLLDKDAEAVREDDGLKLEIAELKSMFIERAQALIHGDLHTGSIMVTPDSTQVIDPEFAFYAPMGYDIGAFLGNLILAYFAQDGHADQANDRKAYKQWILKTIE

SEQ ID NO: 56091 - DNA, 663 bp, Zea mays
  misc_feature: Ceres CLONE 1493806
  misc_feature: Encodes the peptide sequence at SEQ ID NO. 56092
  misc_feature (393)..(393): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (404)..(404): n is a, c, t, g, unknown, or other
  misc_feature (406)..(406): n is a, c, t, g, unknown, or other
  misc_feature (407)..(407): n is a, c, t, g, unknown, or other
  misc_feature (415)..(415): n is a, c, t, g, unknown, or other
atagctggagctccccgcggtggcggccgctctagaactagtggatcccccgggctgcaggaattcgcacgagaccattacctagaacatcctaatcgaaaactatacgccgccatcttcgtaagccaccgcaaccgaagcccgccttcgccgccgccgcctctgcgatccccgcaaggtcgcaaacatgtctaccgtgctccagcgcccgacccccggcacggtccagtgcttcggccgcaagaagacggctgtggccgtcgcctacaccaagccggggctcgtgctgatcaaggggaacggcgtcccaattgagctcttcaggccggaaatgctccccctcaaggccttctatttttttccccccccccaggggggggggggggggggggncttcnnncttnannttcccccntccccacccaacaggtaaaactttccccttatctccgccctctgcgccgggcgcctccccaagggggccccgctcccctactacccagaaagtcctgccaaccaaggccgccccaaaaaagcggtcagcggcccttctccccccggtaaccaaccgccccccctttcccgtccgcccgaccccccgcggccctcccgcaacctcaagaaagcttcggcgggctcccgcgccccccgtcacccaatctc

SEQ ID NO: 56092 - protein, 81 aa, Zea mays
  misc_feature: Ceres CLONE 1493806
  misc_feature (69)..(69): Xaa is any aa, unknown, or other
  misc_feature (71)..(71): Xaa is any aa, unknown, or other
  misc_feature (73)..(73): Xaa is any aa, unknown, or other
  misc_feature (74)..(74): Xaa is any aa, unknown, or other
MSTVLQRPTPGTVQCFGRKKTAVAVAYTKPGLVLIKGNGVPIELFRPEMLPLKAFYFFPPPQGGGGGGXFXLXXPPSPPNR

SEQ ID NO: 56093 - DNA, 610 bp, Zea mays
  misc_feature: Ceres CLONE 1493808
  misc_feature: Encodes the peptide sequence at SEQ ID NO. 56094
aaagctggagctccccgcggtggcggccgctctagaactagtggatcccccgggctgcaggaattcgcacgagaccattacctagaacatcctaatcgaaaaaacgagagctagggttttgattccagtactcacgccgcatcctgtctccttctgcccctccctctcggcaccgcctccgccccctcattctctctcgcgtcatccggcggaggctcgaggaaactgaggccgggagcgccccgaagaatattctccacccagtcgccgacacccctgcgcgcgcgagagttaccattgtactgttgtagcttggcagttggttgactgtgtgacaactttgagctatgtcatattacgaaagaaggggtggagacaagggtagtgggcgtattcaaagaaaagtgtggcgaagtggacatgtcctgcgtggaaatcaggattggctcccgaagacctccttggggtaaactccgtccatctggacgcactattgctaaacctttttgcagaaccaaagacatgacctggcaacctgaatctattaaggataacctgggcgcgcatggaaataaaaaccgggaaaaattggcactttcaaaactggaaa

SEQ ID NO: 56094 - protein, 40 aa, Zea mays
  misc_feature: Ceres CLONE 1493808
MSYYERRGGDKGSGRIQRKVWRSGHVLRGNQDWLPKTSLG

SEQ ID NO: 56095 - DNA, 673 bp, Zea mays
  misc_feature: Ceres CLONE 1493810
  misc_feature (306)..(306): n is a, c, t, g, unknown, or other
tcccgcggtggcggcgctctagactagtggatcccaaggctgcaggattcgcacgagacattacctagaacatcctaatcggaaaatcttcttcgtagcgccgacgctccatcttccgctccctcccttagtcgcgctcggcacgcgggtgacggcggcagcagcggcgctcaagatcgggctctcagcgacagcatcagcggtttcccctcccgcttctctccaggcgcctcgcgccctcgcctccggtcctccacacaccggacggtgaccccgcaatatggggtgtgaggataccaatacacnaaaatgaacaaagggaaagatttttaagccagccaagggcactcagaaggaaggggggaagaagtggcacaaaagaatagcaaagaaaaaaggggtgggaaaaaagccgccccccccactccaaaccaagagaaccggacgcaaccaagaaacaaaaaaaattgccgcaaccacatctggaaaagaaacggcatccaaaagccgggaacgacgcccctcccacaggggcggaaagtacgggcggatacacaacgccacgggagtcaatggggaggagaaaaacacttccaacacccgaacggggaaaaggaagcacctccgggaacacaagcaaatagcaaacaaaagccatcagagacaatccaag

SEQ ID NO: 56096 - DNA, 687 bp, Zea mays
  misc_feature: Ceres CLONE 1493818
caaagctggagctccccgcggtggcggccgctctagaactagtggatcccccgggctgcaggaattcgcacgagaccattacctagaacatcctaatcgaaaaaaacaaggagcgctacatccaggccagcagtttccatttgcaatccgaccccatcttcatcccgttgtcgcagcagcagccatccaagcagcgatggacggcggcaagaagagccggaacccgcacaggcctccgcggactaccgcagcgaccgcaagtcagcctccgggatgagcggcgacccccagaaagggcggccgcggcggcaagttcacctggggagggcgccgacgactacggttacgggtaccgccgagaaggacctcggccctcctcttccagaaaaggaaacattcacacgggaaccccttacccaaggcccagggaaggccccgccccctaaaaaaggacaaaaaacaaaaaggccctccccccctcgggtttcccccccccgggcccccttaaattcccacaaaaaaaaacaaaaaaacccctttctgggttggtttaatttccccataacaaggtccgaattcccccgggttggaaaaaaaccccaaaacccgtggggggggttaggggggccgcgggccccccacaaaaattttggggggggagccccccccccaaaaaaaaaaaagaaa

SEQ ID NO: 56097 - DNA, 674 bp, Zea mays
  misc_feature: Ceres CLONE 1493821
  misc_feature: Encodes the peptide sequence at SEQ ID NO. 56098
aaagctggagctccccgcggtggcggccgctctagaactagtggatcccccgggctgcaggaattcgcacgagaccattacctagaacatcctaatcgaaaaaccagagtcaccgcggcgagttcaaatcccacaatcttcttgtagcacaccactgtcttcgtccaactcggcggcgatgtctgggcgcggcaagggcggcaaggggctgggcaagggcggcgcgaaacgccaccgtaaggttctccgcgacaacatccagggtatcacgaagccggcaatccggaggctggcgaggaggggcggcgtgaagcgtatctccgggcttatctacgaggaaacccgcggcgtgctcaagatcttcctcgagaatgtcatccgcgacgcggtcacctacaccgagcacgctcgccgcaagaccgtcaccgccatggatgttgtgtacgccctcaagcgccagggccgcactctgtacgggttcggtggttgagcgcatctcttccctcgtctgcagcggctgccggtggcgtttcctcaggtccctctggcttgctgggcttgatgtagagaggtatcagattaaaatatctcttgatgtgcttcggtattgggggggaatcatggggccccagcagggctggggaaatcaagatcaggatgtatccttcctttgt

SEQ ID NO: 56098 - protein, 103 aa, Zea mays; identical to SEQ ID NO: 6459
  misc_feature: Ceres CLONE 1493821
  misc_feature (25)..(94): Pfam Name: Histone Pfam Description: Core histone H2A/H2B/H3/H4

SEQ ID NO: 56099 - DNA, 666 bp, Zea mays
  misc_feature: Ceres CLONE 1493822
  misc_feature: Encodes the peptide sequence at SEQ ID NO. 56100
  misc_feature (395)..(395): n is a, c, t, g, unknown, or other
aaagctggagctccccgcggtggcggccgctctagaactagtggatcccccgggctgcaggaattcgcacgagaccattacctagaacatcctaatcgaaaaacccctacgggtcctgtggccactgcctcttgccgcaggcagccctcttctctctcttccgccgtctcgcctcctcacgccattaaaccccacccgcgcgcgcggcggccggcggcgagccctcacccatccgagcaagccgtggaggaagcgagcgcgcgaaagtatcaggaggaggcatgggtaccctggggcgcgcgatcttcacggtgggcaagtggatccggggcacggggcaggccatggaccgcctcggatccaccatccagggcggcctccgcggcgaggaacangtttcaaggcatcgtacaatcatgaatatttttgagaaagagccaaggatccatagagatgtgtttgttgctcccagtgcagcagtcattggggatgttgagattggtcatggatcgtcaatctggtacggatccatattgagaggggatgtcaacagcattcatattggatctgggactaatatacaagacaattcccttgtacatgttccaaagctaaacatagcggggaaggccctcccaaccatatttggaaacaacggtgaccggg

SEQ ID NO: 56100 - protein, 128 aa, Zea mays
  misc_feature: Ceres CLONE 1493822
  misc_feature (38)..(38): Xaa is any aa, unknown, or other
MGTLGRAIFTVGKWIRGTGQAMDRLGSTIQGGLRGEEXVSRHRTIMNIFEKEPRIHRDVFVAPSAAVIGDVEIGHGSSIWYGSILRGDVNSIHIGSGTNIQDNSLVHVPKLNIAGKALPTIFGNNGDR

SEQ ID NO: 56101 - DNA, 659 bp, Zea mays
  misc_feature: Ceres CLONE 1493823
  misc_feature (623)..(623): n is a, c, t, g, unknown, or other
  misc_feature (631)..(631): n is a, c, t, g, unknown, or other
  misc_feature (659)..(659): n is a, c, t, g, unknown, or other
ggagctccccgcggtggcggccgctctagaactagtggatcccccgggctgcaggaattcgcacgagaccattacctagaacatcctaatcgaaaaaagctttagctggatccttgggcatctctgtgaaggtgtgtgcaagcctgagttcatctccttagcctccgcgtcggctttgttcagttcatcaagtgccattccattgtctggtactctggtgccacagcaaccatccttccacctcgccgtggtcagagcatctcgagaagtttgttacccagaacggagttgcgccaccgcagaccggagccgtgaacagcctctgtgttgaccgaacaactcacgctttctccggtcgattccttgtgagcaccaaagtttagaactcctaccagaaggagtgaagattcaagctgaagtggtgactgaagaggagtctactccagtggctgctgatcaagtggaggagccatctaactggggtttaatagagggatcgagtacctcttcactgcaacaaaggtgatgaggagtattctaggagttcctgtggctgggaggcgtttccagttctggaggaggattagttaggattgtgtataagctttagaggggtcctaccntcctgctnatgtaataggtatgcactttgagtatan

SEQ ID NO: 56102 - DNA, 664 bp, Zea mays
  misc_feature: Ceres CLONE 1493825
  misc_feature: Encodes the peptide sequence at SEQ ID NO. 56103
  misc_feature (640)..(640): n is a, c, t, g, unknown, or other
aaagctggagctccccgcggtggcggccgctctagaactagtggatcccccgggctgcaggaattcgcacgagaccattacctagaacatcctaatcgaaaaatcgatcctgtcctgtccagcaagggagacctggactggaggaggaggacctacctacccggcctccagctctctcgtctcttcctcctcctcctcgaagctccgatccgatcccccaatgtctgacagcagtccagctcccggcgcctactactccggccctcccgccgcgccgccgcccgagtctaagcccgttgacggcggccaggtcaacgccgatgttcctggctactactcctccgcccctgctgcgaaatctggcgccggcggccagcagggcagctccgctgctcccaaggaatcgggcttcttcgccagctgttgtgggtgcttctctggcggcgaaaccgcgagatagatagattcagtgttggaccgagaaccatggatggatggatggaacatgcatgcccagtgattgtttgcgccgatgaaagttcaatttgtccggatttattttctctgaaatagtatatgtttttttttctccatcggtgagccggtgatcttgtcaatttgtacaataatcattatatgncaacaactgtgctttaatttgctc

SEQ ID NO: 56103 - protein, 79 aa, Zea mays; identical to SEQ ID NO: 43366
  misc_feature: Ceres CLONE 1493825

SEQ ID NO: 56104 - DNA, 666 bp, Zea mays
  misc_feature: Ceres CLONE 1493826
  misc_feature: Encodes the peptide sequence at SEQ ID NO. 56105
  misc_feature (666)..(666): n is a, c, t, g, unknown, or other
aaagctggagctccccgcggtggcggccgctctagaactagtggatcccccgggctgcaggaattcgcacgagaccattacctagaacatcctaatcgaaaagtcggccatcgtccacggatcctatcggtctctcctgtgtcctcttcagtctccacgccgttccagaagtcgccaaccttccctcgccgccgcgccgcaacagccgcctcccctccaaggtagcccaatcgaaaccactcgcccggccaccatggcctttgccagctcgctgcttcccgtgccgccctaccgcgtctgcgcgacccccgcgtcggaggtcgccgccttctcgccggccaagaagagcgtctcgctcgccgctgcgcgccagcgccgaggatcccgtcacggagtgagggcagaagtaaatgaatctggaagtgttttggctgttgatgcactctcgcaagttaaacatgttctgcttccagtccttgatcgcaacccttacctttctgaaggcacaagacaggcggattttcggagtttagattgatggagcgtcttggggaagggcagaaaccaacagttatcatcggggaagttgctgatgagtgggacttagacctggttgtgctaagcatggaggcaatccactccaagcatgtcgatgggaatttgctn

SEQ ID NO: 56105 - protein, 94 aa, Zea mays
  misc_feature: Ceres CLONE 1493826
MAFASSLLPVPPYRVCATPASEVAAFSPAKKSVSLAAARQRRGSRHGVRAEVNESGSVLAVDALSQVKHVLLPVLDRNPYLSEGTRQADFRSLD

SEQ ID NO: 56106 - DNA, 669 bp, Zea mays
  misc_feature: Ceres CLONE 1493827
  misc_feature: Encodes the peptide sequence at SEQ ID NO. 56107
  misc_feature (520)..(520): n is a, c, t, g, unknown, or other
aaactggagctccccgcggtggcggccgctctagaactagtggatcccccgggctgcaggaattcgcacgagaccattacctagaacatcctaatcgaaaaaaatccgcagattcccgtcgctacttcggccacatggctgcagcggcggcgtggaccggcgccgcatcccccaactcgctgctgctctcgcgctcgcctccccacgccgccgtgctcgcgccttcgtcggggagctccatgcggaggcggctcctgctcggcgtcggcaccccggccgtggcggcgctggcggccgcggcgccgccagcggtgctgcaggacggggcagtcactgtgctcatcaccgccggcgcctactctcttgtgcgcgtcttcgacgagctcaccgagcggcggctcatcgaaaagagcttgagcaggaaagttgtgcacgtgctgtccggcgtcctggtcatgtcatcttggcccctgttcagggaattgctgagaggtccactctatatgtcctggggctgctngtcagcgttttagtctctggcgtgagtccccatcgggatcgtctcctgtcaagaaaagcggtggcaaggttttgctgacatgttgggaagaggtaggctccacaagctgcctttcatcaaaaaaaaactggccgggaaatcttgaattt

SEQ ID NO: 56107 - protein, 132 aa, Zea mays
  misc_feature: Ceres CLONE 1493827
  misc_feature (129)..(129): Xaa is any aa, unknown, or other
MAAAAAWTGAASPNSLLLSRSPPHAAVLAPSSGSSMRRRLLLGVGTPAVAALAAAAPPAVLQDGAVTVLITAGAYSLVRVFDELTERRLIEKSLSRKVVHVLSGVLVMSSWPLFRELLRGPLYMSWGCXSAF

SEQ ID NO: 56108 - DNA, 678 bp, Zea mays
  misc_feature: Ceres CLONE 1493835
  misc_feature (384)..(384): n is a, c, t, g, unknown, or other
aagctggagctccccgcggtggcggccgctctagaactagtggatcccccgggctgcaggaattcgcacgagaccattacctagaacatcctaatcgaaaaccctccggacaaaatgagatcagcggcaccaccgtgccaacttcccagcccaaaccccgacgcgtccccacctccgtcgccgatgacaccgcgtgccccgcaggttcggcatcacccgccgcacctcctcctcgccgaggctgtcgcctcctggcaccctttccacaagaagccatgtctcacggaccgctccacggctcccccctcctcggcccgcctccccgatgcggagactccgacgcctgccccctcggggggcggtagcggcggatccttcggtggnttcggctcccgcagcggcgccgcccgcgtccgggctcgcggtccgtgtccggcgcagcagcgcccgccgaagatcggcacgtgctccgacttcatttcacgtgcggcccccgttgtggtggccgcggcggtgccactgaactcaacggggaaatttgggctttctgatgttcgggaaggtcgaattaggaaccttgccaatggggaacgaattcggcccctcccctttttggtgggtttgtttctagaaaatgttgggtcccgcccctccaccgaagggccgtgttcccccttt

SEQ ID NO: 56109 - DNA, 681 bp, Zea mays
  misc_feature: Ceres CLONE 1493842
  misc_feature: Encodes the peptide sequence at SEQ ID NO. 56110
  misc_feature (681)..(681): n is a, c, t, g, unknown, or other
caaagctggagctccccgcggtggcggccgctctagaactagtggatcccccgggctgcaggaattcgcacgagaccattacctagaacatcctaatcgaaaaatcgagccgccgccgccgccgccgcagttgtcttcggtcttccgtgctcaccttcgagagatcaagttgctgctgcggtagtccccaaccatcatcatgcagaacgaggagggtaagacggtggacctctacgtccccaggaagtgctcggccacgaataggatcatcactgccaaggatcatgcctctgtccagatcaacattggccacttggatgcgaatggcctgtacgatggtcacttcaccacgtttgctctctctgggtttgtccgtgctcagggtgatgctgacagttcgttggacaggctgtggcagaagaagaaggctgagatcaagcagtaggtctttgcacgtagttccaccggtaatggactcttgagggaactgctcatatggcctttttactggggggggggggggggaggagattcagatgttgggctggttcgtttgttggatgaccaggttttagtttgtctggccatgcttgggtcgcagcaatctgtggcacgatgaatatcattttgtcaacctattcttctcacaaaaaaaaaaaaaaaaagcttatcgatactgtn

SEQ ID NO: 56110 - protein, 81 aa, Zea mays; identical to SEQ ID NO: 43974
  misc_feature: Ceres CLONE 1493842
  misc_feature (1)..(81): Pfam Name: Ribosomal_S21e Pfam Description: Ribosomal protein S21e

SEQ ID NO: 56111 - DNA, 728 bp, Zea mays
  misc_feature: Ceres CLONE 1493843
  misc_feature: Encodes the peptide sequence at SEQ ID NO. 56112
  misc_feature (346)..(346): n is a, c, t, g, unknown, or other
  misc_feature (391)..(391): n is a, c, t, g, unknown, or other
  misc_feature (400)..(400): n is a, c, t, g, unknown, or other
aaagctggagctccccgcggtggcggccgctctagaactagtggatcccccgggctgcaggaattcgcacgagaccattacctagaacatcctaatcgaaaaattatccgaagttccgaacccacgccaagccccagggtccgaccgcagaaccgacccaaaatgtcgcccgcctcttccatgctcaccgccgtgtcgctctcctccccgctcccagccccgcgcctccgcgccgccgccgccgcctcctccttcgctccgccgcgccgcgcggcagtcgcactcgtcgtgcgcgcggcgtccgcatcttccaagtcccctgccacggcagaaagcggccccgaangagaaagaggcgaccggcatcacccagccgaagtccgtgtcgccnggactgcanggcatcgtggggcgacccgggtattccccgccacggaggtcctcaggcccctcttgggccttattccaggagcataaccttccagaacccttttgaaaaaaaggggggggttttttgaataaaaacttaaaggacctttttcccggggggggaaccaaagggggattctttgaaaaccccaaatttttccaccccccctttttggaaaaatataaaaagagaaacccccccccttcctggagaaaaaagaacctttataaggggggggggggaattttggggggggaaaaaaaaggggcgcgcgggttttttttttttgtccaacaaa

SEQ ID NO: 56112 - protein, 104 aa, Zea mays
  misc_feature: Ceres CLONE 1493843
  misc_feature (62)..(62): Xaa is any aa, unknown, or other
  misc_feature (77)..(77): Xaa is any aa, unknown, or other
  misc_feature (80)..(80): Xaa is any aa, unknown, or other
MSPASSMLTAVSLSSPLPAPRLRAAAAASSFAPPRRAAVALVVRAASASSKSPATAESGPEXERGDRHHPAEVRVAXTAXHRGATRVFPATEVLRPLLGLIPGA

SEQ ID NO: 56113 - DNA, 918 bp, Zea mays
  misc_feature: Ceres CLONE 1493869
  misc_feature: Encodes the peptide sequence at SEQ ID NO. 56114
  misc_feature (35)..(35): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
tccactatctttctcaaccctcaactttttttcanaaaatnnnnnnnnnnccaagctggagctccaccgcggtggcggccgctctagaactagtggatcccccgggctgcaggaattcgcacgagaccattacctagaacatcctaatcgaaaaaaccaaaatccaaaaacctcgtcagtttgggaacagcggaaaaccggccccccgcccgcctgctaggtgctagcaacagcagtcgccgccgatgggggtggactactacaaggtgctgggcgtaggccgcggcgccaccgacgacgagctcaagaaggcctaccgccgcctagccatgaagcacccatccccataagaacccctaccgccgcacgccgacccccctcttccaagcacgctctcccaaagccatacgacagcgcctcaagccgacctgcacgaaatacagccttcgtaaggatataggtacgtgtgtagggaaaggccctccaaagggacggggggccggaactacctcccctggtctaccattcctactgccacgcgccgacgcgtgcggccccgtttccgtatcaccccgtgatatacccgcttttaataataacccgcgaagtaggcttacccttaaagtacgggctccctttcctcccgcgcacgaatgatttaccggccctgactctgtcaccacgataatagggagataagggatataaaccgtgggacaacgcccgggatagtaacgggtgactccccccccttccgagggactccgccgcatgactgtgtgtcaatataggcccgtaattccgcggcgtgcctatggagggaaagcacccccccccatactcacgggtcattgtcccccgacatatatatagccgggcccttttcactcgtccgctttctgtgccccactgtacgcg

SEQ ID NO: 56114 - protein, 34 aa, Zea mays
  misc_feature: Ceres CLONE 1493869
MGVDYYKVLGVGRGATDDELKKAYRRLAMKHPSP

SEQ ID NO: 56115 - DNA, 669 bp, Zea mays
  misc_feature: Ceres CLONE 1493870
  misc_feature: Encodes the peptide sequence at SEQ ID NO. 56116
aaagctggagctccccgcggtggcggccgctctagaactagtggatcccccgggctgcaggaattcgcacgagaccattacctagaacatcctaatcgaaaaatcgttctttctttgataaatatatcggaaatttctcaagctttactctagtattcttcagccatgaccgctaagaaagctgtgttgcaattgagtgtccacgatgagagaatcaggaagaaagcgtttgtgaccgtctctcgatctcaaggggtaacttcgataacaatggatgacaaaacagggaaaatgacagtagttggagaagttgatacaccggttctcgtgatgaagctaacgaaactgtgtaatgcaaaaatcgtttcggttgaagttgttaaacggcgtgagaaaaagcctgaaccggcgaaaccggctccagctaaacctgatacggctaaaccggcagaaattgttgcctttccagttacgcatatgaactacccgtaccaatatcattcttcctttgcgaattcccactatcagccatacgggaattctaaagttgtggtggaggaaccaaacacttgtgtgcttatgtgaattaatacaattacctttaaaataattgttagtggttaaatacctacgtttggaagggagagtgtattttttggggaactggat

SEQ ID NO: 56116 - protein, 139 aa, Zea mays
  misc_feature: Ceres CLONE 1493870
  misc_feature (6)..(73): Pfam Name: HMA Pfam Description: Heavy-metal-associated domain
MTAKKAVLQLSVHDERIRKKAFVTVSRSQGVTSITMDDKTGKMTVVGEVDTPVLVMKLTKLCNAKIVSVEVVKRREKKPEPAKPAPAKPDTAKPAEIVAFPVTHMNYPYQYHSSFANSHYQPYGNSKVVVEEPNTCVLM

SEQ ID NO: 56117 - DNA, 666 bp, Zea mays
  misc_feature: Ceres CLONE 1493872
  misc_feature: Encodes the peptide sequence at SEQ ID NO. 56118
ctccccgcggtggcggccgctctagaactagtggatcccccgggctgcaggaattcgcacgagaccattacctagaacatcctaatcgaaaagtcttcgctagggtttttagcccgtataagagccccttcctcactccggaaccccattccccgccgcctcgcgcccccgctcgcttcacttctctaggtgcgcaccgatcagaaggtgcctgcctcctcctcgtcggcgaaaagatggcggtgccgctgctgacgaagaagatcgtgaagaagcgggtcaagcagttcaagaggccccacctcgaccgctacaagtgccttaagccaagctggcgcaggccaaagggtattgactcccgtgtcaggaggaagttcaagggatgcaccttgatgcccaacattggttatggttctgacaagtcgaccaggcactacctccccaacaagttcaagaagtttgtggtccacaacgtttctgagctggagttgctcatgatgcacaacaggacctactgcgctgaaattgctcacagcgtgtccactaagaagcgcaaggagatcgtggagcgtgctgcgcagctcgacattgtggtcacgaacaagcttgctaggctccgcagccagaaggacgagtagtctggtttcttgtcttacgacgaactgg

SEQ ID NO: 56118 - protein, 133 aa, Zea mays
  misc_feature: Ceres CLONE 1493872
  misc_feature (14)..(123): Pfam Name: Ribosomal_L32e Pfam Description: Ribosomal protein L32
MAVPLLTKKIVKKRVKQFKRPHLDRYKCLKPSWRRPKGIDSRVRRKFKGCTLMPNIGYGSDKSTRHYLPNKFKKFVVHNVSELELLMMHNRTYCAEIAHSVSTKKRKEIVERAAQLDIVVTNKLARLRSQKDE

SEQ ID NO: 56119 - DNA, 660 bp, Zea mays
  misc_feature: Ceres CLONE 1493924
  misc_feature: Encodes the peptide sequence at SEQ ID NO. 56120
aaagctggagctccccgcggtggcggccgctctagaactagtggatcccccgggctgcaggaattcgcacgagaccattacctagaacatcctaatcgaaaagctttgtgctattcccgcagccagaaaaccctaacttcccggccgccgctttcctttccctcgatccacagctcgcgccgttcctgcaagtgcgcacccatcgtcccgcctacgcactgccgcccaacgatctacgagctgccatggctaactgtaagggatttccagagcctttcctttgcctcgctctcgtcatctcgtacggttagcgtctcatctcgcgctaaccttgggtctggttggctggcctacagcagcggcaccgggaggaatgaggtcgttcctgcaggccgtgtctacggtcaccgaggaggcgccgacgccactccgcgtcgtccagatggagggcctggctgtactgaagatcatcaagcactgtgaggagtttgcgccagctttagttacaggtcaattgcttggtttggatgttggtagtgttctggaagtgaccaactgttttccgttccctatcagggaagaggatgatgaagcagatgcagatggtgccaattatcagcttgagatgatgaggtgtttgagggaagttaatgttgacac

SEQ ID NO: 56120 - protein, 95 aa, Zea mays
  misc_feature: Ceres CLONE 1493924
MRSFLQAVSTVTEEAPTPLRVVQMEGLAVLKIIKHCEEFAPALVTGQLLGLDVGSVLEVTNCFPFPIREEDDEADADGANYQLEMMRCLREVNVD

SEQ ID NO: 56121 - DNA, 652 bp, Zea mays
  misc_feature: Ceres CLONE 1493932
  misc_feature: Encodes the peptide sequence at SEQ ID NO. 56122
aagctggagctccccgcggtggcggccgctctagaactagtggatcccccgggctgcaggaattcgcacgagaccattacctagaacatcctaatcgaaaaattgccatgccgcctccgctctcgctccgcgtcgccgtcatcggcgcgggagccgcggggctggccgccgcgcgcgagctgcggcgcgaggggccacgtgcccgtcgtgttcgagcgcgcccacgcaatcggtggcacctggctgtacgaccacgacgaccgccaccgctccagcagcctgtacgcgtccctgcgcaccaacctgccacgcgaggtaatgggcttcctcgacttccccttcgccgctgtcccggactccgccgacgcgcgcaggtttcctcggcaccaggaggtgctgcgctacatccaggccttcgcgcgccgattccaccttgacggcctcatccgcctccgcacggaggtgctcgccgtcagcaaggacaacgacgaggggagcagcggcggctggagggtgaggtggcgccggaacgcagccggagacgagtccgagcaggagcaggaggaggtgtttgatgccgtcgtggtctgcaacggacactacacggagccgagaaccgccgccgccgacatccccggcctagacgcctggc

SEQ ID NO: 56122 - protein, 111 aa, Zea mays
  misc_feature: Ceres CLONE 1493932
  misc_feature: SWISSPROT Homolog: EC 1.14.13.8 Flavin-containing monooxygenase
MGFLDFPFAAVPDSADARRFPRHQEVLRYIQAFARRFHLDGLIRLRTEVLAVSKDNDEGSSGGWRVRWRRNAAGDESEQEQEEVFDAVVVCNGHYTEPRTAAADIPGLDAW

SEQ ID NO: 56123 - DNA, 613 bp, Zea mays
  misc_feature: Ceres CLONE 1493937
  misc_feature: Encodes the peptide sequence at SEQ ID NO. 56124
ctccccgcggtggcggccgctctagaactagtggatcccccgggctgcaggaattcgcacgagaccattacctagaacatcctaatcgaaaaattcagccctcccttccttggcttgggccacgtcgccccttctcctccccacacatccatactgaagcctcaaaatcctccgcctcactcccatcccatgccctcctctcaaccctagtccctccccatcccttactcatggcgctctcttcccacgccaccaccgctgctgcggcggcggccgtcggcacctttccccaatccactcgctcctcttcccggcgattccccgcgtcatctgtctccccccggctctcgacgctcccgcgctccctacgcctcgaccatggcgtggggccgtccctctccactcgccacatggccggggcccgacgggctccctccctgcaggccatcgaaacacctggaagggctaggccagcatcccggccgaaacccaacaagggttccgctttggggggggtttttcccccgcggggaaactcgcagggcgggggggggtcccccctttaattttcccccaggggggaggggggggcccccaaaccccttatttggtg

SEQ ID NO: 56124 - protein, 187 aa, Zea mays
  misc_feature: Ceres CLONE 1493937
PRGGGRSRTSGSPGLQEFARDHYLEHPNRKIQPSLPWLGPRRPFSSPHIHTEASKSSASLPSHALLSTLVPPHPLLMALSSHATTAAAAAAVGTFPQSTRSSSRRFPASSVSPRLSTLPRSLRLDHGVGPSLSTRHMAGARRAPSLQAIETPGRARPASRPKPNKGSALGGVFPPRGNSQGGGGSPL

SEQ ID NO: 56125 - DNA, 665 bp, Zea mays
  misc_feature: Ceres CLONE 1493951
  misc_feature: SWISSPROT Homolog: EC 3.1.3.16 Phosphoprotein phosphatase
  misc_feature (288)..(288): n is a, c, t, g, unknown, or other
  misc_feature (311)..(311): n is a, c, t, g, unknown, or other
  misc_feature (345)..(345): n is a, c, t, g, unknown, or other
ctccccgcggtggcggccgctctagaactagtggatcccccgggctgcaggaattcgcacgagaccattacctagaacatcctaatcgaaaaaaacaaaaaggtggcatctttgtgtcaccgaggcaccgccgatcacagaccaaagtccgctcctctggtccatcccaagcgtacagcagccgagatttcttcgatctgcgcttgcgtttttttttcttgtaaagattttagttttccccccttcaactgttgctagccttgagtcgctgagaagtttcgagaaggntggtgtgagtgtcggatagctcnagatggatccggtgttgctggacgacgtcatacnccgggctctgggaagtgaagaattctcaggctggggagaacccgcagctggcaaagtcggaaattaagcaacttctgccttgcccccagggaaattttcttgcagagacccaacttgttggaggtctcaggcccccatcaaaatctggggggagttccatggccggactctggatttcctgggagggttttaaatttggggggtttccccccccaggggccaaaccttttttttgggggaaattttggggacccgggagaaaaaaaccctcaaaaaaacatattttttttttttttgggttacaaaggggaaaacccccc

SEQ ID NO: 56126 - DNA, 652 bp, Zea mays
  misc_feature: Ceres CLONE 1493952
  misc_feature: Encodes the peptide sequence at SEQ ID NO. 56127
ctggagctccccgcggtggcggccgctctagaactagtggatcccccgggctgcaggaattcgcacgagaccattacctagaacatcctaatcgaaaaacacccacacccacacccacccacacaaccgcacctcgcacccattgaccagacggcggcgctcatctcctcccccacggttctccccatcggcctgctggcttctccccggcttccccgatactgatcctcatcactcatgtctgctgaagttgctggaggacacccttatttcctctcgtgctacttctggttcatatactgcataaaattccgagattttacttgatacaagtggaacactcagagttttgtgcgaatacttcctaccatgtgaatcagttgtagctggtgaatttggcaagactcaatttctctcatctgagttcagaaacgtttgcttggtctcctgcttcccttgagtcttgccaaccatagttttctctcatctctttctgtgacttgaccaacatctcttttggtcctgtcagtctcgcaatactcccttccaaagacttgtctagaggttggattgccctgctctctgctggcactgcagcctgctgaagtctttacttgctgcattctgtgctcacctttgaaagctgctctct

SEQ ID NO: 56127 - protein, 29 aa, Zea mays
  misc_feature: Ceres CLONE 1493952
MSAEVAGGHPYFLSCYFWFIYCIKFRDFT

SEQ ID NO: 56128 - DNA, 662 bp, Zea mays
  misc_feature: Ceres CLONE 1493954
  misc_feature: Encodes the peptide sequence at SEQ ID NO. 56129
ggagctccccgcggtggcggccgctctattctagtggatcccccgggctgcaggaattcgcacgagaccattacctagaacatcctaatcgaaaagaggtggcccgcgtgggcgggtacggcgcggtcgtggactggtgggcctacagcgtgttcctgtaccagatcatgtacgggctcaccccgttcgtcggggagagcaatgaggccacgctccgcaacatcgtgcgggggacggtggagttcccggccgccgcgaccacgcacgggggctccgcctgggtgtgcgacctgatcgcgcggctcctggacaaggacccgcgcagcacgctcgggtcgaagcgcggcgctgccgacatgaagggtcacggtttctatcaagggcctgaacttcgcgctgctgtggacgagtcctccgcccgtggtggcgacccccgtcgccccgtacctgtgcgacaaggacgccgacgtgcagcagctgatccatcacttctgagctccgcatctcccgaagtccctataggaatccgtttcagtcaaatgatgtcccgcatatgtcttatcgcttcgtatcgtcgttgatcaactccatcttcaaccggacgaggactgtgggccacgagggactaacctctcctttggtagtccgatcgatgcatgtcc

SEQ ID NO: 56129 - protein, 192 aa, Zea mays
  misc_feature: Ceres CLONE 1493954
  misc_feature: SWISSPROT Homolog: EC 2.7.11.1 Non-specific serine/threonine protein kinase
SSPRWRPLYSSGSPGLQEFARDHYLEHPNRKEVARVGGYGAVVDWWAYSVFLYQIMYGLTPFVGESNEATLRNIVRGTVEFPAAATTHGGSAWVCDLIARLLDKDPRSTLGSKRGAADMKGHGFYQGPELRAAVDESSARGGDPRRPVPVRQGRRRAAADPSLLSSASPEVPIGIRFSQMMSRICLIASYRR

SEQ ID NO: 56130 - DNA, 687 bp, Zea mays
  misc_feature: Ceres CLONE 1493960
  misc_feature: Encodes the peptide sequence at SEQ ID NO. 56131
  misc_feature (253)..(253): n is a, c, t, g, unknown, or other
  misc_feature (347)..(347): n is a, c, t, g, unknown, or other
  misc_feature (388)..(388): n is a, c, t, g, unknown, or other
  misc_feature (392)..(392): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (687)..(687): n is a, c, t, g, unknown, or other
agctccccgcggtggcggccgctctagaactagtggatcccccgggctgcaggaattcgcacgagaccattacctagaacatcctaatcgaaaaacatccaaaattcccagtccgcgatacaagaccaatccaatcccagcggaagtggaagcagtttcatttccttccttgcagctagcagcgatgattcttgtggcgatagtggcggagctgctcgaggagtacaccgcgctggtggcgcgggtgctggancacctgctcaacgacccgccgttctcccgccggatgcgcttcctcatgctgcggagtctccccttcgtgccgccggctctggcccccgccgccncttttttttcccccccccggggggaaaaggaaaggggggtntttncctccctttttccccnnnnncccccccccacaaaaacgccatgttccccccccccgcgggggcgcgggccttgaaagaacctattcctcagaaatctgtggggcggggcggacgggccccaccccgggggggttgctcccctttccctcccgccacggggtgaatacccgcccggcgttccccacacaccctccctacccgcccgaatagaccccaaaataccgcggtacgcgggagtccccccattcggccggccgaaggttttggttgccggaaccccggcactcccgcgcan

SEQ ID NO: 56131 - protein, 93 aa, Zea mays
  misc_feature: Ceres CLONE 1493960
  misc_feature (23)..(23): Xaa is any aa, unknown, or other
  misc_feature (55)..(55): Xaa is any aa, unknown, or other
  misc_feature (70)..(70): Xaa is any aa, unknown, or other
  misc_feature (75)..(75): Xaa is any aa, unknown, or other
  misc_feature (76)..(76): Xaa is any aa, unknown, or other
MILVAIVAELLEEYTALVARVLXHLLNDPPFSRRMRFLMLRSLPFVPPALAPAAXFFSPPRGEKERGVFXSLFPXXPPPTKTPCSPPPRGRGP

SEQ ID NO: 56132 - DNA, 769 bp, Zea mays
  misc_feature: Ceres CLONE 1493964-R2
  misc_feature: Translation starting site: 614
ccactaatattactttatgaaactcacttataagtgcagccaccattgaattcaagctacatgctgttcattctagtcagagttcttggcaaaagtttaacaaaaaagtttcatctcttgaggagcaggcctgatgtagtggtgactggtgagagctgcctcaatgagttaccaggtcgcgggattgaagcagtctctacacattggggggaggcttgcgttggtttatccctcctctcaaccccactcatgtgggatcctctagcactagctctgctctcttgataatagtcatagactcatttgttgtttacattcttccacaataggactaattataatatttatcaccctattaaccctcgcaacattgctaatgtccatctgctgctggtccaggccaattggagccaccagcaccacctctgagctcatccatccactccttgaagaactctggatcataaccgccctcttcatcctcctcccggtcaggaatgccttcttcaaatcccccttcctccatagcatcaatggtggactctgtaggccctgtcaccacatccttgtttggcttagtaactgctggcgtgtggccttcaaagagcgctagatgaccgaagagcttgtccttgcgggagaaggtggtgccgcaggagcagcgccactgtgcctcctcgccgcagtggcggatgtggctgcggaggtccgccaggacagcgaagcgcttcttgccgccacatcgctcgcaggcgtagagcttggggca

SEQ ID NO: 56133 - DNA, 787 bp, Zea mays
  misc_feature: Ceres CLONE 1493964-R
  misc_feature (762)..(762): n is a, c, t, g, unknown, or other
cgaattgggtaccgggccccccctcgaggtcgacggtatcgataagcttttttttttttttttttcagataaaacctactaaatattactttatgaaactcacttataagtgcagccaccattgaattcaagctacatgctgttcattctagtcagagttcttggcaaaagtttaacaaaaaagtttcatctcttgaggagcaggcctgatgtagtggtgactggtgagagctgcctcaatgagttaccaggtcgcgggattgaagcagtctctacacattggggggaggcttgcgttggtttatccctcctctcaaccccactcatgtgggatcctctagcactagctctgctctcttgataatagtcatagactcatttgttgtttacattcttccacaataggactaattataatatttatcaccctattaaccctcgcaacattgctaatgtccatctgctgctggtccaggccaattggagccaccagcaccacctctgagctcatccatccactccttgaagaactctggatcataaccgccctcttcatcctcctcccggtcaggaatgccttcttcaaatcccccttcctccatagcatcaatggtggactctgtaggccctgtcaccacatccttgtttggcttagtaactgctggcgtgtggccttcaaagagcgctagatgaccgaagagcttgtccttgcgggagaaggtggtgccgcaggagcagcgccactgtgcctcctcgccgcantggcggatgtggctgcggaggtccc

SEQ ID NO: 56134 - DNA, 637 bp, Zea mays
  misc_feature: Ceres CLONE 1493965
  misc_feature: Encodes the peptide sequence at SEQ ID NO. 56135
  misc_feature (442)..(442): n is a, c, t, g, unknown, or other
ggagctccccgcggtggcggccgctctagaactagtggatcccccgggctgcaggaattcgcacgagaccattacctagaacatcctaatcgaaaaatcctattctcgcgcccggcgtctcccttctccaacctccgtttctaatccgcgctgctaatcccactcccagtcccagctcgtccgctgagatggacagtagcagcctcaaatccgcgcagctcctggagctgatgcgccagcacctggccaccgatgccggcaaggaggtcaccaagaaggtcggcctcgtctaccagctcaacatcgcccccaagaagatcggcgttgatgaggagatcttcgtggtcgacctcaagaagggcgaggtcaccaaagggccgtaccagggaaagccggatgccactttctccttcacggacaacgatttccttggaaatcgcanccggcagacgaatccgcagattgcattcattcgaggggcgattaaaatcaaggggagcatcagtgcggcgcagaaagttcaccctgacatcttccccaagcctgcttagctgtagaaaggtccacatgatgaattggcaggcattgaaaccccgttgttggccttcttcaacctttcaggggattccaacgggag

SEQ ID NO: 56135 - protein, 120 aa, Zea mays
  misc_feature: Ceres CLONE 1493965
  misc_feature (12)..(117): Pfam Name: SCP2 Pfam Description: SCP-2 sterol transfer family
  misc_feature: SWISSPROT Homolog: EC 2.3.1.176 Propanoyl-CoA C-acyltransferase
  misc_feature (85)..(85): Xaa is any aa, unknown, or other
MDSSSLKSAQLLELMRQHLATDAGKEVTKKVGLVYQLNIAPKKIGVDEEIFVVDLKKGEVTKGPYQGKPDATFSFTDNDFLGNRXRQTNPQIAFIRGAIKIKGSISAAQKVHPDIFPKPA

SEQ ID NO: 56136 - DNA, 658 bp, Zea mays
  misc_feature: Ceres CLONE 1493984
  misc_feature: Encodes the peptide sequence at SEQ ID NO. 56137
  misc_feature (393)..(393): n is a, c, t, g, unknown, or other
  misc_feature (394)..(394): n is a, c, t, g, unknown, or other
  misc_feature (396)..(396): n is a, c, t, g, unknown, or other
  misc_feature (397)..(397): n is a, c, t, g, unknown, or other
  misc_feature (399)..(399): n is a, c, t, g, unknown, or other
  misc_feature (411)..(411): n is a, c, t, g, unknown, or other
  misc_feature (421)..(421): n is a, c, t, g, unknown, or other
  misc_feature (422)..(422): n is a, c, t, g, unknown, or other
agagctggagctccccgcggtggcggccgctctagaactagtggatcccccgggctgcaggaattcgcacgagaccattacctagaacatcctaatcgaaaaaccaaagatttactcaatttatcccagacgagacacacactcgcaacgaccggaccgtcgaatctctcgactccggcgacatgtcgacggcggtggcagaggtgcggccgccctacgggttccccggatccgggaaggggagcggcggcgggtatgggaaggaggcgcacttggccgcggccgggaagaggaggagcgacggcttcttcatagaggaggaggaggttgaagaagacgtgctgactgacaactcgtcgatttggcgcaccctctccgtgggggggggggacnntnnanaactcctccccnaacgcccgcnngaacaaccgggagaaggagtcctacgcgaacgttcaggtaggtcaatttcttccggctgcttggaccccctccaaggacccttcgcggataaagaggggcttctccgagtttctcccccggcggaacttaagctgtttctccaccttcgccgaggccccgctgggccgcggtgcgctcgcccccgaaggggcttggacattggggcgtaaccgccttcaaacagggccgcgccccg

SEQ ID NO: 56137 - protein, 149 aa, Zea mays
  misc_feature: Ceres CLONE 1493984
  misc_feature (71)..(71): Xaa is any aa, unknown, or other
  misc_feature (72)..(72): Xaa is any aa, unknown, or other
  misc_feature (73)..(73): Xaa is any aa, unknown, or other
  misc_feature (77)..(77): Xaa is any aa, unknown, or other
  misc_feature (80)..(80): Xaa is any aa, unknown, or other
MSTAVAEVRPPYGFPGSGKGSGGGYGKEAHLAAAGKRRSDGFFIEEEEVEEDVLTDNSSIWRTLSVGGGDXXXLLPXRPXEQPGEGVLRERSGRSISSGCLDPLQGPFADKEGLLRVSPPAELKLFLHLRRGPAGPRCARPRRGLDIGA

SEQ ID NO: 56138 - DNA, 712 bp, Zea mays
  misc_feature: Ceres CLONE 1493995
  misc_feature: Encodes the peptide sequence at SEQ ID NO. 56139
  misc_feature (343)..(343): n is a, c, t, g, unknown, or other
  misc_feature (352)..(352): n is a, c, t, g, unknown, or other
  misc_feature (677)..(677): n is a, c, t, g, unknown, or other
  misc_feature (678)..(678): n is a, c, t, g, unknown, or other
aagctggagctccccgcggtggcggccgctctagaactagtggatcccccgggctgcaggaattcgcacgagaccattacctagaacatcctaatcgaaaagctagggttctcatcctgccgccacagcgatggccgctgccgccgccggcgaggacgacgctgcgtgggagcgcgccatctccgccgccaccaagtccacctcggcgcccaagaccctcaccctcgacggcgccgtcaagtcctccacgggcggcctcccctccgccgcgctcctcgagcgcttcgccgcctccctcgaggagctctccgtcgcgggggcgcgccctctctcgctcgggggnctggcccgnctcccggggctcgggggcctctccctcccggaaaacggcttttggggggcgcggccctcccccctgtccccagggatggggggccccccttgcccccttaacctagggaacaccggtccgggaggccagagatcccccccccccccggggggcggggggaggtcctacactttttctaggcccccccccacaaaaaagggggacggggaaaaagttttctccgtatttccccccccccaaacaccctgggggctcaccacaagagaaaaaactttttttgaggaaaagccccccccccaagggggggcccccaagggggagaaanncccccgcgcgggggggagaaggagttgtttattt

SEQ ID NO: 56139 - protein, 194 aa, Zea mays
  misc_feature: Ceres CLONE 1493995
  misc_feature (183)..(183): Xaa is any aa, unknown, or other
MAAAAAGEDDAAWERAISAATKSTSAPKTLTLDGAVKSSTGGLPSAALLERFAASLEELSVAGARPLSLGGLARLPGLGGLSLPENGFWGARPSPLSPGMGGPPCPLNLGNTGPGGQRSPPPPGGGGRSYTFSRPPPTKKGDGEKVFSVFPPPQTPWGLTTREKTFFEEKPPPQGGAPKGEKXPRAGGRRSCLF

SEQ ID NO: 56140 - DNA, 651 bp, Zea mays
  misc_feature: Ceres CLONE 1494005
  misc_feature: SWISSPROT Homolog: EC 1.1.1.42 Isocitrate dehydrogenase (NADP(+))
gcggtggcggccgctctatttctagtggatcccccgggctgcaggaattcgcacgagaccattacctagaacatcctaatcgaaaagaagaaatatgatggcaggttctaggacattttccaggaggagtatgaagctggttggaaaaccaaatttgaagctgctggcatatggtatgagcaccgccttatcgatgacatggtaccatacgcccttaagactgaaggagggtatgtctggacttgcaagaattatgatggagatgtgcagagcgatttcttagctcaaggttttggctcattgagtttgatgacttcggcactggtgtgccctgatggaaagacgatcgaagctgaagctgcccatggtactgttacccatcattaccgtgttcaccataaaggaccccccactcgtacgaacagtattgcctccatctttgcgtggacaagaggactagcacacagcgcaaagcttgatgacaatgctagactacttgacttcacccagaagcttgaagctgcctgctttggaaccgtcgagtctgggaaaatgaccaatgaccttgcccttctcgttcacgaatcttcaaatatcacgaggagccattaccctaaccacggaggagtttcattgcccctgtttgctgat

SEQ ID NO: 56141 - DNA, 588 bp, Zea mays
  misc_feature: Ceres CLONE 1494006
  misc_feature (198)..(198): n is a, c, t, g, unknown, or other
aagctggagctccccgcggtggcggccgctctagaactagtggatcccccgggctgcaggaattcgcacgagaccattacctagaacatcctaatcgaaaacttttgcaaaccctgctccaactccgattcgtcactccaccctcgtcgcgccgccgccgccgccgccgcctggcgcgtccccggccagcctcgcggnccgggtgtctgctagccacagcggaagagaccaggagtcatggtgatcccttcaccaaccaagggcaacctggagtcacccgtttcctcaagccccacctatggagatgcatttccaaaacaattttgatttgctcaagtggcccaaacccaaaaaaaatgttgattttttgcaactccaaaaaaaactttttaaacaaaatggggccaaccgggaacccccaccacttcaaaaattaaaaattttttggaaaacctttctccaaaggaaaaccccgggggccccccccctgaaaagaaaaaaaaccccccggaaaaaaaaaggtgttttttttttttttaaaaaaaagggggaaactgttttgttttttctttttaaaacaactgcttt

SEQ ID NO: 56142 - DNA, 660 bp, Zea mays
  misc_feature: Ceres CLONE 1494039
  misc_feature: Encodes the peptide sequence at SEQ ID NO. 56143
ctaagctggagctcaccgcggtggcggccgctctagaactagtggatcccccgggctgcaggaattcgcacgagaccattacctagaacatcctaatcgaaaaatacgccgccatcttcgcaagccaccgcaaccgaagcccgccttcgccgccgccgcctctgcgatccccgcaaggtcgcaaacatgtctaccgtgctccagcgcccgacccccggcacggtccagtgcttcggccgcaagaagacggctgtggccgtcgcctacaccaagccggggcgcgggctgatcaaggtgaacggcgtcccgattgagctcatcaggccggagatgctccgcctcaaggccttcgagcccatcctgctggcggggcgctccaggttcaaggacatcgacatgaggatccgcgtccgaggcggccggaagacgtcgcaaatctacgccattcgccaggccgtcgccaaggggctcgtcccctactacccgaagtacgtcgacttaggccgccaagaaggagggcaaggaaatcttcacccgggacgaccgcacccttctcgtcgcctaacccaagggctattagcccaaaaaggtctggtgggcgcgggcccccgcgccaagtttccagaaagtccaaccttttgaaccgctcgcgctcccctc

SEQ ID NO: 56143 - protein, 151 aa, Zea mays
  misc_feature: Ceres CLONE 1494039
  misc_feature (17)..(125): Pfam Name: Ribosomal_S9 Pfam Description: Ribosomal protein S9/S16
MSTVLQRPTPGTVQCFGRKKTAVAVAYTKPGRGLIKVNGVPIELIRPEMLRLKAFEPILLAGRSRFKDIDMRIRVRGGRKTSQIYAIRQAVAKGLVPYYPKYVDLGRQEGGQGNLHPGRPHPSRRLTQGLLAQKGLVGAGPRAKFPESPTF

SEQ ID NO: 56144 - DNA, 673 bp, Zea mays
  misc_feature: Ceres CLONE 1494043
  misc_feature (669)..(669): n is a, c, t, g, unknown, or other
atagctggagctccccgcggtggcggccgctctagaactagtggatcccccgggctgcaggaattcgcacgagaccattacctagaacatcctaatcgaaaaacgacgctgccgccacctatctcaacgaagctttttcttccctccggtgtggatccacactcttcatgcgctggttcgtgttttggatcttcccttgcgttttccttatttgcggtgttctctttttgaccggggatttgggatccgtctttggttgaggacgatgaagattgtatctataggtctcgttcgtcgtaactggcatctgattggattgccttgccgaccatcctgatatatcaccacccatattccgagtccgctgcctacagtcctcagtccccatcgagattttcttatctatttagcctttgttccatgatttactactattgttttctggccgatgattaaatcaaaaaaatagacaagcatatgtccgaatccatctatgtggataagcctaatcttctctatgaggtcgaccgcatcttctaggtttactgtttttttttcatttgatcttattttgattcatctaggggcctaagacgaaatatatggatgctatttttgtatgatatattttgattacaaaaccatttctgccttccctctgaggccctnctca

SEQ ID NO: 56145 - DNA, 607 bp, Zea mays
  misc_feature: Ceres CLONE 1494046
  misc_feature: Encodes the peptide sequence at SEQ ID NO. 56146
atagctggagctccccgcggtggcggccgctctagaactagtggatcccccgggctgcaggaattcgcacgagaccattacctagaacatcctaatcgaaaattatctctgcgcgcgctgcatcggcgcccaccgggaggcggatcccgcccgcctcgtccatgccgtgggtccgcaatctccgccgcttcgtcgacacgggcgttggcctcggatccgaggccctcatggaactggagactaaaaggatattgcttgggattttcaaggagcggcagcggaagagtgccgaggctggttccatcccaagtttttacaagaagaaacctgaagaaggatccatctagctctagagttcaaaagggttggccaaagtacagggttttctaaaaggaacccatccgaagactcccgcccgaaaaggcctaaaaaacccctgaatagccccttgtgggggtttttgttccccaaaaaaaaaaaaaagggggggttttttctagaagaaagaccccccccgggggggggcgcttaaaaaaaaaaaaaaaaaatttttttaaaaaaaattttttttttccgccccattatattcccccccccctgtggtggg

SEQ ID NO: 56146 - protein, 61 aa, Zea mays
  misc_feature: Ceres CLONE 1494046
MPWVRNLRRFVDTGVGLGSEALMELETKRILLGIFKERQRKSAEAGSIPSFYKKKPEEGSI

SEQ ID NO: 56147 - DNA, 834 bp, Zea mays
  misc_feature: Ceres CLONE 1494049
  misc_feature: Encodes the peptide sequence at SEQ ID NO. 56148
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (834)..(834): n is a, c, t, g, unknown, or other
ggggagaaagtcactcggggcagaggggggggggggggnnnnnnnnnnntggnnnnnntcaaaaactggagctccccgcggtggcggccgctctagaactagtggatcccccgggctgcaggaattcgcacgagaccattacctagaacatcctaatcgaaaaactcttcgtgctcctcgatcgtcccaacaaccgcaatggcgcagcagaggcttctcgctctcctcctggtggcgggcctcctcgcgctctccttctcgcaagggcaggtggaagcgcggaaggtgcaggtgcggcgcgcgcccctcggcggcgggggccacctgcttccggaggcgatgatggcgtacacgacgacggactacgggccccccaggggcggcgggggaaggggggagggaaatggggggcgtcgacgggaaggaacccttccctcaccgcgcgacggggggggggggggcgggaacaaaatctaagggggggggaagacgacccaggtggggggggggggggggggggactttcttcttgtaggtcgacacggtgcgggaacggataaccaggagatggagacgcgggggcgggggggcctgctgtccggggaagggggcgggggggcggagaaagaggtgggggggcaacacgctgggcgggccgggggccacgcacccccccgcgatgtggggcgtgctcggggggcgggttgtaactacaaaggatcgtggtgtcgtatgatgtgggggatcgggagggtgcagattcagatgtgtctctatctgcactatcggaggtgggcgagatggggggcgcacatacaacatcgtctcacgcan

SEQ ID NO: 56148 - protein, 92 aa, Zea mays
  misc_feature: Ceres CLONE 1494049
MAQQRLLALLLVAGLLALSFSQGQVEARKVQVRRAPLGGGGHLLPEAMMAYTTTDYGPPRGGGGRGEGNGGRRREGTLPSPRDGGGGGGNKI

SEQ ID NO: 56149 - DNA, 660 bp, Zea mays
  misc_feature: Ceres CLONE 1494066
  misc_feature (215)..(215): n is a, c, t, g, unknown, or other
  misc_feature (216)..(216): n is a, c, t, g, unknown, or other
  misc_feature (236)..(236): n is a, c, t, g, unknown, or other
  misc_feature (257)..(257): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (264)..(264): n is a, c, t, g, unknown, or other
  misc_feature (265)..(265): n is a, c, t, g, unknown, or other
  misc_feature (267)..(267): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (276)..(276): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
cttagctggagctcaccgcggtggcggccgctctagaactagtggatcccccgggctgcaggaattcgcacgagaccattacctagaacatcctaatcgaaaaaccgatcccctcacccccaccggcggcgcacagcccgacgacccgagcgatcctgcggaggcggcagccatggtgcacgtcaacttctaccgcaactatggaaagaccgttnncaaggaagccaaggcgtccngtatgaagaatggagcggttncnnnttnntntnnnnnggngggnnnnnnnnnnggggcgggggtggttttgttttcttttcctggtctgttttttttccccggttgggtgcgcgggctccggccggggtcgcgcgggggggcgggggcgccggcccgcgttgtggtccgtggctgctcctcgcgtgctcctggcggtgtgcaccccgccattcggggtgggtgccccgccttctccttcttccttctgttcccgttgtgtgcttgtggtcccccccctctgccgcttccgttccccccgtcctcccctactcctttgtgttgttgtgggtttctcgggccctctccccctccgccctttcgctggcgtgcgccggtgctgtatttcgtttttgttgttcgtttaccttccatcgggcgttcact

SEQ ID NO: 56150 - DNA, 692 bp, Zea mays
  misc_feature: Ceres CLONE 1494080
  misc_feature: Encodes the peptide sequence at SEQ ID NO. 56151
  misc_feature (418)..(418): n is a, c, t, g, unknown, or other
  misc_feature (592)..(592): n is a, c, t, g, unknown, or other
gaaagctgaagctcaccgcggtggcggccgctctagaactagtggatcccccgggctgcaggaattcgcacgagaccattacctagaacatcctaatcgaaaaaccacgcaaaaaacaaacacactcgaaggcagcgaagcccgagccttcccttccctccaatcgatcacccgctccgatccgctagctagctagcagcgcgatggcttccctcaccgtgtccacgaagaccgcggcggccggcggcaacaagcagcgcgagggcgcggaggtcatcacgggcgcggaggcctgcttcgcgcactccaagcagatgctccaggcgctgggcttcccgggcggcgtgatgccagctgcgggggctgtgtgagtgaaacaggaaaaaaaaaaaaccaaatctataaaacccccaaaaancccgccccccggctatttttttcttgatgctatgatcgagtgaggatttacgacgctctacagtcacactcgtcgtcgcatcaccggcccgagtgtaggcttatggccgggcggctttgcatttacggtctccatcgtatgtgtctctcggtctgtattccttctcggatcaancaagtcggcgttggtaggagggtggtgtgggcatccgccggcgacgaaggatctgcgcttcacaaggagcgttactggggatagtagctcgggtcctgtg

SEQ ID NO: 56151 - protein, 55 aa, Zea mays
  misc_feature: Ceres CLONE 1494080
MASLTVSTKTAAAGGNKQREGAEVITGAEACFAHSKQMLQALGFPGGVMPAAGAV

SEQ ID NO: 56152 - DNA, 682 bp, Zea mays
  misc_feature: Ceres CLONE 1494082
  misc_feature: Encodes the peptide sequence at SEQ ID NO. 56153
aaagctggagctcaccgcggtggcggccgctctagaactagtggatcccccgggctgcaggaattcgcacgagaccattacctagaacatcctaatcgaaaaatggctggtgcatcgctcctctccccatcctgcacgctcctccgcctgattcccagcgcgtcgcacttcaagagattcgatcgggttcgccgtttcgcgcccgccgccatggcgacttcctcaggaccaaaggaggcgccagcgaataaccctgggctccagaccgaggtcgaccccgccaccaaaggctacttcttgcaacaaacgatgttacgtgtgaaggacccaaaagtgagccttgacttctactcacgtgtgatgggcatgtcgttgctgaaaaggttggattttgaagagatgaaattcagtttgtattttctaggttacgaggatgtgaccttagcgcctgatgatcatatcaagcggactgaatggacttttaggcaaaaagctactcttgagctcacccacaactggggcacggaaaatgaccctgaattccaaggttaccataatgggaactcagaccctcgtggtttttggtcatatagggagtaactgtggaagatgttcaacaaggcattgtgaacgcttttgaacgtcctgggggtctaaggtttgttgaataaacccggatgaa

SEQ ID NO: 56153 - protein, 129 aa, Zea mays
  misc_feature: Ceres CLONE 1494082
  misc_feature: SWISSPROT Homolog: EC 4.4.1.5 Lactoylglutathione lyase
MATSSGPKEAPANNPGLQTEVDPATKGYFLQQTMLRVKDPKVSLDFYSRVMGMSLLKRLDFEEMKFSLYFLGYEDVTLAPDDHIKRTEWTFRQKATLELTHNWGTENDPEFQGYHNGNSDPRGFWSYRE

SEQ ID NO: 56154 - DNA, 658 bp, Zea mays
  misc_feature: Ceres CLONE 1494090
  misc_feature: Encodes the peptide sequence at SEQ ID NO. 56155
caaaagctggagctccccgcggtggcggccgctctagaactagtggatcccccgggctgcaggaattcgcacgagaccattacctagaacatcctaatcgaagaactcatctatttcttttgaatcattgtatactagctagctagctagccagagcttgtatggccactgctcatcatgcggatgaccatcgtgcagggagaagaagcgaggccgtcggagagaactacatgaggggcctctacggcgacgatgactacaacgccacccactacggtcaccagcagcagcagcggccgccgcccgcgcccatggcggtggccaaggcgttagccacagccacggcagccttctccatgttgttgttgtcggggctggcggtgacgggcacggtgctggcgctcatcgtggcgacgccattgatggtgatcttcagccccgtgctggtgccggcggccatcacggtggcgctgctcgcggtaggcatcgtttcgaccgggagggttctgggtggctgccgaggctggtctggcttgggctctcccgctaccctcggacccgaactccgccttcgggtcaccgccccacatcgtcaaggactgggccctaccaccccctccggaacaaaaacccctcccctggaaataaaaaaataacc

SEQ ID NO: 56155 - protein, 164 aa, Zea mays
  misc_feature: Ceres CLONE 1494090
  misc_feature (49)..(151): Pfam Name: Oleosin Pfam Description: Oleosin
MATAHHADDHRAGRRSEAVGENYMRGLYGDDDYNATHYGHQQQQRPPPAPMAVAKALATATAAFSMLLLSGLAVTGTVLALIVATPLMVIFSPVLVPAAITVALLAVGIVSTGRVLGGCRGWSGLGSPATLGPELRLRVTAPHRQGLGPTTPSGTKTPPLEIKK

SEQ ID NO: 56156 - DNA, 655 bp, Zea mays
  misc_feature: Ceres CLONE 1494092
  misc_feature: Encodes the peptide sequence at SEQ ID NO. 56157
caagctggagctcaccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgatgccagcttgagcgtgcccgctgccgccagcagcaagcctggtccaacccagctttgattgcaccaacaaccagcagcttgtttgggaacccaaggggtctccaaccccctttggcccatttatttatgggggcccataaaatttccgcgccccttggttgtggactc

SEQ ID NO: 56157 - protein, 110 aa, Zea mays
  misc_feature: Ceres CLONE 1494092
MKMVIVLVVCLALSAASASAMQMPCPCAGLQGLYGAGAGLTTMMGAGGLYPYAEYLRQPQCSPLAAAPYYAGCGQPSAMFQPLRQQCCQQQMRMMDVQSVAQQLQMMMPA

SEQ ID NO: 56158 - DNA, 649 bp, Zea mays
  misc_feature: Ceres CLONE 1494097
  misc_feature: Encodes the peptide sequence at SEQ ID NO. 56159
aaagctggagctccccgcggtggcggccgctctagaactagtggatcccccgggctgcaggaattcgcacgagaccattacctagaacatcctaatcgaaaagttcgaggaggtgaggaagcacagcgaccgcaaggactgctggctcatcatcgccggcaaggtacgtatatttcgtcaccggccgacgatcgactccgaccgtgtttgacgcccccggcctcgctcctgctgctgctgctctgctcaggtgtacgacgtcacgccgttcatggaggagcaccccggcggcgacgaggtcctgctggcgtccgtcggcaaggacgccaccgcggacttcgaggacatcggccacagcgcctccgccaaggagctcatgccccagtactgcatcggcaaggtcaacgcggctaccttcccggccaagcccgcctacgtcgtcaccaaggacgacgccaggtcgtccgagaaggccgcgacgagcgccggcgcttgggccacgctcctgcagctcgccgcgcccgtcctgctgctggcgctggccttcgcgctgcagcagaactatgccagggccaaggcggagtagacaagatacagatagataccatcgttgattccgctgagtcgcggccgtgcggcctctttggaa

SEQ ID NO: 56159 - protein, 104 aa, Zea mays
  misc_feature: Ceres CLONE 1494097
  misc_feature: SWISSPROT Homolog: EC 1.7.1.3 Nitrate reductase (NADPH)
MEEHPGGDEVLLASVGKDATADFEDIGHSASAKELMPQYCIGKVNAATFPAKPAYVVTKDDARSSEKAATSAGAWATLLQLAAPVLLLALAFALQQNYARAKAE

SEQ ID NO: 56160 - DNA, 662 bp, Zea mays
  misc_feature: Ceres CLONE 1494099
  misc_feature: Encodes the peptide sequence at SEQ ID NO. 56161
aaaactggagctccccgcggtggcggccgctctagaactagtggatcccccgggctgcaggaattcgcacgagaccatttcctagaacatcctaatcgaaaaaaggaaacagtcacgtctcccagatctaactgccccccgactcacgaatcccaaagcctccatggcgacgcaccgccactgccttccactcctcctcctcgtggccgccgccctcgccgccgtccctgctcgcgcggcgctgggcggcgggcgcggcccgctgctgggcgggtggaacccgatccctgacgtgagcgactcgcacatccaggagctaggcgggtgggcgctggggcaggcgaagcaccagaagctggccgccgacgggctgcggttccaccgcgtggtgcgcggcgagcaacaagtcgtgtccgggatcaactaccgcctctacgtcgacgccgccgaccccgccggccgcaccgtgccctacgtcgccgtcgtgtacgagcaagtctggacccgcacccgccagctcgcctccttcaacccggtgccccgcgcccactgaaaccatacgcacacgggtgggcccaaagcgacgttctccgtcaattacgtgccgagctaaccctattgattggttccattaatcataaaaaggttcccccctgttccta

SEQ ID NO: 56161 - protein, 129 aa, Zea mays
  misc_feature: Ceres CLONE 1494099
MATHRHCLPLLLLVAAALAAVPARAALGGGRGPLLGGWNPIPDVSDSHIQELGGWALGQAKHQKLAADGLRFHRVVRGEQQVVSGINYRLYVDAADPAGRTVPYVAVVYEQVWTRTRQLASFNPVPRAH

SEQ ID NO: 56162 - DNA, 675 bp, Zea mays
  misc_feature: Ceres CLONE 1494105
  misc_feature: Translation starting site: 197
atagctggagctccccgcggtggcggccgctctagaactagtggatcccccgggctgcaggaattcgcacgagaccattacctagaacatcctaatcgaaaaccttcgcctaccccagccagccaggaatcgccaccggcggaagccaagcatcgtcccagcaccggatcgattccgcccgcccgcccgcccgtccatggatccggcggccgagccggcggcgtggccgccgtggacgtcgctcctgctgcgggcgctaaaccggcagcggacctgggtggagctcttcctcgccgtctacgccgggctgctctcgtcctcctggtccctgctcgcctccgtccgcgcctggtactactccgcctcctcggcgtccgcggcgcccgcctggaccgccgcgctctacgcctccgtcatgtacggcgccgtgttcggcctgctctccatggacgccgcgctcgccgtcgccgcgcccgccatgctcgtcacctggaccaccgtcctcgtgctgctcgccttcgcgggccgcccgcgcaggtcactcgtcaccgagggccgccgcgccaccatggacatcgcgggcctcgcgctccgcgtactcctgcgcgaaggctacgccgtctccgcgctctgtgccgccgccagctttgccgcgctcctcctcggccatcgcgg

SEQ ID NO: 56163 - DNA, 657 bp, Zea mays
  misc_feature: Ceres CLONE 1494114
  misc_feature: Encodes the peptide sequence at SEQ ID NO. 56164
atagctggagctccccgcggtggcggccgctctagaactagtggatcccccgggctgcaggaattcgcacgagaccattacctagaacatcctaatcgaaaaattcccacccgtccatccatcctccgaagctcctcggcagacaagcagcagcgagagaaagcaagcaaggcagaggcagttgtgttgctggtcggtccgtccatggcgcccaagagaccagtgtcggcggcggcggcagcggagcagccgaggctgcacggcgtgcggaagcggccgtggggccggtacgcggcggagatccgcgacccggtgcggaaggcgcgcgtgtggctgggcaccttcgacacgccggagcaagcggcgcgggcgtacgacgccgccgcgcgcaagctccgcgggcccggtgccaccaccaactaccccgccccggatccgacggcagatgcgttggcggacgctccagcggcgagcgggagcgggagcaccgtggtgtacgagtcgtcgtcggcgtctgcgtcggcgtcttcgtgctccctgccgctggcggccccgtcgctggacctcagcctggcgctgccggctgcggaggcgtgcccaaatccctaccatctgttcgcggaccgggcgcggctggctccgtgactccgggactgt

SEQ ID NO: 56164 - protein, 146 aa, Zea mays
  misc_feature: Ceres CLONE 1494114
  misc_feature (16)..(67): Pfam Name: AP2 Pfam Description: AP2 domain
MAPKRPVSAAAAAEQPRLHGVRKRPWGRYAAEIRDPVRKARVWLGTFDTPEQAARAYDAAARKLRGPGATTNYPAPDPTADALADAPAASGSGSTVVYESSSASASASSCSLPLAAPSLDLSLALPAAEACPNPYHLFADRARLAP

SEQ ID NO: 56165 - DNA, 865 bp, Zea mays
  misc_feature: Ceres CLONE 1494118
  misc_feature: Encodes the peptide sequence at SEQ ID NO. 56166
  misc_feature (13)..(13): n is a, c, t, g, unknown, or other
  misc_feature (22)..(22): n is a, c, t, g, unknown, or other
  misc_feature (24)..(24): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (497)..(497): n is a, c, t, g, unknown, or other
  misc_feature (865)..(865): n is a, c, t, g, unknown, or other
gggggagagggcngggctaatncnggaacaaacaggtggttggggnnnnnnggggnnnnnaaaaactggagctccccgcggtggcggccgctctagaactagtggatcccccgggctgcaggaattcgcacgagaccattacctagaacatcctaatcgaaaaacacaaagaagctccataattaattattgccctttcgattcgccatcggaagccgagcaccatgatgtccacaggcggcgacgatggggccaagaaatcttggccggaagtggccggggtctgcccggcaagagccaagagggtgatcctgtgggacgaggccaacgccgacaacggcgtgctcgccgatggcacaccggggaccacgggggttccgctcctgggcgggtgcggggtgtaggagtaaaaccggtccggaagaaaccccacacaccccccgaccaaccgaacgcccaaagaactcgaagatattgggggagcatgacggatcacncacacaccccccccccccccccacaaaacgtggggaggggcggggtagcctgcctgtccccacggagaaaccacccccgcgctgggagcacggattggggcgactcggacggggtgattgcgaaggagggtgggcaaggcgacatgcagcaaacaggggcgcaatatcgaggtcacacattcacggccgacacggggaagaaaggggtgcctgcggtcgcgacttgtgcgtggtgtgtacaggaattaaagacgtccaacagatcggtcacccaacccgggctgcgaacctcggtagggcggggcgggcttctgcggcgaccgtattactgaccaggcgggcgggacgaacaccaccgtccgtctccn

SEQ ID NO: 56166 - protein, 59 aa, Zea mays
  misc_feature: Ceres CLONE 1494118
MMSTGGDDGAKKSWPEVAGVCPARAKRVILWDEANADNGVLADGTPGTTGVPLLGGCGV

SEQ ID NO: 56167 - DNA, 653 bp, Zea mays
  misc_feature: Ceres CLONE 1494123
  misc_feature: Encodes the peptide sequence at SEQ ID NO. 56168
atagctggagctccccgcggtggcggccgctctagaactagtggatcccccgggctgcaggaattcgcacgagaccattacctagaacatcctaatcgaaaactttttctatatcgcgttacgtccctccctacccagcgatctaggccgccgcctctcctactgcatctccctcgctctcgtcgcctcgttcgcttcgcctcctccccgccccgccccgagccgagcagagcgcagccctatccggagctgggatggcggacgcgaagcagcagcagcagcagccacagcaggcggcagcggcagccaccggcgtgtggaagacggtcaagcccttcgttaacggcggggcctctgggatgctcgcgacctgcgtcatccagcctatcgacatggtcaaggtaccgtaccaccgcaccgctctgtcacccggcttccttcacagtgctcgtgagtgagctggtgaggcgggatcggagcgtggcgggcttagatctacgggaatggggttgcttgccgcgtgaatcagtcggttagatgcttacccgcggagtttgcccctttttggttggatctgatgaatcgagcgtgcccttggggtcagcgtagtggaactaagcttgctgttaagtattttggtgcagctagcttta

SEQ ID NO: 56168 - protein, 67 aa, Zea mays; identical to SEQ ID NO: 48409
  misc_feature: Ceres CLONE 1494123

SEQ ID NO: 56169 - DNA, 670 bp, Zea mays
  misc_feature: Ceres CLONE 1494128
  misc_feature: Encodes the peptide sequence at SEQ ID NO. 56170
  misc_feature (670)..(670): n is a, c, t, g, unknown, or other
aaagctggagctccccgcggtggcggccgctctagaactagtggatctcttgggctgcaggaattcgcacgagaccattacctagaacatcctaatcgaaaaacaaagaagctccataattaattattgccctttcagttcgccatcggcagccgagcaccatgagctccacaggcggcggcgacgatggcgccaagaagtcttggccggaagtggtcgggctcagcctggaagaagccaagagggtgatcctgtgcgacaagcccgacgccgacatcgtcgtgctgcccgtcggcacgccggtgaccatggatttccgccccaaccgcgtccgcatcttcgtcgacaccgtcgcggaggcaccccacatcggctgaggtttaaatctacaaaatgaatgactcggacatgccatccccacctgtccgtcgccgaataatggatgggtgggtgcttcgatcgttcctataagttgctagtaaaaataatggcctcgtcgttatgcatgaataaaaaggatcagattaaggtcccccctttcacgagtggaaatatgaaaatgtcctcgatcaggtgtttgggtttcccgaaaaaaaaaaaaaaaaacctattccatacccggccaccctcgagggggggcccccgggccccatttccccccctatggggn

SEQ ID NO: 56170 - protein, 71 aa, Zea mays; identical to SEQ ID NO: 46326
  misc_feature: Ceres CLONE 1494128
  misc_feature (12)..(71): Pfam Name: potato_inhibit Pfam Description: Potato inhibitor I family

SEQ ID NO: 56171 - DNA, 690 bp, Zea mays
  misc_feature: Ceres CLONE 1494129
  misc_feature: Encodes the peptide sequence at SEQ ID NO. 56172
aaagctggagctccccgcggtggcggccgctctagaactagtggatcccccgggctgcaggaattcgcacgagaccattacctagagcatcctaatcgaaaatttttgctccctggggcgggtcggggcccacccgcccgcctcggctgctcagctctgctttgctctgctcctcgcctcccttcccttcccttcgcctcccccagccagccaggaatcgccaccggcggaagccaagcatcgtcccagcaccggatcgattccgcccgcccgcccgcccgtccatggatccggcggccgagccggcggcgtggccgccgtggacgtcgctcctgctgcgggcgctgagccggcggcggacctgggtggcgctcttcctcgccgtctacgccgggctgctctcgtcctcctggtccctgctcgcctccgtccgcgcctgggactactccgcctcctcggggtccgcagcgcccgcctgggccgccgcgcttctacgcgtccgtcatgtacggggccctggttcggcctggccctcctgggccgcccgcgcttcgccgttcgccgcggcccggccatggctcggcaacctgggaccaaccggtccctcggtggcggcctcggcctttcgcgggggccccccccgccatcaaggttcctgttctctttcccccacaaggaggccctgcccgc

SEQ ID NO: 56172 - protein, 135 aa, Zea mays
  misc_feature: Ceres CLONE 1494129
MDPAAEPAAWPPWTSLLLRALSRRRTWVALFLAVYAGLLSSSWSLLASVRAWDYSASSGSAAPAWAAALLRVRHVRGPGSAWPSWAARASPFAAARPWLGNLGPTGPSVAASAFRGGPPRHQGSCSLSPTRRPCP

SEQ ID NO: 56173 - DNA, 651 bp, Zea mays
  misc_feature: Ceres CLONE 1494133
  misc_feature: Encodes the peptide sequence at SEQ ID NO. 56174
  misc_feature (403)..(403): n is a, c, t, g, unknown, or other
gagctcaccgcggtggcggccgctctagaactagtggatcccccgggctgcaggaattcgcacgagaccattacctagaacatcctaatcgaaaaagcttggtcggttcgtttaccaccaaagcgccccgcaaaatctcgccgccgaccgccatggcagccgccgacgagacgcgtccgctgctcgttgctatatctctcgccgtagccgcctgctgcctcgcgcagctggcggtgggggacacgaacggcgtctacgagccgtgcagtgacgcacggatccagcgcggggacggcttcaccttcgggggggtcttccccggatacaacgccttcttctccggcaaaacatttttctccccccgccaccgggggatgaaggggggtggcctccgggcagctcnccctcttcccgcccgaggggcgaccaagatccccctcctcaccgtcgacacggcctaccggaattcaacccccctttcagccggtgggattcttggtaaccttttgcccggcagaaaatattcaacttagatctcattccctacatcttgttccccaccccccccgggtcccgctgtccccgcctctccccggcggttgtgcactcctccggcagggcccgaacccgcgcacctggcccccgccaagc

SEQ ID NO: 56174 - protein, 126 aa, Zea mays
  misc_feature: Ceres CLONE 1494133
  misc_feature (84)..(84): Xaa is any aa, unknown, or other
MAAADETRPLLVAISLAVAACCLAQLAVGDTNGVYEPCSDARIQRGDGFTFGGVFPGYNAFFSGKTFFSPRHRGMKGGGLRAAXPLPARGATKIPLLTVDTAYRNSTPLSAGGILGNLLPGRKYST

SEQ ID NO: 56175 - DNA, 636 bp, Zea mays
  misc_feature: Ceres CLONE 1494139
aagctggagctccccgcggtggcggccgctctagaactagtggatcccccgggctgcaggaattcgcacgagaccattacctagaacatcctaatcgaaaaaagatctacattgccgaatgatcatgacattggtgtagggtttagtgtacttaccatataggggagccgatgatcctcttggccataatcgtggcgccatctttcttcgccactcccaccaagcgaggaagtagtatgcttcctggggttggggcttcttcaacggatctccgcctcctctgatcgccgctatgtgtaccggccaccgtcgccagcgatgaagtcgaggagatgggcaacagaggaggaaatctttaatccgcaactgggacgcacccaggacctgcactggatgcgcgatttcgggggcggctgcaactggcgcagcgcttcacttcgttgctgcgaatctcaagcagcgactgcggcgggaggtcgcggccgtgggcgacgtgtggcggcgcctggcggctggtcagagtttggtgctttaaactcgcgcggcgtcagtaatcctccaatgccaagcatgacgatgttgggggcacggtatgtttggccttttctcatttggttgtttaagtagctcaaaatt

SEQ ID NO: 56176 - DNA, 718 bp, Zea mays
  misc_feature: Ceres CLONE 1494143
  misc_feature: Encodes the peptide sequence at SEQ ID NO. 56177
  misc_feature (335)..(335): n is a, c, t, g, unknown, or other
  misc_feature (341)..(341): n is a, c, t, g, unknown, or other
  misc_feature (344)..(344): n is a, c, t, g, unknown, or other
  misc_feature (346)..(346): n is a, c, t, g, unknown, or other
  misc_feature (359)..(359): n is a, c, t, g, unknown, or other
  misc_feature (363)..(363): n is a, c, t, g, unknown, or other
  misc_feature (364)..(364): n is a, c, t, g, unknown, or other
  misc_feature (366)..(366): n is a, c, t, g, unknown, or other
ggccgctctagaactagtggatcccccgggctgcaggaattcgcacgagaccattactagaacatcctaatcgaaaaacagtcgcatctcgcctccagcagggtgagttcgcctcggcagggtgtggcataccatggagagctcgtcgccgtcagtgccgttcccgctgctgcaggcgccggtcgagagcacctaccgcgcctgcaccatcccctaccgtttcccctccgacaacccgcgcaaggccacccctgtcgagatccaatggattgacctctttctcaactctgtcccgtccttcaaacagcgggcggagaacgaccccaccgtacccnatactnccncnaaaagcaaaaaanttcnncncaaaagtacacgtcaatggcttgaaaaagtcaaccaccacggggtatattcttgggaggaccaccaaaattggcatactttctttgttaggctttccccacctagctaactcaaaaaagcctggggatttaagggaataacgtcccataacgggcaagggacggaacgagaaatgcccaacgcgctatggtcactttttttgagggggaggctattagggcggaaaagggcggaaactttgagggatgaaccgccacaaaggaattggaacaaccttgcggccctccaaaaggtgtgggcctcggaaacttttctcgcaccctcgggagctcgcaccacgcgtggggggagg

SEQ ID NO: 56177 - protein, 113 aa, Zea mays
  misc_feature: Ceres CLONE 1494143
  misc_feature (68)..(68): Xaa is any aa, unknown, or other
  misc_feature (70)..(70): Xaa is any aa, unknown, or other
  misc_feature (71)..(71): Xaa is any aa, unknown, or other
  misc_feature (76)..(76): Xaa is any aa, unknown, or other
  misc_feature (77)..(77): Xaa is any aa, unknown, or other
  misc_feature (78)..(78): Xaa is any aa, unknown, or other
MESSSPSVPFPLLQAPVESTYRACTIPYRFPSDNPRKATPVEIQWIDLFLNSVPSFKQRAENDPTVPXTXXKSKKXXXKSTRQWLEKVNHHGVYSWEDHQNWHTFFVRLSPPS

SEQ ID NO: 56178 - DNA, 690 bp, Zea mays
  misc_feature: Ceres CLONE 1494146
  misc_feature: Encodes the peptide sequence at SEQ ID NO. 56179
cggccgctctagaactagtggatcccccgggctgcaggaattcgcacgagaccattacctagaacatcctaatcgaaaaagagtccagaccatagcctgcagccttccatccacgaactcccgttctccatttccagccatggcggtgtcgatcgagctcaccaaggagtacggctacgtcgtgctggtgctggtggcctatgtcttcctcaacctttggatgggcttccaggtcggcaaggcccgcagaaaggacaaggtgttctaccccaccatgtacgccatcgaggcggagaacaaagacgccaagctcttcaactgcgtgcagagggagcacaaagaactctctagagtggatggccgtttttggtcatcatactggctgcttggggggttctgcccccacctcggccattatgtggggggtcatggggcggggttcgtacatatactcggcgaagacgggttctagaatgtagggggaaaaaaaacaacggggggtatgcggaaaagtcccggccggcgagaaaatgggggggtggaaataatttgggggggtgctagggggggtgaaacgggtgggacaggaaggggggtataggttccaccccccctcgtgccagggaaaatggcgcgtaaaaaatggagggtggtttttctagaggggggaggcaaaatggtgtgacgccg

SEQ ID NO: 56179 - protein, 110 aa, Zea mays
  misc_feature: Ceres CLONE 1494146
  misc_feature (9)..(104): Pfam Name: MAPEG Pfam Description: MAPEG family
  misc_feature: SWISSPROT Homolog: EC 2.5.1.18 Glutathione transferase
MAVSIELTKEYGYVVLVLVAYVFLNLWMGFQVGKARRKDKVFYPTMYAIEAENKDAKLFNCVQREHKELSRVDGRFWSSYWLLGGFCPHLGHYVGGHGAGFVHILGEDGF

SEQ ID NO: 56180 - DNA, 696 bp, Zea mays
  misc_feature: Ceres CLONE 1494152
  misc_feature: Encodes the peptide sequence at SEQ ID NO. 56181
aaagctggagctccccgcggtggcggccgctctagaactagtggatcccccgggctgcaggaattcgcacgagaccattacctagaacatcctaatcgaaaagtgactcacactcacaccgaaagcgcctcaactctgaaggcgctacagcaacgtcgccacttcactcacgattggagtttcacctcggcagcccagccagccagtggttcctcggctcggaggaacaggcgaacagcaagagcttctgaagatgaaggcgatccccgtggctctcctgctcctcgtcctggttgctgccgcctcctcgttcaagcatctcgccgaggcagcagacggcggcgcggtgccggacggcgtgtgcgacggcaagtgccgcagccggtgctcgctgaagaaggccgggcggtgcatgggcctgtgcatgatgtgctgcggcaagtgccagggctgcgtgccgtcggggccgtacgccagcaaggacgagtgcccctgctacagggacatgaagtccccccagaaccagcgccccaagtgcccctaggccctaccgctctaagggagggaggatgacccaggatttcgctcgcgatcctgcacagcttctaatcctgtactgctagtttagcccccccaaccgtcggaatgccccaacggttccttccgggctggggggctgggttcacccccggacgg

SEQ ID NO: 56181 - protein, 96 aa, Zea mays
  misc_feature: Ceres CLONE 1494152
  misc_feature (1)..(96): Pfam Name: GASA Pfam Description: Gibberellin regulated protein
MKAIPVALLLLVLVAAASSFKHLAEAADGGAVPDGVCDGKCRSRCSLKKAGRCMGLCMMCCGKCQGCVPSGPYASKDECPCYRDMKSPQNQRPKCP

SEQ ID NO: 56182 - DNA, 527 bp, Zea mays
  misc_feature: Ceres CLONE 1494175
aaagctggagctccccgcggtggcggccgctctagaactagtggatcccccgggctgcaggaattcgcacgagaccattacctagaacatcctaatcgaaaaatctcgtccacgaaacgtacggacttcgggcatcggccccaacgccagcggcaccgcacccgcaccaccaagctcgtcggcgacatgaatccgcccgcagcagccgcgtccaccgggcgcaggagccacgccgcggcgcctgcggcagccccggaaatacgcgaactacccgaggttcccggccagaagaaggtggccccgccccccccccccccttttttaagccgccaccccggggggcgttttcccctttaggggggaaaccccctaattttttccccccccgggggggggccccccccctccccccaaaaaaaaaaaaaaaagaacccccctaaaaaagatcccccccaaaaaaaaaaaaaaaaaaatttttggggggggccccaaaaaaaaaaaaaaaccccccgggtttttttttgggg

SEQ ID NO: 56183 - DNA, 1552 bp, Zea mays
  misc_feature: Ceres CLONE 1494190
  misc_feature: Encodes the peptide sequence at SEQ ID NO. 56184
ttttgcactcccacccctcaaaaattttcagccgccagcaacctttcttcctcccacgcacagcagccagcgcgcagggagcttccctgtccatggcgtctcctccccttcctcgagcaagctccagcgtgcgcggggggcagcaacctcgacggtcggcctctctcccctgctgtcgctcgccctatagggatggagagcagccgtgcgctccctgcaggcaagcagaacctccagccgagcgcgctccctgtccttctcctgggcgtgtcccctgctccacggccagcaggaagccagcgcccctctgcagctccttctcccagggcgctcgacgctcctgcagcaaggccagcccccatggcgcccttcctcctcggctcaatggtgtggccgagcagcaacctcttctctctgtttcctgtgcgtgcgcaggggcagaaactccatggccgccgagctccattcctccaagcagcagctccctccatggcgccatttctcccagccagcgccctcattcctccctgcgcagcgccccttttcttctacctcttgccggcgcccagaaattccagcagcgagcagcgcacgtcctgctgtccatggcgtgcagcaaacgtggagctcagctccacctctccccatggctgcgagctcctttccctagctgctcggctccccctcccatggaaaccagcagcctcatctcctctccccaaccgatgccttttttttccacctccggcagcaagctgcgaactccattcctccatggccacaagcctttccttgctgcgactccttcccaaggacagcaccaaccccctccttctccatcgcagcagcatcagtgcttccctcgccgcttgcatgccacccgctcgatgtattgcgcagccacattgtcgctgctcgttgtccgtcaacgcagcccctctgttttccccgttggcgcagcggccccgacgcctccacgcgctgccggttccctgttttataaagcgcagtgaacagcacgccgtcgacactcgccggttgtttgctgtttttgcgcagccccgtcgtcgtcgtcgttcaccccggtgagaccgcgacgctccgtgttcgattccgcatcgacattattttcctatgattaattatgtatgtgtgctgctttgttttatttttatggaggagaaaaccccgtgtttgcgtggagaaggcaagtcgctcgacgctcgtcgatgttcgtagcgatgcacaaatcggaatcaccgtcgttcttgcaaacgccgatttgggtttgtttatggtgagccgatgcatgtcgctctcgattaacttgattaataaattatatagatgtggttgaaatgttttggcggtaggtcgtaatatggtcgtgctcatgatttcgagttagagattggtggtcgtcgattcatagaaattgatcgatgcagtgcgtgtttaaaaattgtattggtatggattgaagtttgtggcgaaagaaaaagaaagtagaaaagaactcggatgtttttacatttcaaaaaaaaaaaaaaaa

SEQ ID NO: 56184 - protein, 298 aa, Zea mays
  misc_feature: Ceres CLONE 1494190
MESSRALPAGKQNLQPSALPVLLLGVSPAPRPAGSQRPSAAPSPRALDAPAARPAPMAPFLLGSMVWPSSNLFSLFPVRAQGQKLHGRRAPFLQAAAPSMAPFLPASALIPPCAAPLFFYLLPAPRNSSSEQRTSCCPWRAANVELSSTSPHGCELLSLAARLPLPWKPAASSPLPNRCLFFPPPAASCELHSSMATSLSLLRLLPKDSTNPLLLHRSSISASLAACMPPARCIAQPHCRCSLSVNAAPLFSPLAQRPRRLHALPVPCFIKRSEQHAVDTRRLFAVFAQPRRRRRSPR

SEQ ID NO: 56185 - DNA, 687 bp, Zea mays
  misc_feature: Ceres CLONE 1494191
  misc_feature: Encodes the peptide sequence at SEQ ID NO. 56186
aagctggagctccccgcggtggcggccgctctagaactagtggatcccccgggctgcaggaattcgcacgagaccattacctagaacatcctaatcgaaaaacgaggaggagcagagcaggtctctccatggatgcgagccaggatgtgtgggactgggactgggaggtggtcatgccagatcacaggagcttctccacgagccatggcagcaagaatcttgatggtaaggagcttctccctgatccatggcggcaagaatcttgatggtaaggatgatcacttgttgtttcacgtatgtaattttgattacgaccgtcttaaattgcactccagataaagaaacagaggagcattatctgctgccaccgtcaggagacgttgacgtgcacgacgactgcaagggcatcggcgtcgtgctggatgagacctgcaaatccgccgtgcctagtgttgccgatccgattatggcttctgagggtggcaaggaagagaaggcgatccagagccctgatgccgaggagtccgtcaccaccgacagcaactttgctcaagaagaggaggaggaggaagaagatatcaagaaggacggcaacgataaggttggagccctgatcggcgcgctgtgctcgtttggggtcgcagccgccaccgcctgcgtctttctcatcggcggcaggctgcatca

SEQ ID NO: 56186 - protein, 146 aa, Zea mays
  misc_feature: Ceres CLONE 1494191
MAARILMVRMITCCFTYVILITTVLNCTPDKETEEHYLLPPSGDVDVHDDCKGIGVVLDETCKSAVPSVADPIMASEGGKEEKAIQSPDAEESVTTDSNFAQEEEEEEEDIKKDGNDKVGALIGALCSFGVAAATACVFLIGGRLH

SEQ ID NO: 56187 - DNA, 675 bp, Zea mays
  misc_feature: Ceres CLONE 1494193
  misc_feature: Translation starting site: 147
  misc_feature: SWISSPROT Homolog: EC 3.1.3.16 Phosphoprotein phosphatase
  misc_feature (410)..(410): n is a, c, t, g, unknown, or other
agagctggagctcaccgcggtggcggccgctctagaactagtggatcccccgggctgcaggaattcgcacgagaccattacctagaacatcctaatcgaaaaacccacacatccgacgccgaggaagtaggaagcacgagcagcatatgtcacagagggccagcgtcccacactcctcctggatagacttcgagctccattcccatctcctggtctccagtgagatgtgccccagctcctattggcagcaatagctattctccgccttccttttttttttcttcttcttcctttcctcccgtctgaatttcgtttccgtttgatcgagctggctctcagcttccgtttttagatttgttggcatctttgctctcggaggcgggggggggcgagcccctgaaacccaaaangacacaacaccccccgcaagcaaacaatgggtgtcaagggattcgccgaggggcggatccccccccatcggggccgggttgctccccccaccgggtgggacctccccaggggcccgcttgccgtctccaggggaaaagcggcgggccgccctgtgctccccaagccggcgtcttgatcccggtcgtttgcctttcctcgcccggggggctccgcgcgtcctgcttcccccccctgctaagtaatcccgggggccccccctggagg

SEQ ID NO: 56188 - DNA, 699 bp, Zea mays
  misc_feature: Ceres CLONE 1494204
  misc_feature: Encodes the peptide sequence at SEQ ID NO. 56189
aaagctggagctccccgcggtggcggccgctctagaactagtggatcccccgggctgcaggaattcgcacgagaccattacctagaacatcctaatcgaaaaaagtgcagatcacactagcctacacacaccgagcgccgtctaaactgacagcaggtcagcagcctagcgaagccaagacatccgccgatctcagatggccgggagaagggtgcgcggcaagagtgccgtggccgtggcggccgtcgcgctgctggcgctgctcttcgcggcgagcgaggccgacgggacgtgcaacgtcgaccggggcacggtgctgaggcagtgcgcgtcctgctcgagcggcgcgccgagccaggggtgctgcgacgcgctgaggaacgccgacttcggctgcctctgcagcaactactggaacaagctcaagaacacgccatacgccagctgcgccaaggccatcccttccgcgtgcaacctcccaaacgccaagtgccagtagatggagacatggagtgcgtgacccggacagcgaacgggcagcttggaccaaacagaataaatccgcttcattaccctgtttcttcctcctctgagtgtgttagttctttgctttgagtcgttatccgatatgatcggctgccctgctagccggcgggacgttctatatatgtctttgcaactcaaaaaaaaaaaaaaagc

SEQ ID NO: 56189 - protein, 100 aa, Zea mays; identical to SEQ ID NO: 43754
  misc_feature: Ceres CLONE 1494204

SEQ ID NO: 56190 - DNA, 696 bp, Zea mays
  misc_feature: Ceres CLONE 1494206
  misc_feature: Encodes the peptide sequence at SEQ ID NO. 56191
aaagctggagctccccgcggtggcggccgctctagaactagtggatcccccgggctgcaggaattcgcacgagaccattacctagaacatcctaatcaaaaattccccttgaggataggatagctgccctggaaaggaaacagaactccaaagcacttgatgcggtcaagtacgggcctggtggctcacgagagatttcgtttttctctaaaagccgtagaaggcacaaggaagagtcatctagcgacgatgaacccaagggtgtcaaaaagagagctgtgcagtcgctgggcttgaagcaaggaaaagccgagttctatatgtttgtcggaaatcgtggcacaggaagaggcggtggtggcagaggtggaggcggtcgaggaagaggtggaggtggtcgaggaagaggtggaggacgacgcatgggcaggggcagaggatgaatggggcccgtcacattgaccccgttcctgcctttgcaggggttttggtaagcttgaaatggattgatcctgcacatgcaatgggtagaaagtgtgttccttcacaacatacgcaagagctagagtaactgacgattgctgcttcagaatttttgggaagagaactttgttagaagacaatattacatatcttatggtctaccttgtaacggatcgttgcattctggtgggagtctatgggtacagtatagca

SEQ ID NO: 56191 - protein, 40 aa, Zea mays
  misc_feature: Ceres CLONE 1494206
MFVGNRGTGRGGGGRGGGGRGRGGGGRGRGGGRRMGRGRG

SEQ ID NO: 56192 - DNA, 476 bp, Zea mays
  misc_feature: Ceres CLONE 1494210
  misc_feature: Encodes the peptide sequence at SEQ ID NO. 56193
aaaatccgtctgtgcatcgcgtcggcgaccaggaagcgacgaggaaggcagagcgggcggcgactacaacggcagcagatctcacggcatggcggcgaaggcgatctcgagccccgtgccggtggagtggtattcgacgctggccgtcgtcatggtatccgtaggcctcatgttcaccgcctccttcttcatctatgaagctacttcatccaagcggagccgtagcctggcaaaggagatcacaacagcagctgttgcttctgttttcctgggctttgggtctctgttcgtgctccttgcaagtggtgtttatgtttgacgactgcgtatggggccgtgttcttggattcagcatacttagggcatgtacaagtctgagactccatttcgattttctatgtacaagagagactgtatgacataaccttgagactcagtattataaatgcagttaatagaaaaaaaaaaaaaaaaaa

SEQ ID NO: 56193 - protein, 76 aa, Zea mays
  misc_feature: Ceres CLONE 1494210
  misc_feature (2)..(76): Pfam Name: UPF0197 Pfam Description: Uncharacterised protein family (UPF0197)
MAAKAISSPVPVEWYSTLAVVMVSVGLMFTASFFIYEATSSKRSRSLAKEITTAAVASVFLGFGSLFVLLASGVYV

SEQ ID NO: 56194 - DNA, 700 bp, Zea mays
  misc_feature: Ceres CLONE 1494228
  misc_feature: Encodes the peptide sequence at SEQ ID NO. 56195
aagctggagctccccgcggtggcggccgctctagaactagtggatcccccgggctgcaggaattcgcacgagaccattacctagaacatcctaatcgaaaaaggcctagttcgcataatgggctcgtggacccattcagcttcgtcttccaagtcccatccgaccggccgaccgaatgtagcgcaccaatcccatcctccacccaatcgaaggacctagcgagcggcagcggcggcggcgatcggagaagatggtgcgcaaggcgaaggttgagttcgacgagcagccgccggataacttcgacccgaagaacccgtatgccgacccggtggcgatgctcgagtaccgggaacacctggtgcgagagaagtggatccagatcgagaccgccaagatcatccgggagcgcctccgctggtgctaccgcatcgagggcatcaaccaccaccagaagtgccgccacctcgtcgaccaatacctagaggctacccgcggcgtgggttggggcaaggatgcccgcccgcctgaactccacgagcccaagaagaccgtcaaggcggagtagcggcgctgctgccttgcttctcgtgctgctgttcctggattggagaggtgatctgacccttccattgagttgaatgaagtagcctggaactgtggtagttcgtcttttacatcttaagctgctgatagacttcaa

SEQ ID NO: 56195 - protein, 104 aa, Zea mays; identical to SEQ ID NO: 49299
  misc_feature: Ceres CLONE 1494228

SEQ ID NO: 56196 - DNA, 835 bp, Zea mays
  misc_feature: Ceres CLONE 1494232-R
  misc_feature (1)..(1): n is a, c, t, g, unknown, or other
ntttggtgcttgcggttaggtcgtcttaggatgacgacgttcataacttatttccgtaggaacggactgatgtcctgcaggaagacctagtctactcacatctgatgtatcattacttatgagagcaatacacacctcaaccgatctgctaagctgatgaccatgaagcctatctgcaaaatataggccatcctgaagagggattacatttcttcttccaagaaacggctccatacctacacggagcctgaacgctggacttgcaacgtggtcatccattcaggacagatttgtagaggaagtcatcaattgtgttgaaaatgttgcccacatcaacatgacctaggatggccgcactgactacatcatctggtagtatgagaccatctatgacatctatgatgtgcacaccatgctcctggaccatgacagatgggtcatgaacaacactcaccaccaagtaggatatgtagcttccatcaacctgattttgctgtgatggggcatgggctactcctccatatgttgcagctgaagaatacatctttaaccctgtgagctccatatgcaccagaatgcactgaagaaagcgacaggttatttcgttgaaggttgtcacacgccgcacagcataggctactacgtgctgctctccatgacaacctttaccaccgccgatgactatgacatacttctcgttagtagcatcaatcatcttcttagcatcagacgcatcatcttcgcagcgaatcacatctatcgtggcagcatcatcatcaggagtgactacaactctgtgacacgatcatctttaccaagcatggtacaagcagcc

SEQ ID NO: 56197 - DNA, 567 bp, Zea mays
  misc_feature: Ceres CLONE 1494232
  misc_feature (232)..(232): n is a, c, t, g, unknown, or other
  misc_feature (283)..(283): n is a, c, t, g, unknown, or other
aaagctggagctccccgcggtggcggccgctctagaactagtggatcccccgggctgcaggaattcgcacgagaccattacctagaacatcctaatcgaaaaaatcgaaaaccttttccttttgctccttccttcctcgggaagcctagggcttaggctttaagcgccgcgatgtacggcggcggcggcggcggcgggcctacgacggagcagcggtggcgccggggacgcntacgcgctctttcggcggcggggggcttcatgcccctccccagtccacggntggggtccccggaaaaaaaacgggccctcccctaagggtcgggaaggggcaaaaacctgggtcccccttttccgggggaaaagaacatggggcgggggcaaaaacagggggaaagggctaatttccccctccccgggggtgaggggcccacaaaatagcttttgggccccccctccagaaagggggaaccctcccaaatgttggtatccccccggaaaaaggccccggcgaaaaaaaaattaaaaccccgggaaaaaaaaagtccccccccgccaaaaaaaggg

SEQ ID NO: 56198 - DNA, 684 bp, Zea mays
  misc_feature: Ceres CLONE 1494244
  misc_feature: Encodes the peptide sequence at SEQ ID NO. 56199
  misc_feature (648)..(648): n is a, c, t, g, unknown, or other
aaagctggagctccccgcggtggcggccgctctagaactagtggatcccccgggctgcaggaattcgcacgagaccattacctagaacatcctaatcgaaaagaaccacttcacagaagtgctttaccctcacccgcacccgccccacgcgcggtaggttcgttcgtcacagtcacagaccagtcgtttctcccttctctcccccgggcccggagaggagaggatggccggccggagcagcctctccatggtcgcgtcgcaccggctgttcacgccggtcaacccagtgggcggcgccgaccacggcgtggagctcgacgaggccgacgtcatctggggcggcggcggcggatacccggcgtcgtcctcaccgtcgtcgtcgccgttcctgtcctccgcggtcgacccgtacgcgcggtcgccgccggtggccgcgccgtccaagcagaagccgcgtggggtggtggccggcgctccggggccggcgtcggtgcccgtcaacatcccggactggtccaagatcctgggcgccgagtacgccgggagcgagtgggcggcgcacgacgaccgcgcggacgacgacgcggcggcctgctgcggcggcggcgccgggggccggcgctgggtgccgccccacgaggtgctcanggggcgggagcgcgcggcggcgtccttctccgtgcg

SEQ ID NO: 56199 - protein, 153 aa, Zea mays
  misc_feature: Ceres CLONE 1494244
  misc_feature (27)..(153): Pfam Name: DUF584 Pfam Description: Protein of unknown function, DUF584
  misc_feature (142)..(142): Xaa is any aa, unknown, or other
MAGRSSLSMVASHRLFTPVNPVGGADHGVELDEADVIWGGGGGYPASSSPSSSPFLSSAVDPYARSPPVAAPSKQKPRGVVAGAPGPASVPVNIPDWSKILGAEYAGSEWAAHDDRADDDAAACCGGGAGGRRWVPPHEVLXGRERAAASFSV

SEQ ID NO: 56200 - DNA, 681 bp, Zea mays
  misc_feature: Ceres CLONE 1494249
  misc_feature: Encodes the peptide sequence at SEQ ID NO. 56201
ggagctccccgcggtggcggccgctctagaactagtggatcccccgggctgcaggaattcgcacgagaccattacctagaacatcctaatcgaaaatttcattaccggaagagaaaaaaataactcggaaaagaaggagacgccgaaaattcgaaaggggagggggaaagcaaagctgatggcggaggcccaggggaaagcaaagcaaatggcggaggccccgagcaagatcgaatccatgaggaagtgggtcgtcgagcacaagctccgagccgtaggttgcatgcgcaagctctaaccctcgctgcattagttggttctgcatgcgtggagtactatgaccagaagtatggttcttctgggccaaaggtggacaaatacacaagccaatacctggcccattcgcataaagattaaaggtcgccatgttggttcctgcatgccggattaattttgggctcatctcgggttgctcatgacccgcccatggatgctggatgtttattctttttttttgtcttcataattacaaaatggtggtgtacttgccaggcaaatgttaatgagggtataatgcagatattgtcgtcataatttggcctcatgttgcattatctaacctcactttgttgactgtcagcgactcagcgtctctgatttttttatattttttgagaaaag

SEQ ID NO: 56201 - protein, 39 aa, Zea mays; identical to SEQ ID NO: 43083
  misc_feature: Ceres CLONE 1494249

SEQ ID NO: 56202 - DNA, 694 bp, Zea mays
  misc_feature: Ceres CLONE 1494265
  misc_feature: Encodes the peptide sequence at SEQ ID NO. 56203
atagctggagctccccgcggtggcggccgctctagaactagtggatcccccgggctgcaggaattcgcacgagaccattacctagaacatcctaatcgaaaagtatcgatcggtcttccacccctttcccctctgcgtcgatctcaccaccgcgccgaccccgatggactccgccgcctcatcgggcgtcgccgctggcaaatcgctgttccaggggttccgcaggttcctcaaaaagccgtgggagatcacgggcccctgcgcctctcccgagtaccgcagcgcgctgcctggcgcgctcgagtaccgcgtcaagtgcccggccaccgtgcgcgacgaccgcgacaatgccatcgagcccacatccgatcctgagacagtctacgacatgcagtacttcacactagatcgcctacggaaccgtccgcacatgcgccgtatcctgctacagaagcccgacctcgagcgctacatggcagctagcaagttcgaccccaccaagaactgccccctgccgtacatcatcccactggccgagaagacgacaatccgggcggaggtgggcacccaaaaaatcccggaaaactaatggatttatgctggaaaattccccgcagccttgttggcgttggagcccaaaaacccccccaaaaattcgccccccccttaaaaaaaccccttttaaagaaatttt

SEQ ID NO: 56203 - protein, 141 aa, Zea mays
  misc_feature: Ceres CLONE 1494265
MDSAASSGVAAGKSLFQGFRRFLKKPWEITGPCASPEYRSALPGALEYRVKCPATVRDDRDNAIEPTSDPETVYDMQYFTLDRLRNRPHMRRILLQKPDLERYMAASKFDPTKNCPLPYIIPLAEKTTIRAEVGTQKIPEN

SEQ ID NO: 56204 - DNA, 700 bp, Zea mays
  misc_feature: Ceres CLONE 1494266
  misc_feature: Encodes the peptide sequence at SEQ ID NO. 56205
  misc_feature (689)..(689): n is a, c, t, g, unknown, or other
  misc_feature (697)..(697): n is a, c, t, g, unknown, or other
aaagctggagctccccgcggtggcggccgctctagaactagtggatcccccgggctgcaggaattcgcacgagaccattacctagaacatcctaatcgaaaaactcttgctactagctagatgaggagtaggatcgtggatcgtacgagtagctcaagaaggaaacaaaacggcaggcttgcagttccaatccatcccgctggcatcgtctgttcttcgtccttccatgctctagactagctagcgttgcagtgcagagcatgacacaggcaggcatggagtagtgacatatagatggagctggcctggagctgctgctgcttcttgctcgccgcctgcgcgcgctctctccgtcgtctgctccagctccccgcgctcctctgctgcgaggccatggcgtgggcggtcaccttcctcgccttcccgctccgcatgctcaccgccgtcgagagggagcgcaagttggggtggctggttgcggagatgcaggcgcagatggacgacctggcgtgggagaacgcggcgctggaggacaggctgcgagcggcgctccgggagcgggaggccgtggaggcggtccttgatgacgtggaggacgagcacgaggacgccctcgccaggatccatgtcctcgacgcccagctcaaggcgctgaggcaggagaacgtgcggctgaacgagcacaaggncaagtccnagg

SEQ ID NO: 56205 - protein, 101 aa, Zea mays
  misc_feature: Ceres CLONE 1494266
  misc_feature (99)..(99): Xaa is any aa, unknown, or other
MAWAVTFLAFPLRMLTAVERERKLGWLVAEMQAQMDDLAWENAALEDRLRAALREREAVEAVLDDVEDEHEDALARIHVLDAQLKALRQENVRLNEHKXKS

SEQ ID NO: 56206 - DNA, 695 bp, Zea mays
  misc_feature: Ceres CLONE 1494292
  misc_feature: Encodes the peptide sequence at SEQ ID NO. 56207
aaagctggagctccccgcggtggcggccgctctagaactagtggatcccccgggctgcaggaattcgcacgagaccattacctagaacatcctaatcgaaaaaaccacaatctcactcataaatcttgccaaccattgccagatctttaatcttcaccatgatctcccggggcaattctagtacgagctcagacaacggctcctccatgcagttgtaggacttcctgccaatgatggtgaggaaggtaggggtggaggggctgattcaggagctatgcaaagggttccagctgctcatggagcctaggacaggcaagatcacctgccagagcctgaagcagaatgcggccaggttcgggcttggagaactccatggtgatgagctcccggagatgatcagggaaggggatcttgacggggatggggcgctggatcagatggagttctgcattctcatggtcagattgagccctaagctgatggaagaagaggcacacatgatgtttcaatattgatgtaacttgatccttgttgcttagtacaacagaacagtgatctttaatgtcaatttggtccagctccaatgtgatattgaattcaaaaaaaaaaaaaaaaaagcttatcgataccgtcgacctcgagggggggcccggtacccaattcgccctatagtgagtcgtattacgcgcgctcac

SEQ ID NO: 56207 - protein, 94 aa, Zea mays
  misc_feature: Ceres CLONE 1494292
  misc_feature (51)..(79): Pfam Name: efhand Pfam Description: EF hand
  misc_feature: SWISSPROT Homolog: EC 2.7.11.1 Non-specific serine/threonine protein kinase
  misc_feature: Functional homolog of the protein sequence given in SEQ ID NO 96881
  misc_feature: Useful for making plants with altered glycerol content
MMVRKVGVEGLIQELCKGFQLLMEPRTGKITCQSLKQNAARFGLGELHGDELPEMIREGDLDGDGALDQMEFCILMVRLSPKLMEEEAHMMFQY

SEQ ID NO: 56208 - DNA, 678 bp, Zea mays
  misc_feature: Ceres CLONE 1494308
  misc_feature: Encodes the peptide sequence at SEQ ID NO. 56209
  misc_feature (305)..(305): n is a, c, t, g, unknown, or other
  misc_feature (387)..(387): n is a, c, t, g, unknown, or other
  misc_feature (390)..(390): n is a, c, t, g, unknown, or other
  misc_feature (394)..(394): n is a, c, t, g, unknown, or other
  misc_feature (395)..(395): n is a, c, t, g, unknown, or other
tccccgcggtggcggccgctctagaactagtggatcccccgggctgcaggaattcgcacgagaccattaactagaacatcctaatcgaaaaagagaacccctcctcgacctcggcctctcctcttcctcctccgctcccaaaatcctagggttttgctcgccgcggcgcgatggagcccacctcgtcggcgtcgatcgcgcggcagacgtgggagctggagaacaacattcccgcggcggcctccgacccggacgcgatggacgcgatctaccgctacgacgacgcgtctcaggcgcgggcgcancaggagaagccttgggccaacgacccgcaccacttccgccgcaccaagatctccgcgcccgcgctgcgggggagggggggcnacncccnncccgggggcaccatcgaggtcatggggctcatgcaggggcagtgtgagggcgacgccctcatccttatggacgctttcgcgctccccgttgagggcaccgagaccaggggtcatggccagggccgatggccacgagtacatgggtgacttccccaccttcaacagacaggctggaaggtggaaaaatggggtggccggcaccccccccccccgggctaggggtgccggctgccaggaaccaacggctcaactccatcccccttccaagattgaccgagacctg

SEQ ID NO: 56209 - protein, 123 aa, Zea mays
  misc_feature: Ceres CLONE 1494308
  misc_feature: The sequence is a functional homolog of SEQ ID NO 122 in the 10/286,264 US patent application
  misc_feature: The sequence is a functional homolog of SEQ ID NO 1844 in the 10/412,699 US patent application
  misc_feature: The sequence is a functional homolog of SEQ ID NO 2088 in the 10/374,780 US patent application
  misc_feature: The sequence is a functional homolog of SEQ ID NO 766 in the 10/412,699 US patent application
  misc_feature: The sequence is a functional homolog of SEQ ID NO 938 in the 10/225,066 US patent application
  misc_feature (45)..(45): Xaa is any aa, unknown, or other
  misc_feature (73)..(73): Xaa is any aa, unknown, or other
  misc_feature (74)..(74): Xaa is any aa, unknown, or other
  misc_feature (75)..(75): Xaa is any aa, unknown, or other
MEPTSSASIARQTWELENNIPAAASDPDAMDAIYRYDDASQARAXQEKPWANDPHHFRRTKISAPALRGRGGXXXPGGTIEVMGLMQGQCEGDALILMDAFALPVEGTETRGHGQGRWPRVHG

SEQ ID NO: 56210 - DNA, 675 bp, Zea mays
  misc_feature: Ceres CLONE 1494361
  misc_feature: Encodes the peptide sequence at SEQ ID NO. 56211
aaagctggagctccccgcggtggcggccgctctagaactagtggatcccccgggctgcaggaattcgcacgagaccattacctagaacatcctaatcgaaaaacatcagcagagagacgccactaccaccaccgcaagcgacgacggggagatgtttctgcgacggatcctgaccggcggaggtggcctggcggcgctgagggcggcgcgcgccgtgaaggagacgacggggatcgtcggccttgaggtggcgcccaacgcgcgggaggttctcatcgggctctacacgcgtacgctcaaggagatcgaagccgtccccaaagacgaaggctaccgcaagggcgttgagtccttcaccaatcaccggctccagatctgccaggaagaagacgactggaagcgcatccaggaccgaatccgattgcgggcaagtccaggagctcatccaggaagccgaagaccaactctagctcatcgcccaaatgattgaatgggatccgtggggtgtcccctgatgactaccaatgtgagagtgattgaagaccacacccccaatcccaagcctgttccttaagacccgggcggtgggtcttcctggagggatcctccagacaccttgatgccggccaatcaaatcccgcccttccaaggcgatgctcctcctcaaggtgaagc

SEQ ID NO: 56211 - protein, 112 aa, Zea mays
  misc_feature: Ceres CLONE 1494361
  misc_feature (35)..(91): Pfam Name: ETC_C1_NDUFA5 Pfam Description: ETC complex I subunit conserved region
MFLRRILTGGGGLAALRAARAVKETTGIVGLEVAPNAREVLIGLYTRTLKEIEAVPKDEGYRKGVESFTNHRLQICQEEDDWKRIQDRIRLRASPGAHPGSRRPTLAHRPND

SEQ ID NO: 56212 - DNA, 665 bp, Zea mays
  misc_feature: Ceres CLONE 1494363
  misc_feature: Encodes the peptide sequence at SEQ ID NO. 56213
ctggagctccccgcggtggcggccgctctagaactagtggatcccccgggctgcaggaattcgcacgagaccattacctagaacatcctaatcgaaaaaaaaccctagaacgtggccttaaaccctcctcttccaacccctttttctcttcctcaccaagaaagaaaaacagacacacgtcactgttcgccttgtccggtcgtttctgctccattcctcctcctgcaagccgcaaaggaatcaggcggagtggcgcgatgggagagcaggtcgtgacggagcagatccagcggaagctggaggaggtcaacgctaccgtccaacagcacctcgcgggtgtccaggaccacatcaacttcaccatgcagcaagcatacttcaagtgcgcatatggttgctttgatcggcgccatactcaggaagcgatcagcaactgtgtggagaattgtagtgtgcctgtccttgctgccaacaatatttttgagagtgagatggccaagtttcagggaatgttgaaccggtcattgagggtctgtcaagataagtttgaagctgccaatctccagaagttgaaatcagatgcaactcgggaactggaatcctgtgtcaacagatctattgatgacagcctcagggtccttccgcatgtggtggatcagatcaag

SEQ ID NO: 56213 - protein, 136 aa, Zea mays
  misc_feature: Ceres CLONE 1494363
  misc_feature (10)..(136): Pfam Name: DUF842 Pfam Description: Eukaryotic protein of unknown function (DUF842)
MGEQVVTEQIQRKLEEVNATVQQHLAGVQDHINFTMQQAYFKCAYGCFDRRHTQEAISNCVENCSVPVLAANNIFESEMAKFQGMLNRSLRVCQDKFEAANLQKLKSDATRELESCVNRSIDDSLRVLPHVVDQIK

SEQ ID NO: 56214 - DNA, 695 bp, Zea mays
  misc_feature: Ceres CLONE 1494364
  misc_feature: Translation starting site: 112
  misc_feature: SWISSPROT Homolog: EC 1.1.1.206 Tropine dehydrogenase
  misc_feature: SWISSPROT Homolog: EC 1.1.1.236 Tropinone reductase
aaagctggagctccccgcggtggcggccgctctagaactagtggatcccccgggctgcaggaattcgcacgagaccattacctagaacatcctaatcgaaaaaaaaagacaatggcccaaagatggagtctcgaaggtacgactgctcttgtcactggtggaggcggcgcaatccggtatgccgaagaagaagatgagcctggtttgggagctcacatccatgtgtgccacatatctgaaacgctgctcaataaaagttcaaccaacactggcaaaagaaaagggcttcaagcgagtggcccacgctgtgatgtaacttctctacccgagagagaaagtttgatgcagactgtctcctccctgttcaatggcaacctcgatattttcctgaatcatgggggtggaggtcgtctaacgcctgctactgaatctgatgcagacgattttgatttccatgtagaagcacacttggaaccatgtctttccatttttgccagctttcacatcctctcctaacggcttcaggctatggaagcatcatcttcgtatcatctgtggcatgggtcgtatctttcaagagtggatccatctatagccgaccacacggagctctgaatcatctagccagaaattacgcatgcgaatggtcaaaagatgaccttccggccaaagctgtcgcgcctaatgcgaccaaa

SEQ ID NO: 56215 - DNA, 688 bp, Zea mays
  misc_feature: Ceres CLONE 1494390
  misc_feature: Encodes the peptide sequence at SEQ ID NO. 56216
aagctggagctccccgcggtggcggccgctctagaactagtggatcccccgggctgcaggaattcgcacgagaccattacctagaacatcctaatcgaaaattctttacctgcgaccgctcaggccgaatcacatcaaggccaatatctggctaggcgcttgatcaagatgaaggatgctgaagaagaccctgaaggcccaatcctcatcaggggagaacgacgccatcgcttccggcacatcacgtacctgcatctgggcctattcaccacactatgatgtcagataactgtggcatagcttcattgccaccggatatcgcatctacatcatgtccccaaatcaccggtactcaaggttctcaatttactattcaactcgcgcacgatatgctgacaaggctctcacagaacatggctagcctgcttccaaaaagacttgagtgttgtatcatcaagatgaacaacatattgctgtcactgctaccagatgatcgagatcacatcagactctgctatctcatatctagcttgataccgcaatactattgccctttcgatgccagtaaagaagcataattctcctgctctttgcatagtgcaccactgaagatatccttggtacctaacgtttcgtctctggacttacctgcggcacatctactgtctagagaagctcataattctat

SEQ ID NO: 56216 - protein, 36 aa, Zea mays
  misc_feature: Ceres CLONE 1494390
MKDAEEDPEGPILIRGERRHRFRHITYLHLGLFTTL

SEQ ID NO: 56217 - DNA, 520 bp, Zea mays
  misc_feature: Ceres CLONE 1494393
  misc_feature: Encodes the peptide sequence at SEQ ID NO. 56218
  misc_feature (206)..(206): n is a, c, t, g, unknown, or other
  misc_feature (247)..(247): n is a, c, t, g, unknown, or other
atagctggagctccccgcggtggcggccgctctagaactagtggatcccccgggctgcaggaattcgcacgagaccattacctagaacatcctaatcgaaaagggttctggctcgccaaaccctagccgccgagtgccgcccaccgcccgcccgccctccgccgcgcgtcggacggtgccgagggaagaggcaccatgaggttggnagaagtgctggtttctggctcctctaacatctaccccgggncattggaatcccagttcgtcccccaacgaacccccaagtgttttccccctttttgcccggcaaaaggggcccctaaaaaaccttcccgagaaagaaaaaggggaaccccccccctcaaggggggttattgggggggaaaaaaaaaaacttctccccccgggcttttttttttttttttttgtgggggaggaaaataaattttccccccccccccaaaaaaaaaacccctcccttttttttttttttttttttttttaaaaaaaaaaaaaaaaa

SEQ ID NO: 56218 - protein, 82 aa, Zea mays
  misc_feature: Ceres CLONE 1494393
  misc_feature (4)..(4): Xaa is any aa, unknown, or other
  misc_feature (18)..(18): Xaa is any aa, unknown, or other
MRLXEVLVSGSSNIYPGXLESQFVPQRTPKCFPPFCPAKGAPKKPSRERKRGTPPLKGGYWGGKKKTSPPGLFFFFFCGGGK

SEQ ID NO: 56219 - DNA, 699 bp, Zea mays
  misc_feature: Ceres CLONE 1494398
  misc_feature: Encodes the peptide sequence at SEQ ID NO. 56220
  misc_feature (631)..(631): n is a, c, t, g, unknown, or other
  misc_feature (699)..(699): n is a, c, t, g, unknown, or other
caaagctggagctccccgcggtggcggccgctctagaactagtggatcccccgggctgcaggaattcgcacgagaccattacctagaacatcctaatcgaaaatctctcgatttctcgcggagcggccctccacctttatcgccgccgcctccgccgccgttgctgtgttccgtctcttcgccgatggcttcggccaagagaatgatgccaggacctcctgcttctggatatgaccggtcacctctattttacggaggaggtggtggcgccccacctccaattccgcttggaactggtagctatggtgctccatatccacaccttgggatgcgatatggctatggtccaccagtaggacctcctggttcatacggtcttttctcttcatatggtccacctgggccaatgagtggtatgggatatggcccaggacctgagctaggccgatatagctatgggtttagaggttctccaatgccggtttctagcccatggtctggtggagcattagctgaaaacactgacaacattgcttcacgaaagcgccgtggaggccctgatggactttctgagggtgactggacctgtcccaaatgcgacaacattaacttttccttcagaagcacttgncacatgaagaaatgtggagccccaaggccagctccgggagggtacacgagctcatctcgcaaggacan

SEQ ID NO: 56220 - protein, 171 aa, Zea mays
  misc_feature: Ceres CLONE 1494398
  misc_feature (149)..(149): Xaa is any aa, unknown, or other
MASAKRMMPGPPASGYDRSPLFYGGGGGAPPPIPLGTGSYGAPYPHLGMRYGYGPPVGPPGSYGLFSSYGPPGPMSGMGYGPGPELGRYSYGFRGSPMPVSSPWSGGALAENTDNIASRKRRGGPDGLSEGDWTCPKCDNINFSFRSTXHMKKCGAPRPAPGGYTSSSRKD

SEQ ID NO: 56221 - DNA, 703 bp, Zea mays
  misc_feature: Ceres CLONE 1494404
aaagctggagctccccgcggtggcggccgctctagaactagtggatcccccgggctgcaggaattcgcacgagaccattacctagaacatcctaatcgaaaaaatctacggcggaccaggacgacgctccccggcggaacgtagcggaccactgcattctccgagcaaaatatctcatgtgatcggtggcgtgcacatagaggccctcttcaatttgggctccaatgtgttgacagggacatcaaccgatctcgacctctcccatcctgtcaccaatgtgaaaacagatctcatgcaggcggatacacagaggacgataccttgcgacgtacctacgggactgcacttccgttgcagacggatatggacaagtcaattctctctcctgttccaacaccggctcgaccaattccctcataaatgctgtgtgagcacctctaaccaggaccccttgatgactttcgtcttgaagattacttgaatgacccacgtgactccaacacatactcgtctgtagacttcccccacgcgatggaagttcctctcggcatgtcctacgtcccggttgcctcaagcttctctctactcccccatcacggatgggttatgatgcatgtagcggcttgtctgcttgcgatcgatcaatcataggggcacggtacatgaactgcgatctacttgcctctcgatcgcttgatccttg

SEQ ID NO: 56222 - DNA, 675 bp, Zea mays
  misc_feature: Ceres CLONE 1494408
  misc_feature: Encodes the peptide sequence at SEQ ID NO. 56223
  misc_feature (523)..(523): n is a, c, t, g, unknown, or other
ctggagctccccgcggtggcggccgctctagaactagtggatcccccgggctgcaggaattcgcacgagaccattacctagaacatcctaatcgaaaaacacattttcaatttcgtactgggcgactgggcgtagggcgagctgagctcccaagtcgacgtggcggggatggctgcgacggccggcgtcggcggtggtggaggggctaacgcggcggtggcagagcagatagcacaggcagtgcggtccacctccaatctcctccagctcatggagcagtcctcccccgctcaggttcacttggcaaaactacccaagaacctgttggaaaaagcatcctttgcaaagaacacggagcatgtactgcaccagctacctcaagtaatttcatccttggatgcttatatggacaggagtttgcaaagtgcatctcaaattaagactgtcacacagctcttgtcaaacatggagaagacacagctgaagtccatgttgccttcctctcgaaggaagaagatcagangagtactgaaccccttagaactcaggggttgattgacgtcaccgagacatatgggagggtaaacttttgccgccttatgtagagagatctgaagataagggtttgcctgattggctccttgcatcttccgggataaggatcctcgctgcccc

SEQ ID NO: 56223 - protein, 128 aa, Zea mays
  misc_feature: Ceres CLONE 1494408
  misc_feature (119)..(119): Xaa is any aa, unknown, or other
MAATAGVGGGGGANAAVAEQIAQAVRSTSNLLQLMEQSSPAQVHLAKLPKNLLEKASFAKNTEHVLHQLPQVISSLDAYMDRSLQSASQIKTVTQLLSNMEKTQLKSMLPSSRRKKIRXVLNPLELRG

SEQ ID NO: 56224 - DNA, 699 bp, Zea mays
  misc_feature: Ceres CLONE 1494410
  misc_feature: Encodes the peptide sequence at SEQ ID NO. 56225
  misc_feature (497)..(497): n is a, c, t, g, unknown, or other
atagctggagctccccgcggtggcggccgctctagaactagtggatcccccgggctgcaggaattcgcacgagaccattacctagaacatcctaatcgaaaaagttcttctgatctctgacttctgagcgaggagtggacgagtggtgtgccgtcgtccggttcccgttggtttggcgatgaggcgcgctcgcggtcgccgcgggctgctgcttctcctcggcgtggcgctctcggcggctgcgctgctccgtggctgctcggggcagcaaggggaggacggctcggacgcccctgcggcggcggctgagacggcccccatggaggagaaggagcgcagggcgctgtacgccgccatcgagagcttcgtcggcaaggtgtggaacggctccgggctctaaccagacccctgcggatggtctcccatccagggggtgtcatgtgatctcttcgatggcctgtggtacccacagtgatgagcattggcccgtccttgancactcgctgcattgctggccctacgcctagttcagcgcccagctgttcgacctgaggcgcctccggacgctgtctttctacagctgcttcccggctagcaaccccacgggcatcccgacctggagctgggcagagcctgccgggacgctggaaaccctggatttccgcacaacccgggactgaactggccatccccgcgtcc

SEQ ID NO: 56225 - protein, 73 aa, Zea mays
  misc_feature: Ceres CLONE 1494410
MRRARGRRGLLLLLGVALSAAALLRGCSGQQGEDGSDAPAAAAETAPMEEKERRALYAAIESFVGKVWNGSGL

SEQ ID NO: 56226 - DNA, 581 bp, Zea mays
  misc_feature: Ceres CLONE 1494417
  misc_feature (231)..(231): n is a, c, t, g, unknown, or other
  misc_feature (243)..(243): n is a, c, t, g, unknown, or other
  misc_feature (331)..(331): n is a, c, t, g, unknown, or other
aaaagctggagctccaccgcggtggcggccgctctagaactagtggatcccccgggctgcaggaattcgcacgagaccattacctagaacatcctaatcgaaaagttgcctcgttgaggaatattccacatcccctcgtttccggcaaaccgcaatgaagtctctgacccccaccgccgctggctccgccgcagatttttccgactctctgcccctccccgaatctccccntgcgcgtccatngcattcagcccggccgcactactacctcgcgtcgacgcacccagtcaaatgaggacactcttgagctcctggggttgtccgatccccntgtgggctgccaatgcacatgggtttcctccctgatgagctaatgcgtctggcctccctccaaaactcccctttggtcacgtgccccctgtaatgggtcaacttaaaccaaaagtgctcttttcttggaaactttctccaaaaaaaccccggggaaaaaacgcgctaagctcccaattttgccaaaattctacatttaaagacccgggctccaaaaaaaatttttatttccccaaaaaaattttttttcc

SEQ ID NO: 56227 - DNA, 684 bp, Zea mays
  misc_feature: Ceres CLONE 1494422
  misc_feature: Encodes the peptide sequence at SEQ ID NO. 56228
ctggagctcaccgcggtggcggccgctctagaactagtggatcccccgggctgcaggaattcgcacgagaccattacctagaacatcctaatcgaaaaacacgaggctcccggactcctcagttccttcgctcctctgtaacccggggcggccgacgaggccgggaccaccgacggcgacgatgggcggcggcgagggcaagtccaagaaacgccgctcttctacctcctcagcggaggaagaagggggggaacggaagaggcgggacaagaaggagagcaagaggaggagccgagacgacagggaggatgacgatgacagacacaagaagaaggggaaacacatcgacaggaacaaaggaaaagagagagattcgaaggataggcattccaaggagaagacgagcaagagaaaagacaaccacccggccttcaaagaaatatccaaggatgactactttgcaaagaacaacgagttcgctacctggttgaaggaggaaaagggcaaatatttctcagatttggcttcagagtctgctcgtgatcttttcttgaagttgtgaaacaatggaacaaaggcaagctgccctcacaatactatgaggggattacgagtggcccccgaacagcgcacaattggaacatcaaaggatgaaacgttttctggggtcaccggggcctccag

SEQ ID NO: 56228 - protein, 126 aa, Zea mays
  misc_feature: Ceres CLONE 1494422
MGGGEGKSKKRRSSTSSAEEEGGERKRRDKKESKRRSRDDREDDDDRHKKKGKHIDRNKGKERDSKDRHSKEKTSKRKDNHPAFKEISKDDYFAKNNEFATWLKEEKGKYFSDLASESARDLFLKL

SEQ ID NO: 56229 - DNA, 654 bp, Zea mays
  misc_feature: Ceres CLONE 1494436
  misc_feature: Encodes the peptide sequence at SEQ ID NO. 56230
  misc_feature (441)..(441): n is a, c, t, g, unknown, or other
  misc_feature (541)..(541): n is a, c, t, g, unknown, or other
aagctggagctccccgcggtggcggccgctctagaactagtggatcccccgggctgcaggaattcgcacgagaccattacctagaacatcctaatcgaaaaccgcgccgcatctgggaaggtctcgtcttgctcgcctccgtccgtcgccgcaccctgcgtcgtcgccatggccaccgacgaagccaccaagccgtccccgatcccaccctatcccgagatgatcctggcggcgatcgagggtctagacgacaagagcgggtcgaacaagtccgccatctccaagtacatcgagggcaagtacggctcgctgccccccgcgcacgcgtcgctgctgaccgcgcacctggcgcgcatgaaggagtccggagagctcgtcttccctcagaacactacttccgcgcgggcgcccccgacgcgccgccgaagcgcgggcgcgggncgccctcccaaggcgcggggaccgaacgcgccgggcgccggcgcccaagtcgccgtcgtccacggggcgcgggcgcgggcggcccgcccaaggccaaaanccggctggaacccgccgtgaaagcaggcaccccggggaatgcccaagcccccggggccccccccccaaaaaagccaaaaccggaggggccgggttcccctttcccgttcccgg

SEQ ID NO: 56230 - protein, 130 aa, Zea mays
  misc_feature: Ceres CLONE 1494436
  misc_feature (13)..(82): Pfam Name: Linker_histone Pfam Description: linker histone H1 and H5 family
  misc_feature (125)..(125): Xaa is any aa, unknown, or other
MATDEATKPSPIPPYPEMILAAIEGLDDKSGSNKSAISKYIEGKYGSLPPAHASLLTAHLARMKESGELVFPQNTTSARAPPTRRRSAGAGRPPKARGPNAPGAGAQVAVVHGARARAARPRPKXGWNPP

SEQ ID NO: 56231 - DNA, 477 bp, Zea mays
  misc_feature: Ceres CLONE 1494437
  misc_feature (190)..(190): n is a, c, t, g, unknown, or other
  misc_feature (191)..(191): n is a, c, t, g, unknown, or other
  misc_feature (437)..(437): n is a, c, t, g, unknown, or other
atagctggagctccccgcggtggcggccgctctagaactagtggatcccccgggctgcaggaattcgcacgagaccattacctagaacatcctaatcgaaaaagtcttcagcacgcacaccaatcgcccacaagcgctcgcaggagaggtcgaaaccctagcttttgcggcggcgggcgagagaaagatnngatctacgacgttgaaactccccccttctttcggttcctttccttaaaccaaaaaggggcgggccccccaaaaaaggggaaaaaggggggggggcctttatacccccgggggggcccaaagggcccccaggggtttaaaaagaaaaaaaacccctggtgggaaaaaaaaaaaaaaaaaaaatttctccccccaaaaaaaatttttttttttttttgtttgggggaaccaaacacacccccaaaagnggccccttttttttttttcccccgggggagggaaaaaaaa

SEQ ID NO: 56232 - DNA, 657 bp, Zea mays
  misc_feature: Ceres CLONE 1494438
  misc_feature: Encodes the peptide sequence at SEQ ID NO. 56233
  misc_feature (505)..(505): n is a, c, t, g, unknown, or other
  misc_feature (523)..(523): n is a, c, t, g, unknown, or other
  misc_feature (548)..(548): n is a, c, t, g, unknown, or other
  misc_feature (634)..(634): n is a, c, t, g, unknown, or other
aaagctggagctccccgcggtggcggccgctctagaactagtggatcccccgggctgcaggaattcgcacgagaccattacctagaacatcctaatcgaaaaatccaaccacaacccagcgcatcatcgcagcggcggcaactcgtcggagcaagcaaagcaaagcaaagctagcaccttccttctcacgacaagctaataccaagcccgatcgattgacatggccgagaggacgaacgcgatggcggcgccgcggccgctcctgcgccggatgctctcgttccgggagccgctcctggtcatcccgtacctgctcagcttcctgggcgccgcggcctcggcgctgacgcgcagccactcgtcgctgctgcactcgctcgccagggcgctgttcccggccgcgcctgccgccgccaacgccaagcacgcgccgccgcctgccgctgccgctgccgctgccgccgcggcgcccctggacggcgaggacgccgcgctgagcaaggcngaagtggaggcatcatgnctacgatcggcctcgcggcgccggnaaaaggcgaggggctcgcggccgccatgggccgcgaacaagtgtccgcgctcttcgacgccgacgagcccagcttcgcggaggtgnggggcgcctcgccgtcttcgacg

SEQ ID NO: 56233 - protein, 145 aa, Zea mays
  misc_feature: Ceres CLONE 1494438
  misc_feature (101)..(101): Xaa is any aa, unknown, or other
  misc_feature (110)..(110): Xaa is any aa, unknown, or other
  misc_feature (138)..(138): Xaa is any aa, unknown, or other
MAERTNAMAAPRPLLRRMLSFREPLLVIPYLLSFLGAAASALTRSHSSLLHSLARALFPAAPAAANAKHAPPPAAAAAAAAAAPLDGEDAALSKAEVEASXLRSASRRRXKARGSRPPWAANKCPRSSTPTSPASRRXGAPRRLR

SEQ ID NO: 56234 - DNA, 695 bp, Zea mays
  misc_feature: Ceres CLONE 1494445
  misc_feature: Encodes the peptide sequence at SEQ ID NO. 56235
atagctggagctcaccgcggtggcggccgctctagaactagtggatcccccgggctgcaggaattcgcacgagaccattacctagaacatcctaatcgaaaaaccaagtaccaacaggaaaaaaggcccagaggcggtgccgtgaccgattcgagacgcaagagaaggatcgagacgaggcggcggttttccgggggcagcatcggcgcggccacgaaagatgtcttactcaagaggctcaagtgaaaggtatggatctcgctcgccttactcgagaagcacaaggtaccgaagtcgctctaggagtgtcgactctagtgatgctgaaaaccctgggaacaacctgtatgtgactggtttgtcagctcgtgtaacggatcgagatctggagaagcacttctccactgagggtgaggtgattgatgcaagcgttgtatatgatccttggacaagggaatcacggggttttggttttgttaccatggctgctgttaaagatgcagatcgctgcatcaaatatctggaccgttctgtgttgcaaggtcgggtcataactgttgagaagattttgttgacagcaacagggtagatgttggtagctgctctgcaacaaactgatacaacctaacaccaaaccatgccaacctcagccaaaggggaaagagaagacgaggtagaaccccaacacctgggga

SEQ ID NO: 56235 - protein, 122 aa, Zea mays
  misc_feature: Ceres CLONE 1494445
  misc_feature (42)..(113): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSYSRGSSERYGSRSPYSRSTRYRSRSRSVDSSDAENPGNNLYVTGLSARVTDRDLEKHFSTEGEVIDASVVYDPWTRESRGFGFVTMAAVKDADRCIKYLDRSVLQGRVITVEKILLTATG

SEQ ID NO: 56236 - DNA, 625 bp, Zea mays
  misc_feature: Ceres CLONE 1494466
  misc_feature: Encodes the peptide sequence at SEQ ID NO. 56237
  misc_feature (600)..(600): n is a, c, t, g, unknown, or other
  misc_feature (601)..(601): n is a, c, t, g, unknown, or other
aaagctggagctccccgcggtggcggccgctctagaactagtggatcccccgggctgcaggaattcgcacgagaccattacctagaacatcctaatcgaaaaaccacgctgtgcctgtgagtgactcggtcgcatcttccccattctccatcgacgcaccggcggcggcgcaagtgaagcgaagaggaaaggaagctacgagatgtcggcgaccactgcagcggtgcccttctggcgggcggcggggatgacctacatcggctactccaacatctgcgctgcgctggtccggaactgcctcaaggagcccttcaagtctgaggccgcgtcccgcgagaaggttcatttctccatctccaagtggacggatggcaagcaggagaagcccactgtccgcacagaatcggatgactaagggctggcgcgccatggcgacatagtccttcccacagatgatttgaagcgtcgttgcaagtttctgagacttgttatttagttggcttgatttgtaatcaatgctgaagataaatactttttgcgacaatggtctttttacaatgtcgtggtgttttcgttgctaattgcacttgcccttccaanntcagcatgtgaactaatggaatgc

SEQ ID NO: 56237 - protein, 70 aa, Zea mays; identical to SEQ ID NO: 4918
  misc_feature: Ceres CLONE 1494466
  misc_feature (9)..(57): Pfam Name: ATP-synt_Eps Pfam Description: Mitochondrial ATP synthase epsilon chain

SEQ ID NO: 56238 - DNA, 690 bp, Zea mays
  misc_feature: Ceres CLONE 1494476
  misc_feature: Encodes the peptide sequence at SEQ ID NO. 56239
aaagctggagctccccgcggtggcggccgctctagaactagtggatcccccgggctgcaggaattcgcacgagaccattacctagaacatcctaatcgaaaaaatttctcatcggattacttgctgccaactcttgatccaacgatcgctccgtttccgcttccttccctcctccccgcgattgattgggccggtgtgctgacggtgccgtcgctgcttgcttcctccgcagccagtacttggccgagcttctcgcggagcatcagaagctggggcccttcatgcaggtgctgccgatatgcagccggctgctcaatcaagaaatcatgcgggtatcaagcatggttcatgaccatggatttagtgatcttgacaggcgccggtttagaagtcctagccctatgtcctcaccaattgtccggcctaatctacatggcaatggatttggtccttggaatgggatgcaccaagagagattgggctttcctcctcctggaacaagtatggactggcaaggagcaccaccaagccctggctcttatattgtcaagaagatcgttcgcttggaagttcccgtcgactcttaccctaatttcaactttgtggggcgcattctaggggccaggggtaattctctaaagcgagttgaaagcatcactggctgccgtgtttttattagagggaagggtc

SEQ ID NO: 56239 - protein, 136 aa, Zea mays
  misc_feature: Ceres CLONE 1494476
MQVLPICSRLLNQEIMRVSSMVHDHGFSDLDRRRFRSPSPMSSPIVRPNLHGNGFGPWNGMHQERLGFPPPGTSMDWQGAPPSPGSYIVKKIVRLEVPVDSYPNFNFVGRILGARGNSLKRVESITGCRVFIRGKG

SEQ ID NO: 56240 - DNA, 686 bp, Zea mays
  misc_feature: Ceres CLONE 1494663
  misc_feature: Encodes the peptide sequence at SEQ ID NO. 56241
aaagctggagctccccgcggtggcggccgctctagaactagtggatcccccgggctgcaggaattcgcacgagaccattacctagaacatcctaatcgaaaaaccaggcaccagcatagatctcgtgctcgacactattattctgcacagcaacgcatcagccttctggaaccatctcgccgccgccacaccacaatccacaacccgtcgaagcgaagcaagcaatggccggagtcggatcgaaggccctcgccgttgccgccgttctggcggccgtctccttctcggtggccgccgcggccgaggcgcccgcgcccagccccgtctccgccgccgtcgcggcgtcgtcgcccttcgccgccgtccgccactgagccgatggggcctcgtgcctgcaggctacctagcagtacttcccccgccgccgccgccgccgcctagatctatttattggagtgctatccagtagtactagtagtagtgagatttgttcggtgctgtcgtgtcgtcgtcgcattttggtcggatctggtttccttggtgcagggagggtttctataccatgtcgcggtgtcggttgtgtgatctcatcccccccttgtagatagtactctgctatctcgtcgtgatcgtgagtggtgattctgtctggttgatatttgctactgatattggtcccatttgag

SEQ ID NO: 56241 - protein, 49 aa, Zea mays; identical to SEQ ID NO: 55755
  misc_feature: Ceres CLONE 1494663

SEQ ID NO: 56242 - DNA, 687 bp, Zea mays
  misc_feature: Ceres CLONE 1494667
  misc_feature: Encodes the peptide sequence at SEQ ID NO. 56243
aaagctggagctccccgcggtggcggccgctctataactagtggatcccccgggctgcaggaattcgcacgagaccattacctagaacatcctaatcgaaaaatttcctcctcctgtcctccacccaagccaaagcccctcggatcggatccggtctcctccgtgtcccattcgccacgcagcggcgccacaggagacggagacggagatgaagctgtccatccagtcgctcgccaggaagctgtccctgccgtccccgaagcggggcggcggcggcatcgtcgaggacgggaagaagaagaagaagcgctcgctgtcgcgcggcgaggcgccgtcgttcgcgtcctcttcttcatcctcctcctcctcctcctccaccacgacgccgcggtccgtgctggcggcggcgccggcgctggagatcccgcggcgggagctggaggccgtgctgcggcgcctgggccacgcggagccgtccgacgccgagctcgacgccgtggccgctctcgccgcgcagcccccgccgggcgacgccgacgcggacgccgacgccgacctcatggaggcgttccgcgtgttcgacgcggacggcgacggccgcatcaccgccgaggagctccgcgccgtcctggacgccgtcctcggcggcgggtgcagcctcgacgactgccgccgcatgatcggcgg

SEQ ID NO: 56243 - protein, 159 aa, Zea mays
  misc_feature: Ceres CLONE 1494667
  misc_feature (116)..(144): Pfam Name: efhand Pfam Description: EF hand
MKLSIQSLARKLSLPSPKRGGGGIVEDGKKKKKRSLSRGEAPSFASSSSSSSSSSSTTTPRSVLAAAPALEIPRRELEAVLRRLGHAEPSDAELDAVAALAAQPPPGDADADADADLMEAFRVFDADGDGRITAEELRAVLDAVLGGGCSLDDCRRMIG

SEQ ID NO: 56244 - DNA, 694 bp, Zea mays
  misc_feature: Ceres CLONE 1494671
  misc_feature: Encodes the peptide sequence at SEQ ID NO. 56245
  misc_feature (402)..(402): n is a, c, t, g, unknown, or other
aaagctggagctccccgcggtggcggccgctctagaactagtggatcccccgggctgcaggaattcgcacgagaccattacctagaacatcctaatcgaaaaatacgggcccgtgtctcagcgcacacctcttcgtgctcgctcccatggaggccaccccgatctccatgaagccaccggcgccggcgccggcgccacccccggtcactctggagcccatagaattgtcaacgcatgccgtcggagtgaccgagctggagcgatccagcatgaaccagctcgcaatagcgccggaccccaagcggcagagggtggaggaggctgccgatggcaacgggtgcaagcattgcgcctgcaagaagtccagatgcttgcagctctattgcccgtgttttgctggangtggttattgttcccataagtgtggctgcccaccatgtttccaacaagaagcctttttagaaacagtttaaactactcgcaaggtgttacttttcagaaagaagcgcatgtcgatgaaaattaatagggagacctggggcaaatgctgaacccatgggaagaagttccccttctttcttcgtcaactccaccaaggagagggtggcacctgcagaaaacaagttgcctgaaaaaaaaccgtgaatgctccccggaatgggaccgatggttccttgttttcccctttggacca

SEQ ID NO: 56245 - protein, 108 aa, Zea mays
  misc_feature: Ceres CLONE 1494671
  misc_feature (63)..(104): Pfam Name: CXC Pfam Description: Tesmin/TSO1-like CXC domain
  misc_feature (86)..(86): Xaa is any aa, unknown, or other
MEATPISMKPPAPAPAPPPVTLEPIELSTHAVGVTELERSSMNQLAIAPDPKRQRVEEAADGNGCKHCACKKSRCLQLYCPCFAGXGYCSHKCGCPPCFQQEAFLETV

SEQ ID NO: 56246 - DNA, 668 bp, Zea mays
  misc_feature: Ceres CLONE 1494681
  misc_feature: Encodes the peptide sequence at SEQ ID NO. 56247
  misc_feature (328)..(328): n is a, c, t, g, unknown, or other
  misc_feature (422)..(422): n is a, c, t, g, unknown, or other
caaagctggagctccccgcggtggcggccgctctagaactagtggatcccccgggctgcaggaattcgcacgagaccattacctagaacatcctaatcgaaaaagctacaaccgaagccaccaccagcagtcccgcacgactagcggaataatatccaccggcgacgggaacgggaggcggcgcggccggagattcgaagcgatggcgttcacgatgcgggcagtgaaggtgcctccgaactcggcctcgctggaggaggcccggcaccgcgtcttcgatttcttcaagcaggcatgccgctctatccccaccgtcatggagatctancacctcgacgacgttgtcacgccctctcagctccggctcgaccatcgctaagggagatccgtaaaaccccaaacgtcaccacccccaggtgggntgatatgcttctgttcaacgcgacggaagagctgaacaacttagtccaacattcaaagcaccgccttcatgtgatggggcatatgggatccggccaaaagggcctgtgcctgactggggtccaaagaatttgggaaacctggacttcctgaaaaaattctacaaagctattcctctgagacggggggggcaatttcaaacctcgggatccccccgggggggccttaaaaaaacaaaccctgggccc

SEQ ID NO: 56247 - protein, 58 aa, Zea mays
  misc_feature: Ceres CLONE 1494681
  misc_feature (42)..(42): Xaa is any aa, unknown, or other
MAFTMRAVKVPPNSASLEEARHRVFDFFKQACRSIPTVMEIXHLDDVVTPSQLRLDHR

SEQ ID NO: 56248 - DNA, 747 bp, Zea mays
  misc_feature: Ceres CLONE 1494692
  misc_feature: Encodes the peptide sequence at SEQ ID NO. 56249
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (20)..(20): n is a, c, t, g, unknown, or other
  misc_feature (21)..(21): n is a, c, t, g, unknown, or other
  misc_feature (33)..(33): n is a, c, t, g, unknown, or other
  misc_feature (39)..(39): n is a, c, t, g, unknown, or other
  misc_feature (40)..(40): n is a, c, t, g, unknown, or other
  misc_feature (47)..(47): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (92)..(92): n is a, c, t, g, unknown, or other
  misc_feature (93)..(93): n is a, c, t, g, unknown, or other
  misc_feature (95)..(95): n is a, c, t, g, unknown, or other
  misc_feature (152)..(152): n is a, c, t, g, unknown, or other
tgtaaaagagtnnnnggccnngggcggcctccncccccnntggaggnttttgtggnnnnnnncaaactggtgctgaccgggggggaagttgnncntttactaaagagaccgcgggctgcaggagtggccaaagagggtaccgagaacatccnaatcgaaaagacgccactcccacctctcttcttctctttcccttcgcattaatggccgctctctccctatcccctttcgtctcgctctcggagtaggacactcgcccgcttccggcttaaccttcaagattctccctcctcctcctacttcttcccgcttgggcgggcgcggcaccttccggttctgggcctcctatatatatacgcgcgcgaaccgtcccccttcatactccctagcatgctcggctcgcaccccggattgatcgagctcccccgcccccccaatgggatcgggggcctcccccctcctctttaacccggggcaccccttccccccgggcccgggtgccccctttaaaccccttgggaaggggggggcccagggaacaccccccccccccccggcggggccccccgggggggggggcttgggggccccgtgtcacacggggggttttccccccccgggggggccccccccccgcggggagaacctcctcttggtggggcccctctcgggggggggtggtctcccaccaaaaaaagggggtttgtgtctccccgccgggggggggggggtgtccgagaaaaaaaa

SEQ ID NO: 56249 - protein, 103 aa, Zea mays
  misc_feature: Ceres CLONE 1494692
MGSGASPLLFNPGHPFPPGPGAPFKPLGKGGAQGTPPPPPAGPPGGGGLGAPCHTGGFPPPGGPPPRGENLLLVGPLSGGGGLPPKKGGLCLPAGGGGVSEKK

SEQ ID NO: 56250 - DNA, 785 bp, Zea mays
  misc_feature: Ceres CLONE 1494715
  misc_feature: Encodes the peptide sequence at SEQ ID NO. 56251
tggagctccccgcggtggcggccgctctagaactagtggatcccccgggctgcaggaattcgcacgagaccattacctagaacatcctaatcgaaaatctcgccccccttcccctccgttgttgtcttgtcaagttgcggttgtctccctcctccggcgctcccttccgcccctcccttcccgccgcctccgcgcagatcgccaggcgaggaaccagaccgcagggcaggatgcagtacaagaacctggggcggtcgggcctccgcgtcagccagctctcgtacggcgcgtgggtcaccttcgggaaccagctggacgtgaaggaggccaaggcgctgctgcagacgtgccgggacgctgggcgtcaactttttgggaaaacgcccaggtgtaccgccaacggggcgcgccccgaggaaaatcatgggccaaggccatcccgggaaccctggggttgggcgccccctcccaaagttcttctttctccacccaagcctctttccgggggcgggcccggggcccccaaaagaaaaagggggcctccccccagaaagaaaccgtccgtccaaggggccttccggggggttcggcttccggccggccttggccatgggaacataccgtccaaagtcctgtctaattggcccacccgcccccgaaggcggtcaccacaccccgttcaaagggaaaaacggtggccgccgcccaatgaaacttggggccacatcccaccaggggggcgtgggcccctccttacctggggggccaccctcccagaggtgggc

SEQ ID NO: 56251 - protein, 185 aa, Zea mays
  misc_feature: Ceres CLONE 1494715
MQYKNLGRSGLRVSQLSYGAWVTFGNQLDVKEAKALLQTCRDAGRQLFGKTPRCTANGARPEENHGPRPSREPWGWAPPPKVLLSPPKPLSGGGPGAPKRKRGPPPRKKPSVQGAFRGVRLPAGLGHGNIPSKVLSNWPTRPRRRSPHPVQREKRWPPPNETWGHIPPGGRGPLLTWGATLPEVG

SEQ ID NO: 56252 - DNA, 761 bp, Zea mays
  misc_feature: Ceres CLONE 1494720
  misc_feature: Encodes the peptide sequence at SEQ ID NO. 56253
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (29)..(29): n is a, c, t, g, unknown, or other
  misc_feature (30)..(30): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (498)..(498): n is a, c, t, g, unknown, or other
  misc_feature (550)..(550): n is a, c, t, g, unknown, or other
  misc_feature (680)..(680): n is a, c, t, g, unknown, or other
  misc_feature (761)..(761): n is a, c, t, g, unknown, or other
gtggcccccccccnnnnntccggcttgtnntttnnnnngaaaagtataacaatgctgggactcaccgcggtggcggccgctctataatagtggatcccccgggctgcaggaattcgcacgagaccattacctagaacatcctaatcgaaaaaatagaagtgacaactccatctctggtctcccagactcccacgcctataatctcattcccctccttcaaagccctctggcgatcgagattcttccccctccgtctccagatatggcaaacaaaaggattcagaaggaactcatggatctgcaaaaggacccaccgacatcatgcagtgcagggccagctggagaggatctattccactggcaggccacaatcatgggtcctagcgacagcccctatgcaggaggggttttctttgttaatatccattttcgtcctgactacccgtttaagcctccaaaagtgaatttgcaaaccaaggtttatcacccgaacatcanctctaaggggagcatctgccttgatttccctcaggagcaagggagccctggnctgaccatataaaaggtcttcctctccatcagctcgcttctgattgaccccaacccagaaaaccccctcgtcccccgaaatcgcccacttgtaccagaaaccaaagggccgcgcctaccaaggaaaccgnaacgggtcctgcgaccccaaaagaaacgcgaatggggctaagcttaattccggtcctcccacgaaaacaaataacagtccn

SEQ ID NO: 56253 - protein, 99 aa, Zea mays
  misc_feature: Ceres CLONE 1494720
  misc_feature (5)..(98): Pfam Name: UQ_con Pfam Description: Ubiquitin-conjugating enzyme
  misc_feature: SWISSPROT Homolog: EC 6.3.2.19 Ubiquitin--protein ligase
  misc_feature (79)..(79): Xaa is any aa, unknown, or other
MANKRIQKELMDLQKDPPTSCSAGPAGEDLFHWQATIMGPSDSPYAGGVFFVNIHFRPDYPFKPPKVNLQTKVYHPNIXSKGSICLDFPQEQGSPGLTI

SEQ ID NO: 56254 - DNA, 784 bp, Zea mays
  misc_feature: Ceres CLONE 1494724
  misc_feature: Encodes the peptide sequence at SEQ ID NO. 56255
  misc_feature (5)..(5): n is a, c, t, g, unknown, or other
  misc_feature (6)..(6): n is a, c, t, g, unknown, or other
  misc_feature (315)..(315): n is a, c, t, g, unknown, or other
ggggnnggggcgcgcgttcccttcccccccccccctgttgaaacccccccaaactggcgctccccgcggtggcggccgctcttttaatagtggatcccccgggctgcaggaattcgcacgagaccattacctagaacatcctactcgaaaaaaagaaaaacacaagacctcctattcaccatgccgaccgaagagggttccgacggcggtggcggcgccggagccggagccggggagaagaagagctcgcaggcgcccgcaaagcctggagcgtgcggcgccgcaaagttcctcgcggggttgccgtcgcgaggnaacttctcttccgggtccgccccctccaatctgggagggttcagggtttacctctgcgagcacaacacagatcccccagaaggacaagttataaagacggattcaacgaaaattttaaccacgcatctccagttgaacaagtagaagactccccacaccgtatggaccattcccagaattgtcggcgaaaacaacagaaggaaaagatctgccgcccagaatttggcatggcaacatttcagcaaacaagggtaaattggggaactccatctggaacccacacccaaaagaggtaaattgctaggattttcaccaaccaataacttgacagcccttttacaatttgcaaaaaactggagagggcaccttctccccaacgaacccggccccccacgcaatccgatagggccagaaacagaatgaaacacgagattgacctcaactataaaggcgaaacaaccccacagag

SEQ ID NO: 56255 - protein, 92 aa, Zea mays
  misc_feature: Ceres CLONE 1494724
MPTEEGSDGGGGAGAGAGEKKSSQAPAKPGACGAAKFLAGLPSRGNFSSGSAPSNLGGFRVYLCEHNTDPPEGQVIKTDSTKILTTHLQLNK

SEQ ID NO: 56256 - DNA, 759 bp, Zea mays
  misc_feature: Ceres CLONE 1494725
  misc_feature: Encodes the peptide sequence at SEQ ID NO. 56257
  misc_feature (20)..(20): n is a, c, t, g, unknown, or other
  misc_feature (21)..(21): n is a, c, t, g, unknown, or other
  misc_feature (35)..(35): n is a, c, t, g, unknown, or other
  misc_feature (37)..(37): n is a, c, t, g, unknown, or other
  misc_feature (38)..(38): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
gttgtgcggccggggggtcnntacccccagaccancnncccccnnnnnnnncaaactgggactccccgcggtggcggccgctctagaactagtggatcccccgggctgcaggaattcgcacgagaccattacctagaacatcctaatcgaaaaatcgtttatccacggaacttccggtgccggcggcgaccacttgtggcgatccatccctcaccatgtcgtcggagaaggaggcggcgctcgccgccgtgctcgatgacagcccaaccatatttgacaagatcatcaaaaaggaaataccttctactgtggtttatgaggacgagaaggtactggctttcagggacataaaccctcaagctccaacacacattctcatcatccccaaagtcaaggatggactaactggcctggcaaaggctgaagagaggcacatacaaatacttggctatctcctctatgttgccaaggttgcccccaaccaggaaggacttgaagatggctatcgcgtcgtcatcaatgacggcccaagtggatgtcaatctgttttaccccatccacgttcatcctctcggaggcagggcaaatgaactggcccccaggctaagaatatcttgtgattgatcaggtgcaaatgccaaggactggcaacccccttttccctaaaataatcccttgaaatttcccacaaaaagctaagtgccgcagtgccgctgaacctttgagcctaatattgtgggggaaattacccggacaacc

SEQ ID NO: 56257 - protein, 124 aa, Zea mays
  misc_feature: Ceres CLONE 1494725
  misc_feature (25)..(117): Pfam Name: HIT Pfam Description: HIT domain
MSSEKEAALAAVLDDSPTIFDKIIKKEIPSTVVYEDEKVLAFRDINPQAPTHILIIPKVKDGLTGLAKAEERHIQILGYLLYVAKVAPNQEGLEDGYRVVINDGPSGCQSVLPHPRSSSRRQGK

SEQ ID NO: 56258 - DNA, 706 bp, Zea mays
  misc_feature: Ceres CLONE 1494727
  misc_feature: Encodes the peptide sequence at SEQ ID NO. 56259
tggagctccccgcggtggcggccgctctagaactagtggatcccccgggctgcaggaattcgcacgagaccattacctagaacatcctaatcgaaaaactcttcgtcctcctcgatcgtcccaacaaccgcaatggcgcagcagaggcttctcgctctcctcctggtggcggccctcctcgcgctctccttctcgcaagggcaggtggaagcgcggaaggtgcaggtgcggcgcgcgcccctcggcggcggcggccgcctgcttccggaggcgatgatggcgtacacgacgacggactacgggccccccacggccaacaccaacacccacggcggcatggtcccgtcgccggacgacccctcctcgccgccgacgcactgaccggccagtcgatctcaccggcaacaactgtgttgttctttgggattggagctttggaagaaagattggaggagaggatcggaagaagctggtcttgttcttctcccttattgggcgcgcgtgttgtgttgtgcgctgctgtgtctgtgtagcccacctgtagctgctgctgtgcttacctgattgaagttggaactgtagtggggtccccagtattatgcaatgttttgttttgttcgaaacttccaaaaaaaaaaaaaaaaaagctttatcgaaaaccgtccaaccctcgaaggggggggccccgggaacccaaattcccccc

SEQ ID NO: 56259 - protein, 82 aa, Zea mays; identical to SEQ ID NO: 44249
  misc_feature: Ceres CLONE 1494727

SEQ ID NO: 56260 - DNA, 789 bp, Zea mays
  misc_feature: Ceres CLONE 1494728
  misc_feature: Encodes the peptide sequence at SEQ ID NO. 56261
  misc_feature (22)..(22): n is a, c, t, g, unknown, or other
  misc_feature (23)..(23): n is a, c, t, g, unknown, or other
  misc_feature (30)..(30): n is a, c, t, g, unknown, or other
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
tttggggggctcccccgccccnntcggtgntttatngnngggtttannnnataaactggaactcaccgcggtggcggccgctctatactagtggatcccccgggctgcaggaattcgcacgagaccattacctagaacatcctaatcgaaaaacccctcgagatctctccctccccgcgccgccatggacgcagttgactcggtagtcgacccgctccgggagttcgccaaggacagcatccgcctcgtcaagcgctgccacaagccggaccgcaaggagttcaccaaggtcgccgcgcggactgcgatcggcttcgtcgtcatgggattcgtcggcttctttgtcaagctcatcttcatccctatcaacaacatcatcgtcggttccggctgatccgtaaacctcaggctagtggttgcaggaatggacaatggccctcacaaccttgcaggcaccaccgttttcagctccccccccccgcaaaaaaattccttttaggatttggggtgtttaaagggcaacctcccttatccttttcctcttcttgaaagccggggggaaaaatctggaaatctttttgtaccctggggccaaaaaatccttttggtggatcagcgggggggatcaaaattaaaagggttaaccggttgcgctctcgataatataaacaaaaaagcatcaaaaaaagctttactcaatttcccgccgaaacctccgagggggggcgggcccgggtaaaccccaatttctgggccgttataagggggattccttaatattcggccgcg

SEQ ID NO: 56261 - protein, 69 aa, Zea mays; identical to SEQ ID NO: 51077
  misc_feature: Ceres CLONE 1494728
  misc_feature (10)..(66): Pfam Name: SecE Pfam Description: SecE/Sec61-gamma subunits of protein translocation complex

SEQ ID NO: 56262 - DNA, 760 bp, Zea mays
  misc_feature: Ceres CLONE 1494732
  misc_feature: Encodes the peptide sequence at SEQ ID NO. 56263
  misc_feature (17)..(17): n is a, c, t, g, unknown, or other
  misc_feature (36)..(36): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
gtggtggttcccccccnacccccacagacgggcccnttccannnnnnnnnnnnnnaaaactggagctccccgcggtggcggccgctctagaactagtggatcccccgggctgcaggaattcgcacgagaccattacctagaacatcctaatcgaaaaaaaaacccaagtaggcttgccctcgcggtcgcagctagcgaaccctaatggagatcgctgaggccctgcaggcctacacgggcctcacacccgcggccgccgccaccatcctcgccctcatggtggccacctacctcctcgtctcctccctcttcgtcgcccccgcccccgcccccgccccactttccaagccgccccagcagcagcgcgagggggagaaggcacaggaggaggaggaggaagaaccgatgcctttcgtgtatccggaccccgtggaggtgggcgagctcacgctcgagcagctcagtgcgtatgacccccccgacccagccaagcagatcctcattgccttccggggccaggtctacgacgtcccccgcgggaggctcttttaatgcccctcagggaccatattccttgtttgcccgggaaggaatgcaacccccggcccctggcatttgaatgtctttttggacccaaacccaccctcaccggggggatttgggaacggccctaaaccgcccaaagaaccttggaagggtgtttgcaaaaattggcgaagggaaaaaaattcccagggaaaaagggaatccctcaaagggg

SEQ ID NO: 56263 - protein, 115 aa, Zea mays
  misc_feature: Ceres CLONE 1494732
MEIAEALQAYTGLTPAAAATILALMVATYLLVSSLFVAPAPAPAPLSKPPQQQREGEKAQEEEEEEPMPFVYPDPVEVGELTLEQLSAYDPPDPAKQILIAFRGQVYDVPRGRLF

SEQ ID NO: 56264 - DNA, 691 bp, Zea mays
  misc_feature: Ceres CLONE 1494740
  misc_feature (513)..(513): n is a, c, t, g, unknown, or other
  misc_feature (520)..(520): n is a, c, t, g, unknown, or other
  misc_feature (638)..(638): n is a, c, t, g, unknown, or other
gctggagctccccgcggtggcggccgctctagaactagtggatcccccgggctgcaggaattcgcacgagaccattacctagaacatcctaatcgaaaaagactgacaataccgtcctcaggacaaggcacctcagaagcccttctcgtccgcgccgcctccttgaccccgctggccggcgagctgctcagcgcggcttttttttgcatccacatgccgcagcttggccctgttcatggcctgagctgcatctatggcacttcaactagaaaattggaggttggagttcaccaaataaaggtaacccatccctttggggcggaaaggccgggtaaacccccttttaaaaggggggaggggggcccctccaaaaacgggggccaaaaaaaatcttcggggggatttttccccggggaaaaaaaagaatgttttgggggcccaattgggggaggggagggggggggcccccccccctccccttttaaaaaaagggggggggggggagggcgccgnagaaaanggggcgaccccccggggggggattttccccccccccccggggggggccaccaaaaaaaaaaaaaaaaaaaaaaaacccttcctctcccccccccccccctaaaaaaataaccgccgcnccggcgggaattctctttttttcctccccccccaaaaaaaaaaaaaaaaaaac

SEQ ID NO: 56265 - DNA, 759 bp, Zea mays
  misc_feature: Ceres CLONE 1494743
  misc_feature: Encodes the peptide sequence at SEQ ID NO. 56266
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
gttttaagctacaccatctttcacacctttccgcagtagtnnnataaaannnaaaaaagctggagctccccgcggtggcggccgctctatactagtggatcccccgggctgcaggaattcgcacgagaccattacctagaacatcctaatcgaaaaagaaggctcgcgacatcagctcgagccagctgacgggatccacacggcgccatgtcttcccggcggccgtcgcatccgtcccaccggaatccacggcgattcccgtccgcctgctatcttctagtactcacccttgccctcctcgtcgtctctgccgctgccaagtcctcccgccgccccatctccgacaacgagatccggcagaagaaggaggcctgctacaccgacgtcaagaacgggctgtggggatgggtgtgcaggtactcgccgacggagaaggagaactgcgtgttgcgctgcctctcgccggagtgctaccacctcatatacggcggggatcccgcttgaggaaggggagttggactatgttcgaggccaggagtacaagtattgtatgcacaaatcatcccctttggagaaagcttggatggtgtgaaagggatccttcccctactcctgaaaggaatgagaagaaaaaaggttctggttagtcctgctggaaatattttatttaacaatctgtgaaacagaacattgcatcctctttttagaataaacgggaaccctggtaaatttcccagaacttttgggcttttttccccc

SEQ ID NO: 56266 - protein, 98 aa, Zea mays
  misc_feature: Ceres CLONE 1494743
MSSRRPSHPSHRNPRRFPSACYLLVLTLALLVVSAAAKSSRRPISDNEIRQKKEACYTDVKNGLWGWVCRYSPTEKENCVLRCLSPECYHLIYGGDPA

SEQ ID NO: 56267 - DNA, 700 bp, Zea mays
  misc_feature: Ceres CLONE 1494751
  misc_feature: Encodes the peptide sequence at SEQ ID NO. 56268
tggagctccccgcggtggcggccgctctagaactagtggatcccccgggctgcaggaattcgcacgagaccattacctagaacatcctaatcgaaaaacatacaacatgctagcctagtcctcttctagtcgcctctacccagttacttgcatcgccccgtcaagcacgccgccggcacgcggccctcggtctccccgccgcgccctctgcctccgcccgaacaaagccgtctcgccgtcgcgttgccttccttaccgtccaccgcgggcagccgtcctagtactcggttggtcctcccctgctgcccttctacggtggaggagcggagatcctgccgttttccggctgatttcttctaattgcggggcaagttccgtggatagtcaatactgcttgtgctgttgagctaatataaagttcctgctggaagaactttctgcagttcctatgggcaagcctctcaatgccagtggccgtagcatgccaagatcgaatgaaggaatgcggctcatattttcggcagttggaaggggcatgctgggttaactgttttgggatctccttccctaaagtaaacataaccaaagcttcacttcccttcgaggaacatctcttaaatccgaaaataagaactctggcttcacaacccaaacatttgttgaaaccatgcttggggcatctgaaaaacatcaaaaaaaa

SEQ ID NO: 56268 - protein, 78 aa, Zea mays
  misc_feature: Ceres CLONE 1494751
MPVAVACQDRMKECGSYFRQLEGACWVNCFGISFPKVNITKASLPFEEHLLNPKIRTLASQPKHLLKPCLGHLKNIKK

SEQ ID NO: 56269 - DNA, 863 bp, Zea mays
  misc_feature: Ceres CLONE 1494758
  misc_feature: Translation starting site: 250
  misc_feature: SWISSPROT Homolog: EC 2.7.7.13 Mannose-1-phosphate guanylyltransferase
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
taataatcccataccactacgaaagattcccannnnnccccctnnngcatagctggaactccccgcggtggcggccgctctagaactagtggatcccccgggctgcaggaattcgcacgagaccattacctagaacatcctaatcgaaaaatcggggtcggtggatctcactgttttcttttcctgctgcttgctgcatttttcgcagggtgtgggagctgagttgggaggaggattgctgctgcaaccatgaaggccctcattctcgtcggaggcttcggcacccgcctgggcccgctcacgctcagcgtccccaacccgctcgtggatttcggcaacaagcccatgatcctgcaccagatcgaggctctaaaggaagttggtgttacaaaggttggccctggccatcaatttacaagcctgaagtcatgctcaactttcccccaaggactcccaaagccaaccttggcccccccccccatcacctggcttcccaggataacggaagcccccctcggggaacccgcaggccccgccttggcccctgggcccccgcgaacatgcctccgcccaacgggaattccggagaaacccctttttcattcctaggattcaaacacccctacctgcatcaacccgtaataaccccgtctcgcgccgtagctcttttttgaaatttccccccgcgcccccaacgtccgagtcgagggccccacctaacacctgcggggacccaagatgccccaccacaaaccccccaccttcatcccgcatcgttgccattcctctcaattcaacaaactccgtccccccctacaaaaatgtcaaactccctcctccttcggtaaaatcatcccccgtgg

SEQ ID NO: 56270 - DNA, 685 bp, Zea mays
  misc_feature: Ceres CLONE 1494764
  misc_feature: Encodes the peptide sequence at SEQ ID NO. 56271
aaagctggagctccccgcggtggcggccgctctagaactagtggatcccccgggctgcaggaattcgcacgagaccattacctagaacatcctaatcgaaaacccctctgttcccctcccaagaaaccccacatttgcatgggcaagcacctacctgccgccgccaccgccgccgccgccgccgcggttcgctcgtacgcccgcagccttcgcgtcccatccgataccgccgcatccgccgggagggcagctaagacgccgtctgccccgctggatacacccaggaaatccgctgccgccgctgccgcggccagctccgggcgggccgaggtgcgggatttggcggcggcgtgcgggctaaaggcggacgagagggttccgctcgcgaaggtggtgtcggactgcacgaagcggtgggtccagaacgcactcaaggaggcgcgcgccggcgacatcaccatgcaggtgctcgtcggccagatgtaccgcagcggatacggtgtcaacaagaacgagcacaaggcaagaggtgggaatggaaaagcatcaagatatcgggctacagtctgaaaagttaccaataaacgtcccaggtacaatgccagtgactcggactccggcacagatgatgctaaagaaacatgcaataaaaaaaattgaaattttgacataaagggaccgcagc

SEQ ID NO: 56271 - protein, 143 aa, Zea mays
  misc_feature: Ceres CLONE 1494764
MGKHLPAAATAAAAAAVRSYARSLRVPSDTAASAGRAAKTPSAPLDTPRKSAAAAAAASSGRAEVRDLAAACGLKADERVPLAKVVSDCTKRWVQNALKEARAGDITMQVLVGQMYRSGYGVNKNEHKARGGNGKASRYRATV

SEQ ID NO: 56272 - DNA, 758 bp, Zea mays
  misc_feature: Ceres CLONE 1494765
  misc_feature: Encodes the peptide sequence at SEQ ID NO. 56273
  misc_feature (14)..(14): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
gggtggtccccccnccctcccgggcgggcgccnnncaccgacccccccccaagctggagctccccgcggtggcggccgctctttaatagtggatcccccgggctgcaggtattcgcacgagaccattacctagaacatcctaatcgaaaaaatcgagcatcgcatagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttccccccaccttgaacccactgtcatcgatgaggggaggactggcacctaccgccagctcttccaccctgagcagctcatcagtgggaaggaggatgcaaccaaacaactttgcccgtgggtcactaccccattgggaagggagattgttgaacctatgccctggatccgaaccaagagagcttggccaaaaacttgcactgggtctccaggggccttcctcccgacttcaaccgttgattggggggaaagaaaacgggcccctgggccccttgggccccctccccctcctaaaa

SEQ ID NO: 56273 - protein, 164 aa, Zea mays
  misc_feature: Ceres CLONE 1494765
MRECISIHIGQAGIQVGNACWELYCLEHGIQADGQMPGDKTIGGGDDAFNTFFSETGAGKHVPRAVSPHLEPTVIDEGRTGTYRQLFHPEQLISGKEDATKQLCPWVTTPLGREIVEPMPWIRTKRAWPKTCTGSPGAFLPTSTVDWGERKRAPGPLGPPPPPK

SEQ ID NO: 56274 - DNA, 663 bp, Zea mays
  misc_feature: Ceres CLONE 1494773
  misc_feature: Encodes the peptide sequence at SEQ ID NO. 56275
agtggatcccccgggctgcaggaattcgcacgagaccattacctagaacatcctaatcgaaaatcttctctctctctctctctctctctgatttcttctcttaactctcgcgtctcgcgtccttttcccttcctcccctccgttgcgtccgtcgtctgcgttgcgtccctccgtccgtccgtccgttggcccgtccgtcgtcaccagcctcctccctcgcgcccaccgccgggatccggccctcctcgtctgcgcccgcctcggtctagatttctgagaaaatggcgagaagtgcgggaactaggaggcgtgtggctcgccagctcaagtccacacatcccattccttcataccgatggaagtcaaagcccatgaaaaaccccaccaaaaaatccaaccgaaagcaagtgttgccaaccttgcaaaagatggactgggaaaatgccaattgctctgtgtgcatggaaaacccacataatgctgggctcttcctttggtcatcccatgaaaaggggtgtccgccctaaaaggggggaaaaaaactaccgccactcaaaatggctggaatccatcaaaaaaagctaacaccaagggggcatttgccttgagaaagtttcccgcgaaaaaatggtggggcacaaaatcggagatagggtgccttta

SEQ ID NO: 56275 - protein, 81 aa, Zea mays
  misc_feature: Ceres CLONE 1494773
MARSAGTRRRVARQLKSTHPIPSYRWKSKPMKNPTKKSNRKQVLPTLQKMDWENANCSVCMENPHNAGLFLWSSHEKGCPP

SEQ ID NO: 56276 - DNA, 680 bp, Zea mays
  misc_feature: Ceres CLONE 1494790
  misc_feature: SWISSPROT Homolog: EC 3.6.3.44 Xenobiotic-transporting ATPase
  misc_feature (680)..(680): n is a, c, t, g, unknown, or other
ggagctccccgcggtggcggccgctctagaactagtggatcccccgggctgcaggaattcgcacgagaccattacctagaacatcataatcgaaaaaaggagccagggccgctccgctccgctccgctcgtgctctgctcctgctctctctctctctcggcgtcgattgggcgaccgccgccgcctcccccaggtcttcgctgggcccgtcgccggcgccgagcacccaccagggcaagttttacttgataatgtggacatcaagacgttgcaattaaagcgacttagagaccagatcggattggtgaatcaggaacctactctttttgcaactacaattcttgagaatattctttttggcaaacctgaggcgacaaaggcagaggttgggtctacgactacttccgcagtagattaaaggagccctagctttcggaggacaacccagatgccttcaaagttcaaaatgacggtgatgaaggtggacaagaaacaaaattttggatggttcaaaattttgctataggtcctagcaacgcttatgtgttgctataggggggttattttgtagtgaactcccaggccatatgctagcttactttgaagagtgcccactatttgtgcatgctacaggcgctatctttacatttccttgaactgtaaagtggggaactcctttn

SEQ ID NO: 56277 - DNA, 675 bp, Zea mays
  misc_feature: Ceres CLONE 1494805
  misc_feature: Encodes the peptide sequence at SEQ ID NO. 56278
gctggagctccccgcggtggcggccgctctagaactagtggatcccccgggctgcaggaattcgcacgagaccattacctaaaacatcctaatcgaaaagtgatactccctcagattcttaccaaaacacaggagcccgtcggccgtcgcaaaaaaacaaaacaagaccaccgcaccatggaatcgctgacgcttcgcgcttcgacggccgcctcgccgctgcagcgacgccggctgctccccgggcggcagcgcgcgacgtacgtccgcgccacggcctccgccggcgagccggacctctccgtgcgcgtgaacgggctgcagatgcccaacccgttcgagatcgggtcggggacaccggacaccaactacaccgtcatgaaacgcgccttcgacgagggctggggcgccgacatcaccaagactgtgtccttggatgctgaataagatatcaacgttactcctcgttatgaaaagcttctggcagaaccaaatggggctgccatggggcgcatcactggctggcacagcattgagctcatcagtgacaggcctctggagaccatgctgaatgagttcaaacggttgaggaaagagcatcctgacaggatacttatcggttcagttatggaggagtacaacatagctgcatggcatgagcttattgaacgtgta

SEQ ID NO: 56278 - protein, 89 aa, Zea mays
  misc_feature: Ceres CLONE 1494805
  misc_feature: SWISSPROT Homolog: EC 1.3.1.2 Dihydropyrimidine dehydrogenase (NADP(+))
MESLTLRASTAASPLQRRRLLPGRQRATYVRATASAGEPDLSVRVNGLQMPNPFEIGSGTPDTNYTVMKRAFDEGWGADITKTVSLDAE

SEQ ID NO: 56279 - DNA, 712 bp, Zea mays
  misc_feature: Ceres CLONE 1494932
  misc_feature: Encodes the peptide sequence at SEQ ID NO. 56280
  misc_feature (394)..(394): n is a, c, t, g, unknown, or other
atagctggagctccccgcggtggcggccgctctagaactagtggatcccccgggctgcaggaattcgcacgagaccattacctagaacatcctaatcgaaaaacttggccgtcctcccgagctgcggcggccgcatcgattgctagggtgaaaatccgttctccggcgattttgggctctcgggaacagacaggaggatccgcgggaaggattcggctgcgtcctattgtagtgtcgacatggctgggcgcacggagaccgcactcgacctggcgaagttcgtcgacaagggcgtccaggtgaagctcaccggcggccgccaagtgtaaggaactttaaagggatatgaccagctactcaacttattgctacacgaagcagttgagtgtgaganacatcaagatgaccctttgaacctaccacggaaaaccatacagcttggcctcattgtgtgcagaggggccgcattcatgcaggtctcacccactgatggaactgatgagatcgccaacccttttcttgctgaaagagcataagcttgcagttggtcaaatatttagaaccgtgttttcttgtcacccttataacgaagggtttttcttgggaaaaaaaacggtttttcccgtaccggttggggatgaactctgtaaaacttcccgcgcaagtgccaccttgaacctccgggcgtccataaaaaaaaaaaagaaggttg

SEQ ID NO: 56280 - protein, 29 aa, Zea mays
  misc_feature: Ceres CLONE 1494932
MAGRTETALDLAKFVDKGVQVKLTGGRQV

SEQ ID NO: 56281 - DNA, 905 bp, Zea mays
  misc_feature: Ceres CLONE 1494937
  misc_feature: Encodes the peptide sequence at SEQ ID NO. 56282
  misc_feature (34)..(34): n is a, c, t, g, unknown, or other
  misc_feature (35)..(35): n is a, c, t, g, unknown, or other
  misc_feature (557)..(557): n is a, c, t, g, unknown, or other
gagttccctccccattccgtcccccgcccttccnntactcctccttatacactggtgctccacgcggtggcggccgctctagaatagtggatccctcgggctgcgggaattctcaagagacctttacctagaacctcctaatagataattcctcacccagtcgaggaccctctccgaatccgagggttcaagcgactgacggcgaacatggtggcggacggcggcccagcgacgtcggcgctggaagaggccctcaagccctatcaggatagagcctccgaggctgagatacgcatagccaagctggaagccttgttgtataataaagatggtccgagcgggggatccgaggccacttccctctgccgtgaaaggatctcctctcgaaagctagatggggcttactgccggattggtctggatttgttaggggacaaaacaataaaaatttggaacatcgggagacacgaaaatactccccccccccccggtttggacccccccccgacaccgtggggcgataataatgaagggtgcaaaccctcataattttgatnccccctcccgcgctgaaggtggaattcttaaagtcctttgtgtgagtacgaaaagagttttctcttaacccgcgcgcttggttagggaactttaagcccgctggggcctcttgggacatatatatttttgtatctctcctttgttgttattccccccgccccctcagtttttttcctttttgccgcacataactcgggctattttatacacccccgccctccttttatagtgagctcttctgtttctatacctttcgccccaccattcctccttcttccccccgccctcttattttttttttttccccgccgcctttcttttatttcctccaccggatgcatatcgcg

SEQ ID NO: 56282 - protein, 113 aa, Zea mays
  misc_feature: Ceres CLONE 1494937
MVADGGPATSALEEALKPYQDRASEAEIRIAKLEALLYNKDGPSGGSEATSLCRERISSRKLDGAYCRIGLDLLGDKTIKIWNIGRHENTPPPPGLDPPPTPWGDNNEGCKPS

SEQ ID NO: 56283 - DNA, 720 bp, Zea mays
  misc_feature: Ceres CLONE 1494942
  misc_feature: Encodes the peptide sequence at SEQ ID NO. 56284
  misc_feature (479)..(479): n is a, c, t, g, unknown, or other
ctggagctccccgcggtggcggccgctctagaactagtggatcccccgggctgcaggaattcgcacgagaccattacctagaacatcctaatcgaaaaaaaaaaaatggcggcggcgccggaggagctgctctgcgcggcggcgaagtccggtgaagagggcgaagtcgctaaactccttgcttcaggagctgacgcgacccacttcgatgccgacggcttgacgccgctgatgcacgcggccgcgggggggcacgccgccgttgcgcgcctcctcctcgactgcggtgcgccctggaacgcgctctccccctcgggcctctcggcaggggacatagcctccgaccccgacacctacgacctcctcctcggccacgccctccgctccgagctcgtcctgggcaccgtcgcgcggcggcaagcggcccccgcgaaacgtcccccggtcgagagctacctcgaatccagggtctcgttcancgaagaaaagggtgatggaccctgaaagcagggcgtgatgatgtgcctgggaacgcctcctaatggaggcccccccccggcggtggtgcaaggggcggccagggcttcaacggggggtccggatggggcctcgggaacaaacaaatccaagggacgggcccaagacaccccattggcaagcccccccggggagggtacaacggggcccccctttccgaggggccaaaaaaaatccttcggg

SEQ ID NO: 56284 - protein, 132 aa, Zea mays
  misc_feature: Ceres CLONE 1494942
  misc_feature (37)..(69): Pfam Name: Ank Pfam Description: Ankyrin repeat
  misc_feature (125)..(125): Xaa is any aa, unknown, or other
MAAAPEELLCAAAKSGEEGEVAKLLASGADATHFDADGLTPLMHAAAGGHAAVARLLLDCGAPWNALSPSGLSAGDIASDPDTYDLLLGHALRSELVLGTVARRQAAPAKRPPVESYLESRVSFXEEKGDGP

SEQ ID NO: 56285 - DNA, 748 bp, Zea mays
  misc_feature: Ceres CLONE 1494949
  misc_feature: Encodes the peptide sequence at SEQ ID NO. 56286
  misc_feature (371)..(371): n is a, c, t, g, unknown, or other
  misc_feature (381)..(381): n is a, c, t, g, unknown, or other
  misc_feature (464)..(464): n is a, c, t, g, unknown, or other
tccccgcggtggcggccgctctagaactagtggatcccccgggctgcaggaattcgcacgagaccattacctagaacatcctaatcgaaaaatttccttccagtggtcacatcagagcagaggtcgagcatcgcatcgcgcgctttgcctgccgcagcggctaacgaacgcgtggatcatcccttctattattaattaattgggaggagtgggagtgatagctgcagcacccagcgcccatccggaaccctagcctcctcgtcgttgaatccaccacaccacaccatgagcgggagcgcctccaggaagctcttccaggccgccaggtccatcgtcctctccgcttctcaacgctcctcctccgtcctcgncggcgagggnctgcacgccgcgctcactaattttggcaggaagatcctccctagcgcctgctccctacacaggaagggatcccacgcgcgtcnggatggggagcatccctgcccgcatttactgcctcggaacaggaggctcatgctgcaaaaatggagcgcattttcttcgccttaagcccgaaggggtcaaagaggcccgatttctgaaatggggaccccttccaagaaaaagggttaaagcctggtgccctcaacctaaagtctcccccccaaggattccctggaaaacccttcccttgtttccgggaaggggccttttctcccgggggggggagaactccccccccctcgggccggaaatacaaaaggggggg

SEQ ID NO: 56286 - protein, 87 aa, Zea mays
  misc_feature: Ceres CLONE 1494949
  misc_feature (29)..(29): Xaa is any aa, unknown, or other
  misc_feature (60)..(60): Xaa is any aa, unknown, or other
MSGSASRKLFQAARSIVLSASQRSSSVLXGEGLHAALTNFGRKILPSACSLHRKGSHARXDGEHPCPHLLPRNRRLMLQKWSAFSSP

SEQ ID NO: 56287 - DNA, 815 bp, Zea mays
  misc_feature: Ceres CLONE 1494956
  misc_feature: Encodes the peptide sequence at SEQ ID NO. 56288
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
aaggggtctcccccatgtaacccctcacctcacaccnnnnntttacacccctcacagctggagctccccgcggtggcggccgctctagaactagtggatcccccgggctgcaggaattcgcacgagaccattacctagaacatcctaatcgaaaaacccacttccgctctgctcacgtgccgtgcccgtgtgcatcggggaaaaaacagcagcaggggccgaatcggagctccgccgccggcagatctgcgccggccggtctgctccgcccagcggacatggaccgcgacggccgcccggggtggctaccgtcgctgggcttcgccttcctcagcttcaactgcgggatggccgtctaccgctcctgggacgacccctacgccgtcgccttcgacctcgccgcgtacgccgccctcgtcctcctcttccgctgcctccaccttctggagcgccgccgggacaagggcctcacgcccaccgactggggcctctccacgctcctcaaactcatgttctcgtaaaatatcccccgccgtgatgccgccccgggcccagctgctacgtctggggcaatggggatccttaccggcatttgccggaattcctacgtcctttttcgtccgcccgccccggaaagaacccctgaaccctttcgccccctattctttgggttgcccaccccccgacattccaccatggactaccccgaatgaagccatcacctcgccccgcatttcgggcctacagtttattctttggtggaaggcaaacacatgggcagttcctatgcaaaataacgccttaaaagacactcg

SEQ ID NO: 56288 - protein, 80 aa, Zea mays
  misc_feature: Ceres CLONE 1494956
MDRDGRPGWLPSLGFAFLSFNCGMAVYRSWDDPYAVAFDLAAYAALVLLFRCLHLLERRRDKGLTPTDWGLSTLLKLMFS

SEQ ID NO: 56289 - DNA, 921 bp, Zea mays
  misc_feature: Ceres CLONE 1494964
  misc_feature (637)..(637): n is a, c, t, g, unknown, or other
cccccccttccctaattccccctttccttcaacgagtcgggccacccccaacccgcgacctccccccggtggtggccgctctataactaatggatcccccgggctgcaggaattcgcacgagaccattacctagaacatcctaatcgaaaattttcattgctcacactgctgtctccgttccatcccctacgagatctgccccctcgccctcgccctgctccaatccccatctccttgcggcccgatccaccctgctccaatcccccggcgatgttcgtgtgcaaatgccgaaaggcgacgagggtttactgcttcctccatcaggtcccgcccgtggccggggcatattgcttcccgaacatccactatgtgcggttgaaaaacaatgctgaatggggttggtaaattctgaaaatcgacttggccacaacactggtttcgttctttgaaatttttggttctagaaagggggcgcacccccaccaaacaaaacaaaaatggggtttctttgtgattgggcgcccccaccccaagtgggtttggatatgcccaatatgcccaagatatttttccttacgcccaaaatggactccccaacagggaaaacgagtaggggcccccccccggggttttttngccatcaacatgagcggccccctctttttttctgtataagcaaaaaatcgcggtgtgtttttcttctcccccccgccatatttaaaataaaaatccatagatgatttacctatcgccgcgcgaaaaaaaaaaattattctgtacaccacctcttgtgggcgagagatagaggaatgacattatgtaatatacacaaacaacccacttcgtttgtatgcccaaatacctctcaatcaacatttctccaccctttgcgattgaattaagcaattgttggcctgcgt

SEQ ID NO: 56290 - DNA, 438 bp, Zea mays
  misc_feature: Ceres CLONE 1494981
  misc_feature (220)..(220): n is a, c, t, g, unknown, or other
tggagctccccgcggtggcggccgctctagaactagtggatcccccgggctgcaggaattcgcacgagaccattacctagaacatcctaatcgaaaaaagaacactcgcttctgagtttggtcgcggttttgcccctcccttcttgaactcctccgctcgatcgaactcagttccgattcggcaggttcattgtgaagttgaggtgggtggtataagcantcgaagagagcatgagcaccctggcccagtgggtacaagggcgtggcaccaagaaaaacgtcccaagaggggccggctgaaaaagaaaggggggatctccaaaaacaaccccccgggggtgggggaccccctttgggaaccccaaaacccccttggtttttggggccccaaaattctcccttttgggtggggggccccccccaaaaaaaaaattttcg

SEQ ID NO: 56291 - DNA, 738 bp, Zea mays
  misc_feature: Ceres CLONE 1494982
  misc_feature: Encodes the peptide sequence at SEQ ID NO. 56292
ggagctccccgcggtggcggccgctctagaactagtggatcccccgggctgcaggaattcgcacgagaccattacctagaacatcctaatcgaaaaaacgccaagaaagaatggcgtgctgcaccaccaccagccgtctcgtcctctcggcggcggccgccctgctcgccgtggcctgcggcgccgcggaagccccgagctactgcgcgccggggcaggccatcccgtaccgcccgctgtccggctgcacctggtacgttgcgagccggagctgcgacgtgatcgaggccatgctcccgaaccgggccgtcctcaaggagacgtgctgcagccagctgcgggacatcccggcggagtgccggtgccgggcgctgcgggtgatgatggagacgcccctcgtcgtgggcgcgcagccgggggcccagcagaggtgccgggtcgcgcaggcccgcttcgcccccgcctcgtcgccgcggccaagtgcgcctgctcaccgccaccggaggcgcttctgcaacgcgctccaaaacaagtgaatgagggacccagggggataatactgccccccgaaccgggggggtccaaaaaaaaggggggaaaaataatcccccggccaaccggaaccataaaaaaccaaagggccccctcccgcctccccaaaaaaaaaaaaaaaggcttttccatcccccccacccctcggggggggccccgggaccccatttcccccaaaaggggggg

SEQ ID NO: 56292 - protein, 141 aa, Zea mays
  misc_feature: Ceres CLONE 1494982
MACCTTTSRLVLSAAAALLAVACGAAEAPSYCAPGQAIPYRPLSGCTWYVASRSCDVIEAMLPNRAVLKETCCSQLRDIPAECRCRALRVMMETPLVVGAQPGAQQRCRVAQARFAPASSPRPSAPAHRHRRRFCNALQNK

SEQ ID NO: 56293 - DNA, 637 bp, Zea mays
  misc_feature: Ceres CLONE 1494985
  misc_feature: Encodes the peptide sequence at SEQ ID NO. 56294
tccccgcggtggcggccgctctagaactagtggatcccccgggctgcaggaattcgcacgagaccattacctagaacatcctaatcgaaaaacacccacacccacacccacccacacaaccgcacctcgcacccattgaccagacggcggcgctcatctcctccccacggttctccccatcggcctgctggcttctccccggcttcccgatactgatcctcatcactcattctgctgagttgctggagacaccttatttctctctgctactctggtcataactgcataaattccgagatttacttgatacagtggaacactcagaggtttggcgaatactcctaccatggggatcagttgtaactgggggaatttggcaaaaatcaatttctctcctcccgaagttccaaaacgtttggctgggcccccgggttcccttgggactttggaaaccaaaattttccccccctccttttgggggaatggcacaaaatccttttgggcccgggaagcccccaaaaaatccctttccaaaaattttcccaaaaggggggaatgccccggtcctcttggggggctgggccccggggaaaaattttatttggggggattttggggggccccctttgaaaaagcg

SEQ ID NO: 56294 - protein, 97 aa, Zea mays
  misc_feature: Ceres CLONE 1494985
MGISCNWGNLAKINFSPPEVPKRLAGPPGSLGTLETKIFPPSFWGNGTKSFWAREAPKKSLSKNFPKRGECPGPLGGLGPGEKFYLGGFWGAPFEKA

SEQ ID NO: 56295 - DNA, 867 bp, Zea mays
  misc_feature: Ceres CLONE 1494992
gaagggggcccgccgcgccccgaaaacgccgacgcccaatatcacccacacataaaaaagatggaactccccgcggtggcggccgctctagaactagtggatcccccgggctgcaggaattcgcacgagaccattacctagaacatcctaatcgaaaagtttcagttcctcgtcgccctcgccacttcgccgccgccgctttggctccacccagtccgcttccggcatccgcccatggctgcggcccccgcccgccacctcgccgcggccttcacggccgccgctgcgcaccagcgcgtcgcgttcaggcgcgtccaggcccgggcccccggtgtccgcctctctctccttcccgccgcgccatctcgcgccatttcgcggcagggccagcctcgactgccccgccgccggcttatttctctgccccctgcgggaggagagaacaccgggccccccgggccatttcaaacttccctgacgccccgggccccccccggggtggaacgaagggggaacccggccccccgggggggaaatatcacccgccctccgcccggttagggtgggcggggcgggggtctttccggggtgggcgcctcacaacttgggccccagtaatccccccggtagggcgcccgggcccgcgcgccccaaaaaaaaatacgggggccccgtaggagaaaacacccccccccaataaaatccggggagtgtaaaaaaggcggccccgttttatatccgcgccccccttaaaagagaacttcaacgcgtataaatattccgctcccatgcgagaaaaaaggcggcgggctttttcaattattttccgcgcgggtttatctttgggggggcggacgccgaaacaag

SEQ ID NO: 56296 - DNA, 913 bp, Zea mays
  misc_feature: Ceres CLONE 1494993
  misc_feature: Encodes the peptide sequence at SEQ ID NO. 56297
  misc_feature (38)..(38): n is a, c, t, g, unknown, or other
  misc_feature (41)..(41): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (698)..(698): n is a, c, t, g, unknown, or other
  misc_feature (913)..(913): n is a, c, t, g, unknown, or other
tagttatcctcccccttaccccacgaacacaggctaanacnccccgnnnnnnccaaacactggaactccccgcggtggcggccgctctagaactagtggatcccccgggctgcaggaattcgcacgagaccattacctagaacatcctaatcgaaaagactttgtctgttctgcttcgctcgcgggcgctcatctccactcctccgatggtgccgccacccaccagcccctcattcctccgaccgccgccgatgccacataacccgcaccctcgcctccttttgggaactcccatccgcctccttccgggtagccgaaataatccgcggccggggcctttgaaatggtgaggttgggggtccgaaaagaactcggatcccggatccacccccttccccgcccggggccctctcctcctcctttcaagcgaattctggatagggggggaggtaggacttcgaccccgtttgaaaaaagaaaaaggcgggaccaaccccccccgcggtgttttgtccccccccccgcaggggggggggcggtctagggcgactttctttagccccaaaagaaccaggacacccctccccccagaaacaccgagaaaatagcctctcttctgatggaagaggcgctcttaccccggacacgccgtagggccctccccggcggacggtcccacccgggataattggcgcctngtgctctgtgcggcgcgcttcgttcgcgataaacccccccaccaacacccgccatcccgccatattttacccgctcgcaatattcgcagtacgcctgcgatgccagtcccgaaacacaacgccgcggggcttgatggcctgctagccccgaggagaagcgcgcgcactcgaatgtacgcgccaggtaccttccgcatatcgttcccgccgcaccn

SEQ ID NO: 56297 - protein, 38 aa, Zea mays
  misc_feature: Ceres CLONE 1494993
MPVPKHNAAGLDGLLAPRRSARTRMYAPGTFRISFPPH

SEQ ID NO: 56298 - DNA, 740 bp, Zea mays
  misc_feature: Ceres CLONE 1494998
  misc_feature: Encodes the peptide sequence at SEQ ID NO. 56299
  misc_feature (399)..(399): n is a, c, t, g, unknown, or other
ccccgcggtggcggccgctctagaactagtggatcccccgggctgcaggaattcgcacgagaccattacctagaacatcctaatcgaaaacccgccccatcaagattccgaccccaaaatccctctccgagctcgaccaaaaaccaccctctctgattcattccacccacgtccacgtacgtacgtacattcccaccacctcccagtgcagcgccagtctgtaacccataaccataaccataccatggtggtcctcaccaagggcgagctggagcagatcgcgctgccggccgtgcagcgcgcatcgccgccgccgccggccgccgtggcggaggtcgaactggcagccggggaacgcgccgccgcgcgcgcggtggcaaggcgtgcgaagaccagggnttcttcaaggcaaccggccaagggggtgccgaagaaccccctgggccgcctcaaggccgccgcggccgcggtttttccggttccccaaacggaaaaaagaaaggccccccggtggcctttctgaatacccacaaaacggaatgggcgccaaggggaatccggttgggggaaaaaccctctggtttgcccccccccccccggggaaaacgccccccccggggtttccgtggaaaggggccgaaccccccctttttccccgggtggggggaaaaaaaaaaggggcggggggaaggagaaaaatcccacccgggtttccttaatagaggcaagggggttggccc

SEQ ID NO: 56299 - protein, 92 aa, Zea mays
  misc_feature: Ceres CLONE 1494998
  misc_feature (52)..(52): Xaa is any aa, unknown, or other
MVVLTKGELEQIALPAVQRASPPPPAAVAEVELAAGERAAARAVARRAKTRXSSRQPAKGVPKNPLGRLKAAAAAVFPVPQTEKRKAPRWPF

SEQ ID NO: 56300 - DNA, 751 bp, Zea mays
  misc_feature: Ceres CLONE 1495537
  misc_feature: Encodes the peptide sequence at SEQ ID NO. 56301
ataagctggagctccccgcggtggcggccgctctagaactagtggatcccccgggctgcaggaattcgtctcacccctagaaaaaacgcacccagcgcaaagcgatggcgtcgctcaccatgatggcgtccttcgccgccgtggcggtggccgcgccctcgcgccgcggcaccttcgccgtggtcaggtccgccaaggtcgaccgctgccaggagcccgccacgctagcagcaaccgaggccaggcccgccgccgacggacgccgcgccgtcatgctcgcggctgctgcggcggccgtggcagccatcggcggcgccggcgccgccatggcgggccccaagaacgggacccccgaggcgaagaagaagtacgcggccatctgcgtcaccatgcccaccgccaaggtctgccacaactgagcacgcccgcgttgcagctgcagggccggggggtggtatataattaatgtacgtgccacggtgttgttgtccctattgttggttcgagctttagatgcatgcctgacgtgaggccgcttaattgcaaaaaaattttggtgtgtttggttccctacggaattatagatggttaggcgggacgcctcgaggtacccaatttcccccctttagttgaggccatatttacccgcgcctcccttgggccggttcttttttacaactttcttggactgggaaaaaacccttggcgtttccccaaacttttatccgcctttggcagacaaatccccccc

SEQ ID NO: 56301 - protein, 104 aa, Zea mays
  misc_feature: Ceres CLONE 1495537
MASLTMMASFAAVAVAAPSRRGTFAVVRSAKVDRCQEPATLAATEARPAADGRRAVMLAAAAAAVAAIGGAGAAMAGPKNGTPEAKKKYAAICVTMPTAKVCHN

SEQ ID NO: 56302 - DNA, 729 bp, Zea mays
  misc_feature: Ceres CLONE 1495538
  misc_feature: Encodes the peptide sequence at SEQ ID NO. 56303
atagctggagctccccgcggtggcggccgctctagaactagtggatcccccgggctgcaggaattcgtctcacccctagaaaaaaccgaattcgagacctccaattccctcgtagcagcagcaccagtagagtctccttcctctccggcggcgatgtctgggcgcggcaagggcggcaaggggctgggcaagggcggcgccaagcggcaccgcaaggtgctccgcgacaacatccaagggatcacgaagccggcgatccggaggcttgcgaggaggggcggcgtgaagcgcatctccgggctcatctacgaggagacccgcggcgtgctcaagatcttcctcgagaacgtcatccgcgacgccgtcacctacactgagcacgcccgtcgaaaatccgtcaccgccatggacgtcgtctacgccctcaagcgccaggggcgcaccctgtacgggtttcggcggctaaccgcccctgtccatcctgggggtgggcctggaactgttggccctcctctttggggtccctggtcctgggcttccattctgggggaaaggacgggaatcctaaaatctaggtttccatccggggttttgggggcccctggtaaagcccgggaaaaaaccaaaaaaagcccacccccccaagtggactctaaaggtggtccccttcggaaaaatggatggttacccccccctttcgcccgccaccaaaaaaataaaaaaaacccg

SEQ ID NO: 56303 - protein, 192 aa, Zea mays
  misc_feature: Ceres CLONE 1495538
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKIFLENVIRDAVTYTEHARRKSVTAMDVVYALKRQGRTLYGFRRLTAPVHPGGGPGTVGPPLWGPWSWASILGERTGILKSRFPSGVLGAPGKAREKTKKSPPPQVDSKGGPLRKNGWLPPPFARHQKNKKNP

SEQ ID NO: 56304 - DNA, 753 bp, Zea mays
  misc_feature: Ceres CLONE 1495539
  misc_feature: Encodes the peptide sequence at SEQ ID NO. 56305
aagctggagctccccgcggtggcggccgctctagatctagtggatcccccgggctgcaggaattcgtctcacccctagaaaaaattcacgcacctagggttttcgcgccgccgccgcagccgcaacaatgccgtcgcacaagaccttccggatcaagaagaagctggcgaagaagatgcgccagaaccgccccatcccctactggatccgcatgcgcactgacaataccatcaggtacaacgccaagcgcaggcactggcgccgcaccaagctcggcttctgagcgtcgggattggccggctgctgcgtcggaaggctagggtctaagagctatcttctgttttatcattgtctctgtttctgtaagctagcaagtgatgctgtgatgctgtgtattaagattctgatgagtggtgacgttaagagaaaattggcagtactgtgttgtaccccaagattccttgcagcattgctatgctaagtaacgaaccctttattctatttttttaaaatagaagtgcggagggtggtgtaaagatggggggtccccgtggtcgccccccccgcgatgagcaagtcacccaataactgcggggtggatctagggggggatctatgctataaatataaccccagcccccctcccggggtcccgcatgtgcccgccatggaggagaccgtatttccggccccccctctctggcccgtcgggtttgtacataccttcgggcacgtgagataaccctctctgtt

SEQ ID NO: 56305 - protein, 51 aa, Zea mays; identical to SEQ ID NO: 2355
  misc_feature: Ceres CLONE 1495539
  misc_feature (9)..(51): Pfam Name: Ribosomal_L39 Pfam Description: Ribosomal L39 protein

SEQ ID NO: 56306 - DNA, 852 bp, Zea mays
  misc_feature: Ceres CLONE 1495541
  misc_feature: Encodes the peptide sequence at SEQ ID NO. 56307
  misc_feature (1)..(1): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
naaaaannnnnnnaaannnnnggttgtgggggtgggtataatttttcataaaactggaactccaccgcggtggcggccgctctagaactagtggatcccccgggctgctggaattcgtctcacccctagaaaaaatccaccatcacacagcaatccacacaagcacttcgacgtcacacgggtgctgcgcacagacacaccgtgcgtcggcactgatggcttactacttggaggtggactactgctcggatgaggtgaggacggaggccccggccggcttcggccgccacggaggaggagtccagcaacacaacgtaaaggaagaagaacgaagaggtcgagacggagtcgtgcgccggtgtcaaccacctccaccaccatgttcacctactaggccacgtgtcttcattgtgtgcagctaaatcagtgtatgaaaatgacatctacacctgcaaccagtgagggacaaaaagacgtatgaaaccaccatctctcgtcatgttctaactgcagaccgcccgggggtgcccggtccatccacgcccctgttcttggcttgtccagacccagcccctaggttatgataatttcgctctaactttcttttgttcaacaggacaaccgatccataatcctaatccatcaagaatgggtcgtagtgcaatgaaagtggttagaagttgagtaaaacttggatcactatgactcaaaacataaaacattccttcatacctttgcgtaatgcttatggaaagaaaaatggtgatcaagtatgaaaataaaaaaaataaactcccattatttttaattttgtaatttatttaaaggattgtgccgatccgtggagttttt

SEQ ID NO: 56307 - protein, 68 aa, Zea mays
  misc_feature: Ceres CLONE 1495541
MAYYLEVDYCSDEVRTEAPAGFGRHGGGVQQHNVKEEERRGRDGVVRRCQPPPPPCSPTRPRVFIVCS

SEQ ID NO: 56308 - DNA, 674 bp, Zea mays
  misc_feature: Ceres CLONE 1495553
  misc_feature: Encodes the peptide sequence at SEQ ID NO. 56309
  misc_feature (369)..(369): n is a, c, t, g, unknown, or other
  misc_feature (418)..(418): n is a, c, t, g, unknown, or other
  misc_feature (442)..(442): n is a, c, t, g, unknown, or other
atagctggagctccccgcggtggcggccgctctagaactagtggatcccccgggctgcaggaattcgtctcacccctagaaaaagggaatgaacatgatcccacttagagaactcctaccagaggggactaaagttactaccctcaacttgcttaagaccatggacccaaacgatgtacaaaatgagaagtctcgtggtgagcttactctagagctcacatacaagcctttcaaggaagaagatatagagaaagaagatacacagggtgctgatgtgatagagaaagctccagatggcactccagctggtggtggcttgctttatgttgttgttcatgaagcccaagatcttgaggggaagcaccatancaacccatatgcaaaaataattttcaaaggcgaagaagagaaaactaangtcatcaagaagaaataggatccnagatgggaggatgagtttgagttcgtgtgtgaggagcctcctgtgaatgataaactgcatggtgaaatcataagtaaagccccgaaagcagggctgatacatggcaagaaaactttgggcctatattgaaataagccttgccaaacttgatccgcaccaagcggaattatgaaaagtcccttctcctaaactccaaaaatgggccatatccaaaccaaagttccagggaaaa

SEQ ID NO: 56309 - protein, 115 aa, Zea mays
  misc_feature: Ceres CLONE 1495553
  misc_feature (94)..(94): Xaa is any aa, unknown, or other
  misc_feature (110)..(110): Xaa is any aa, unknown, or other
MNMIPLRELLPEGTKVTTLNLLKTMDPNDVQNEKSRGELTLELTYKPFKEEDIEKEDTQGADVIEKAPDGTPAGGGLLYVVVHEAQDLEGKHHXNPYAKIIFKGEEEKTXVIKKK

SEQ ID NO: 56310 - DNA, 728 bp, Zea mays
  misc_feature: Ceres CLONE 1495563
  misc_feature: Encodes the peptide sequence at SEQ ID NO. 56311
aagctggagctccccgcggtggcggccgctctagaactagtggatcccccgggctgcaggaattcgtctcacccctagaaaaactccgccgtcgcctgtccactttccccgtgcttctccgccgtcgaggccgcgtcccagtgcgaagagaccacgactcagatggccagccgctgggtccggcccgaggtgtacccgctgttcgcggcaacgggcgtggccgtcggcatctgcggatttcagctcttccggaacatcaccggcaacccggaagtcagggtaaacaaggcagggagggcagctggtgtgcttgagaaccatgaggaggggaggcgttacgccatgcatggcctaagaagctttgtgcacgacaagactcctgagatcatgcctgcagttaacaagttcttcactgaccctaagtgaagcatgttgattggcatactactactactacttgctactggggattttacactttgctggcaactcaatttgttggggacatccctgacctctaaaagtacttttgagtgcttggtgatgacttgctatatgtatgatggtgggatgaagtttgatcgtccatgccttgatgttcatattcctcctgtcatctggatttgcccgcacttccagtgataaaaattgtccatttgggatactgggaaatgggtaccgtcctttgggaaattccgctccaaaaaaaaaaaaaaaaaacccaagcg

SEQ ID NO: 56311 - protein, 87 aa, Zea mays
  misc_feature: Ceres CLONE 1495563
  misc_feature (2)..(88): Pfam Name: B12D Pfam Description: B12D protein
MASRWVRPEVYPLFAATGVAVGICGFQLFRNITGNPEVRVNKAGRAAGVLENHEEGRRYAMHGLRSFVHDKTPEIMPAVNKFFTDPK

SEQ ID NO: 56312 - DNA, 948 bp, Zea mays
  misc_feature: Ceres CLONE 1495568
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (792)..(792): n is a, c, t, g, unknown, or other
nnnnnnnnnnaaaannnnnaaaaaatnnnnnnnttctnnnnnggcaaagctggactccccgcggtggcggccgctctagaactagtggatcccccgggctgcaggaattcgtctcacccctagaaaaagagctctctctagcattacccggcggcggaagcgtaagcgcaaaacgaagcaagcggccgccatggtgaagggacgcacgggacagcgcgtcaggctctacgtccggggcaccatccttggatacaagaggtccaagtcgaaccagtacgagaccacgtctctcgtgcagatcgaggggggtgaacaccccggaaggatgtcccgtggtccccttggcagcgcatgggggaacatcctacaaggccagagaccaggagcgttggaacccccccacaagtgccatccggggccaagggtcacctgtgtcccccccgaaacgggggggagccctccctgggccaagtttcacaacccccccccccccccctggaccccttggggggcgcccaggcccccaaaggtttacatcgcgcccccgccccagcctgcttaagggatctttgtcgcgcaaaaaaagccaggacctccacaacccgcccccagcggggccacgcgcggggacccccccgccccccccccacccccacgaagagcggtccctcgatgctgcctcctcaccatcggttaccctattgctggccggcgggtccgggctgcgggagaacaggcaccgccacgcctcgttgtccctcccctaccctcctcaacacacaggtaaccacncttctccttatccactccaatagtagaaaacaccacccccgcgggccgacggccggcttgctggaaagtggtgcgcgccccctctcccggcagcctaagtccgtgccaagctcaggattacaaacacctcaattgttcgcgcgcctcgtcgggccg

SEQ ID NO: 56313 - DNA, 825 bp, Zea mays
  misc_feature: Ceres CLONE 1495569
  misc_feature: Encodes the peptide sequence at SEQ ID NO. 56314
  misc_feature (682)..(682): n is a, c, t, g, unknown, or other
ggagctccccgcggtggcggccgctctagaactagtggatcccccgggctgcaggaattcgtctcacccctagaaaaaaaaaccctagcccagagcagccgcatcgaactctacctgcctttctctcgtccctggcggcggcggcaggatggcggcttctactgcgaggacggtgaaggatgtgaacccccacgagtttgtcaaggcctactccgcccatctcaaacgctccggcaagatggaccttcctgagtgggttgacattgtgaagactgccaggttcaaggagctcccctccttatgacccctgactggtactacctcagggcctgcttctgtaaccaaggaaaatctctcttggaaccaaggctcttggtgttgggtggcctcccaaaaaaatttaaggggggccccccaaaagaaaaagggctccaaccccacacttaaattttttacaaaaaaccaggggggccccattttcaccgccaaaaatccctccaagaatagcgtgtgaggggaaaatggggactatttttattagacttcacatacaccaaaaggggggagggcggcccccccacccctcccccgggtatagggcattatctctgagcacccaggtgggcgtgaaagaagggttctcctcgtttaacacctcttacaaacccccactatggtggtncttcacatagacaatcccggagataagaccgacaaacagcgctccctacttttcttccccagcgatgtaaaaaaatttttcgtaataacaaaaatccctctttcccttctttttttcaccttcttttcttcctcaccccatca

SEQ ID NO: 56314 - protein, 51 aa, Zea mays
  misc_feature: Ceres CLONE 1495569
  misc_feature (7)..(49): Pfam Name: Ribosomal_S19e Pfam Description: Ribosomal protein S19e
MAASTARTVKDVNPHEFVKAYSAHLKRSGKMDLPEWVDIVKTARFKELPSL

SEQ ID NO: 56315 - DNA, 741 bp, Zea mays
  misc_feature: Ceres CLONE 1495570
  misc_feature: Encodes the peptide sequence at SEQ ID NO. 56316
ggatcccccgggctgcaggaattcgtctcacccctagaaaaatccctatgggaaaaattgatcaaacacgtatgtggaaggtgggtgaaagggtccgttcaaccaggccacaaggtgatcttggcccactgcatcccttcactgctggagtgtatgttgcactaatgatggctcagattgaggtccttaggaagaagggccactcttcactcagagataattaacgagagcctgatcgagtctgtggactcgttgaacccgatcatgcatgcacgtgttgtggcattcatggtccataactgatccacaactgcccggttgggaatctaagaagtgggcactacgcttcaattaacttctggacccacccggcgtttgtagattgttgaaaaagaaagccccaatccaccaagtacctcctcaggcaattttcaagccggacccctgttcaaacggggcctttttaaatcttgcccccattttaatggccccccgtatgacccccctaattaaccccgttgataaaaaaaattctggggcccccaaacattacaataaagcttccaaaagcccgtgttaggaacacccaccctttttctgtaattggcaaaattttcaaaatacctttaaaatccccggagcatttttgagcttcttcaaaaagatgccccgcgtaccgtccctcctctttgacgcccccaaaaaagaaaactccccttgttttgtggtgtcttattattt

SEQ ID NO: 56316 - protein, 73 aa, Zea mays
  misc_feature: Ceres CLONE 1495570
  misc_feature: SWISSPROT Homolog: EC 1.1.1.86 Ketol-acid reductoisomerase
IPRAAGIRLTPRKIPMGKIDQTRMWKVGERVRSTRPQGDLGPLHPFTAGVYVALMMAQIEVLRKKGHSSLRDN

SEQ ID NO: 56317 - DNA, 716 bp, Zea mays
  misc_feature: Ceres CLONE 1495572
  misc_feature: Encodes the peptide sequence at SEQ ID NO. 56318
  misc_feature (675)..(675): n is a, c, t, g, unknown, or other
aaagctggagctccccgcggtggcggccgctctagaactagtggatcccccgggctgcaggaattcgtctcacccctagaaaaaacccagcaacaagcaacctcgtccccaaacaagcaaccaccgcctccccgatctcgtcgagaggaagcccaatcccgaaaccgccgccctattccaatggcgcccaaggccgagaagaagcccgccgccaagaagcctgcggaggaggagccggcggcggagaaggccacggcggggaagaagcccaaggctgagaagcggctccccgcgggcaagtccgcaggcaaggagggtggcgagaagaaggggaagaagaaggcaaagaagtcggtggagacgtacaagatctacatcttcaaggtgctgaagcaggtgcacccggacattggcatctcgtccaaggccatgtccatcatgaactccttcatcaacgacatcttcgagaagctggcggcggaggcggccaagctggcgcggtacaacaagaagcctaccattacgtcccgcgagatccagacctccgttcgcctcgtcctccccggcgagctcgccaagcacgccgtctccgaaggcaccaaagccgtcaccaagttcaccagctcctaggcgagcgatgcgacgtgcactcgtctcctcttcttgcaggagtancatagtagtacggttaggtgtgttgccgcggtggtagttgc

SEQ ID NO: 56318 - protein, 149 aa, Zea mays
  misc_feature: Ceres CLONE 1495572
  misc_feature (56)..(126): Pfam Name: Histone Pfam Description: Core histone H2A/H2B/H3/H4
MAPKAEKKPAAKKPAEEEPAAEKATAGKKPKAEKRLPAGKSAGKEGGEKKGKKKAKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 56319 - DNA, 744 bp, Zea mays
  misc_feature: Ceres CLONE 1495579
  misc_feature: Encodes the peptide sequence at SEQ ID NO. 56320
ggagctccccgcggtggcggccgctctagaactagtggatcccccgggctgcaggaattcgtctcacccctagaaaaaacaccacacgcgccgcaaagcagagcacgggggcctgagagcagagcgccatcagccatcctttgcctgcccaagcagcaagcagcagcagcaacggcggctggcccgatggctctgtctctctccggcacctccgcccgcttcgccctcgcgtcgctggtcccccgggccagggcctacgcggcgtcggcggcgtccggggccatgaggcgcgcggcggagggcgcggccgcgggcgaggccaaggaggccgggcgcgccgccgccgccgctgccgagggctcgtgggtgcccgaccccgtcacggggcactaccgccccgcaactgggccgcccgcgtcgaccccggcgaacctcggggcgttaaccttgcccgaacctacggccggggcttgagcggccccgggtcctttcccctggtcccctcggtttgattaacatccccacccctacttcccaggggaaaacaagggaagggccggggttccgtgtggcaaaagggggttttacaccccccgcgggggggccccctctctttggacccccgaaaaatttttgggaaacacccaaaagatttttttcctcttttggggggggggctttttccacttatagtttatgagccccgctgatcttttgtgcgccccccaccgaggaaagagcccc

SEQ ID NO: 56320 - protein, 95 aa, Zea mays
  misc_feature: Ceres CLONE 1495579
  misc_feature (1)..(89): Pfam Name: LEA_3 Pfam Description: Late embryogenesis abundant protein
MALSLSGTSARFALASLVPRARAYAASAASGAMRRAAEGAAAGEAKEAGRAAAAAAEGSWVPDPVTGHYRPATGPPASTPANLGALTLPEPTAGA

SEQ ID NO: 56321 - DNA, 765 bp, Zea mays
  misc_feature: Ceres CLONE 1495581
  misc_feature: Encodes the peptide sequence at SEQ ID NO. 56322
  misc_feature (765)..(765): n is a, c, t, g, unknown, or other
tccccgcggtggcggccgctctagaactagtggatcccccgggctgcaggaattcgtctcacccctagaaaaaatagcacagcacaaggagaggccgagaagcgctttagccgtagccgtagcgataagagtgagctagctggtgcacaccggcatggcggccacggcgtactccgtggcgctcctcggcggcgcgcgcctccccgccgctccgcgctccgccctcctccctcggcgcagcgtctgccagcttcgcttccaagatgcaccgaggctctccctgctccgtgcgaaggccgcttccgaggacacatcggcctccggcgacgagttgatcgaggacctcaaagcgaagtgggacgccgttgaggacaagcccaccgtcctcttgtacggcggccggccccgtctcccccctattggctgacgtccctgggtcttgggcgccatcaaaccccgggcccgttgcccccccaaaaccctggaaccccgttggggctcggctacacccggtggggttccgggcccccctcccttccctttttaggaaaacccggaaaaaatttgccccccccaaattggaaacctctgaaaaataaaaaaatcttgggaaacaaaaaaaacccccccgggagaaaatttttaaagcgcccctcttccccccttgggaaaagaaaatcccttctccgcggggaaaacacccattgcccccccccctcggaaacccactttttgtccgcccctttatatgggggcgggccaatn

SEQ ID NO: 56322 - protein, 90 aa, Zea mays
  misc_feature: Ceres CLONE 1495581
MAATAYSVALLGGARLPAAPRSALLPRRSVCQLRFQDAPRLSLLRAKAASEDTSASGDELIEDLKAKWDAVEDKPTVLLYGGRPRLPPIG

SEQ ID NO: 56323 - DNA, 824 bp, Zea mays
  misc_feature: Ceres CLONE 1495585
  misc_feature: Translation starting site: 275
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (824)..(824): n is a, c, t, g, unknown, or other
tttttttttttttttttttttttggttnnnnnntnnngagttgttgttcatagctggactccccgcggtggcggccgctctagaactagtggatcccccgggctgcaggaattcgtctcacccctagaaaaagcaccagaagctcactcactgctcgttgccggctgcccccgcggccccggccagtccatcccctcgctcgctccccaactccagcaggcagatcagatacatccatccattcgcggaccggaaggaaaggaagggttgaactatgagcgccgtggcggtttcgtcgtcgctgaacccggacgcgccgctcttcatcccggcggcgctgctgcaggtggaggacttctcgccgcagaggtgggacctcatcaccaccactgactggttccgcgaccactggtcccgcgagcgcgcccacctggaaaagatggccgagcagattcaagcggcccggcctccccccccgaagaaaaagacctctttctacgacgaaccattttcaagcagggcccccgtccccccccgcccctttaaaaaagaatttcggggcccaaaggggccttgaaaattggacctcccccaaaagggcggcggggtcaacgccccccctgggggggttcccgggaaaaaaacccagaaacccccctataatacccacaccattacacccccagaccccccaaagaaaaaaacccccccccccgtaggaaccaccaacccccgccgcgggccccctggggggaaaaccccagagagaggcgtggggccccctttttggacaatttttctcctgtgggagccaccatatatan

SEQ ID NO: 56324 - DNA, 729 bp, Zea mays
  misc_feature: Ceres CLONE 1495589
atagctggagctcaccgcggtggcggccgctctagaactagtggatcccccgggctgcaggaattcgtctcacccctagaaaaaatgagccagccgccaccccacgtccccgcccatccgccagccccaggcttttagcctctgtcccagccggcagcccgccacccgcgaggccgcgaccggcgaccgcccgcccctgacgcggtgactgcgtcctcctccgctctccgtgcgccaccctgaagcggtgaggcggcgacctccaggcaccgccctcccccggttcggcggctccctcgaggccttcctccccaccggttcagcagctcccgatccacacggccaaaggccgattcgcgctcctcccgccttcctccgcgtccaacagcaagggaaaaacttccacccaggaatggggatgcccccgaaaaagaagggtaaagcatgggggtggttccaaggcatgcccctcaattggtggaaagaaaaaacccttggcattgccaagcaagggggaaaaaagggtggaaaaagggggaagactgggaaaattcccgggcccccccccaaagacctcaaaaatgaaaaccgtggtttcgggggaaaaaacctctaaggggggggttctaatccaaaaaccccccccggattcttggagttcccgggagcgcggcgggggatctctgccacaaaagcgcccctcggcaaaaaaagacctctccgagaaaa

SEQ ID NO: 56325 - DNA, 869 bp, Zea mays
  misc_feature: Ceres CLONE 1495590
  misc_feature: Encodes the peptide sequence at SEQ ID NO. 56326
  misc_feature (15)..(15): n is a, c, t, g, unknown, or other
  misc_feature (16)..(16): n is a, c, t, g, unknown, or other
  misc_feature (28)..(28): n is a, c, t, g, unknown, or other
  misc_feature (29)..(29): n is a, c, t, g, unknown, or other
  misc_feature (36)..(36): n is a, c, t, g, unknown, or other
  misc_feature (43)..(43): n is a, c, t, g, unknown, or other
  misc_feature (46)..(46): n is a, c, t, g, unknown, or other
ttttttttttttttnnttttttttgttnnaaacagnttgaaanatntcaaactggagctccccgcggtggcggccgctctagaactagtggatcccccgggctgcaggaattcgtctcacccctagaaaatacacttgtcccaaaggtcaacaaggaaatcgtcaaaatgcagagagtgaatgctccagctgggcagatgcagctaaagggcttgattgaggcctatgttgaaaaaacgggcagcgagaaaggtattgcgattttgagggaatgggaggcctatttgccgctcttctggcaactggtaccgcccagtgaagaagactcgcctgaggcttgtgcagagtttgagagagtacttgccaagcaagcaaccacccaattgtctggcgaaatggatcgaatcagactacaggaaggtggtaggggtttttctatttaaaccaaaatgaatctcaccttatccacttcaaaaaaatccaaaaaaccttaacccgtgcctcttgaggcccccaaagtgccccgtccttaaaaaccggcaacctttttgggaaggctttttgcccacaggcccattttttttttaggttggtgagccaaacaaaaaactcagggggttttttcttcagaacgcccggggaaacacaagggtgaaccccccctctaaaatctgattagttaaaaacactaatggtcttacaagggggcccccccccccttgtataacacatcttttcatttaaattaaaatatacactggaaccaaaaccacaccggacatcaatacaattctccccccacccccgccagttaatcctctaccccccccacaaatggggccaacacgatgaaagaaaaaaaaaataaa

SEQ ID NO: 56326 - protein, 146 aa, Zea mays
  misc_feature: Ceres CLONE 1495590
  misc_feature: SWISSPROT Homolog: EC 1.4.7.1 Glutamate synthase (ferredoxin)
  misc_feature (5)..(5): Xaa is any aa, unknown, or other
  misc_feature (9)..(9): Xaa is any aa, unknown, or other
  misc_feature (12)..(12): Xaa is any aa, unknown, or other
  misc_feature (14)..(14): Xaa is any aa, unknown, or other
  misc_feature (15)..(15): Xaa is any aa, unknown, or other
FFFFXFFCXKQXEXXQTGAPRGGGRSRTSGSPGLQEFVSPLENTLVPKVNKEIVKMQRVNAPAGQMQLKGLIEAYVEKTGSEKGIAILREWEAYLPLFWQLVPPSEEDSPEACAEFERVLAKQATTQLSGEMDRIRLQEGGRGFSI

SEQ ID NO: 56327 - DNA, 926 bp, Zea mays
  misc_feature: Ceres CLONE 1495599
  misc_feature: Encodes the peptide sequence at SEQ ID NO. 56328
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (724)..(724): n is a, c, t, g, unknown, or other
ttttttnnnnnnnnnnntttttttttttttcttnnngnggggnnnnnnnncccaagctggagctccaccgcggtggcggccgctctagaactagtggatcccccgggctgcaggaattcgtctcacccctagaaaaaccacgaaggcacgaaccctctcttcctaggttcatcgttcctcctccgcgtccttccttccctccgcagcgcggcgcggcgcggcgcgatgatacagctgctcttcacgctgctagcggcggagggcgccgtggcggcggtgctactcttcaagacgccgctgcggaggctggccgtgctcgcgctcgaccacctcaagcggggccgcgggcccgttttggttgcgcaccatctgcggccaccgtgcttgtcgtgcttcgtatccatttctccactccattggcccagttccgccgcccccccccaaggggggaggttgaactggctcccggggccctttggggtctcccccccccctcccttatccatggtcccttccttgtgtataatccccgttcattcgaagggaggtcaactcaccagggggaaaacctttccctcttatgttcccatgggcctatataaatacacagttgaaaccccgagaattggcaccgattttagtgggtccgagaaagaatgaaatacgaaaaggtttccaagaagagaaaaaagaacggccacagctaggtgtttgtacaaaggcnaaacttttcggggccctttttttatgaaaataaaaatgataagtttaaaaactctcacaaaaacaataaaacaggcccctgccaccaacagaacaccctctccaccaacgcacaatactcgttacttttacatctctccccagcccctctccataccgcgccctccactagcctggttatgctccgcccacttaatgcggcg

SEQ ID NO: 56328 - protein, 144 aa, Zea mays
  misc_feature: Ceres CLONE 1495599
MIQLLFTLLAAEGAVAAVLLFKTPLRRLAVLALDHLKRGRGPVLVAHHLRPPCLSCFVSISPLHWPSSAAPPQGGRLNWLPGPFGVSPPPPLSMVPSLCIIPVHSKGGQLTRGKTFPSYVPMGLYKYTVETPRIGTDFSGSEKE

SEQ ID NO: 56329 - DNA, 835 bp, Zea mays
  misc_feature: Ceres CLONE 1495605
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (20)..(20): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
tttttttttttnnnnnnggngcggtccactccnnnnnnnnntnnnnatcaaagctggactccaccgcggtggcggccgctctagaactagtggatcccccgggctgcaggaattcgtctcacccctagaaaaactgccctcacagatacgaaggcggttggcctagtgctgattgcaatgcgctccccagctgtacttccgctctgatatcgttcagaggcgtttctctacgatatcatgcgatggctctgttatcattcagaaactatgctgctacaagatcatgaggctgatgctgtgtgtcccttttttcttctgagactgacttaatttcattgccactacatgtggtgtagaatgcgaaaccgtactcatacagattaggatgtctatccccccccaggaccccaggcacataccataactgaaaggttagagatcaagcacgccaatgctggttaagaaaggcgtatgaaccaccaaaaacaaccttggattcatcccccatggcaggttggcgagaggactttgcgttaaggcgcggggcactggggcaaagaccccttcgccccgttttgtttttatggcttataccattaatgagagttcatctgtagtcccaaaaaaaggtcccgtggctcctacaaattgcactatggcccgctccacctaaacacggtgagtcgatttcagacggttaccgcgaacgttcgcccctcgccgcggcaagagaagagtcttctacgcgggcggggcacgacttcccccgccatcttccccccagaccccggaacaattgggttccttacacgagcttggttttggatatcacgac

SEQ ID NO: 56330 - DNA, 792 bp, Zea mays
  misc_feature: Ceres CLONE 1495607
  misc_feature: Encodes the peptide sequence at SEQ ID NO. 56331
ggagctccccgcggtggcggccgctctagaactagtggatcccccgggctgcaggaattcgtctcacccctagaaaaagcgcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccaatgctcttctggggttcgagaagcttgtgaaggccaagacacaagttggtgctggcacgatgtactatctcacctattgaaggaaaggatggccgaagtcaagaaacctctaccaagcctaagggtatgggaaaaagcccagggggagaaattccaaggagcctgcaggaatttcaaaccttggttaaaaaagggggcatagcccccaaaggaatgcccccttctccccgtgggcaacccctgaaaccccaaaacaaaaattgtccaaaaaaaaagggcccctgtcccccccttgggtaatttctcaaaaaaacccacccccctttttagggctttttttttgggttgttccttttttctccaaggggaatatgaagagggataataaattcccccccccccctccaaaaagagggggttttttatatcctccccacaaaatcttttttctcccccctcttataaaaaaaaaaccccccaaaaaataaagtttctccctcccccc

SEQ ID NO: 56331 - protein, 65 aa, Zea mays
  misc_feature: Ceres CLONE 1495607
MANNTGTLVGGIQDVPGSENDLHLQELARFAVDEHNKKANALLGFEKLVKAKTQVGAGTMYYLTY

SEQ ID NO: 56332 - DNA, 687 bp, Zea mays
  misc_feature: Ceres CLONE 1495611
  misc_feature: Encodes the peptide sequence at SEQ ID NO. 56333
ggagctccccgcggtggcggccgctctagaactagtggatcccccgggctgcaggaattcgtctcacccctagaaaaagttgcttgctcccaagatcaagcgcctcccgcctccagcactcttaactcaggggacacgatcgccatggccgccacatcgaccgccgccgccgtgctgtgcccgccgtccgtggccgggctccgcctggcgccgtctcccggccgggcgcgcgtgtcgttccgcgcggcgccggcgccggcgcggcggtccgtggcggcgcgcgcggagctgagctcggcgctggtgatcagcctgagcacgggcgtgtcgctcttcctgggccgcttcgtcttcttcaacttccagcgggagaacgtggcgaagcaggtgcccgcgcagaacggcaagacgcacttcgacgccggcgacgagcgcgccaaggagttcgcggccctgctcaagtccaacgaccccgtgggcttcaacctcgtcgacgtcctcgcctggggctcgctcggccacatcgtcgcctactacatcctcgccacctccagcaacggatacgaccccaacttcttctgagcggtcgtcggggatgtactctacagacagccgtgtgcgtgtgcttgtcatgtatccgatcaaggtttggttaattggacagtagtgcaacttcataataattgg

SEQ ID NO: 56333 - protein, 145 aa, Zea mays; identical to SEQ ID NO: 55959
  misc_feature: Ceres CLONE 1495611
  misc_feature (48)..(142): Pfam Name: PSI_PSAK Pfam Description: Photosystem I psaG / psaK

SEQ ID NO: 56334 - DNA, 725 bp, Zea mays
  misc_feature: Ceres CLONE 1495615
  misc_feature: Encodes the peptide sequence at SEQ ID NO. 56335
aagctggagctccccgcggtggcggccgctctagaactagtggatcccccgggctgcaggaattcgtctcacccctagaaaaagtggaggtcctggagctgcgcgtgtcggaggtgggcgaccgcgtgctggtggtgaacgtgacgtgcagcaagggccgcgacgccatggcccgcgtgtgccgcgccgtcgaggagctccggctccgcgtcatcaccgccagcgtcacctccgtcgccggctgcctcatgcacaccatcttcgtcgaggtggattcggaccagacgaatcgtatccagatcaagcacatgatcgaggccgctctcgcccagctagatgatgcctccgcgagcccgccgagcgtgatgagctactattagaatcggacaaacgtcacgctgacatgcatgagccggcctagctacttgtgcccgacggtacttgtcccggggcggctccccctttttttctttccccaaacccctgggcgcttttttgggacctggaaaaaagggggggctctttttccctattttgaaggacatagcccgggggttttgtgaggggggtttttccccctttttttttgggcccccaaaccccaattttgtgggggggggcgccccccccctttttttaagcccccggaagaaaaaaaatacccggggccctccccccaaaaaaaaaaaaagaaaagacccggggggcccctctccccccttagg

SEQ ID NO: 56335 - protein, 125 aa, Zea mays
  misc_feature: Ceres CLONE 1495615
AGAPRGGGRSRTSGSPGLQEFVSPLEKVEVLELRVSEVGDRVLVVNVTCSKGRDAMARVCRAVEELRLRVITASVTSVAGCLMHTIFVEVDSDQTNRIQIKHMIEAALAQLDDASASPPSVMSYY

SEQ ID NO: 56336 - DNA, 778 bp, Zea mays
  misc_feature: Ceres CLONE 1495616
  misc_feature: Encodes the peptide sequence at SEQ ID NO. 56337
ggagctccccgcggtggcggccgctctagaactagtggatcccccgggctgcaggaattcgtctcacccctagaaaaaacggtccgcccaccctccgttttcgcttcctccctccacgtcgtctcggtcttcctctcctgtaatcccgtgacacgggtggctgcgacggcgaatcagatccctacccgtggcgttggtcgtgaattggcgccgtctccccctgccagccggattccctgctttgttctcaggcaacattttgttcactagtgtggtagctttgttgattggagtgcgcaatgggaggctgtgcgggaaaggtacgtcgtgatgacgaagaaaagcttgattttaaaggtggaaatgttcatattataacaaggcatgagggctgggaccagaagattgcagaagcaaacagagatgggaaaactgttgttgcaaatttcaagcgctccctggggtgggccatgcccgggccttggcccccggcctttgctgaaattgccaaaaacttttccccacactcttgttccttgacaaataaaactttaattaccccgtagggactttcccccctcttcttggggaaatcccggggaaacaccccaaatttttttttttttctcaaaaaaacgggggaaaaaaaatccaaaaaaatttttggggggcggcaaaaaaaaaccctgtattttctcaaaaataaaaatatgtcttaaccccccctcttttattccccaatacccccctttatgtgaaaaaaaggtgaagaaggcgc

SEQ ID NO: 56337 - protein, 88 aa, Zea mays
  misc_feature: Ceres CLONE 1495616
MGGCAGKVRRDDEEKLDFKGGNVHIITRHEGWDQKIAEANRDGKTVVANFKRSLGWAMPGPWPPAFAEIAKNFSPHSCSLTNKTLITP

SEQ ID NO: 56338 - DNA, 700 bp, Zea mays
  misc_feature: Ceres CLONE 1495617
  misc_feature: Encodes the peptide sequence at SEQ ID NO. 56339
  misc_feature (412)..(412): n is a, c, t, g, unknown, or other
  misc_feature (413)..(413): n is a, c, t, g, unknown, or other
  misc_feature (482)..(482): n is a, c, t, g, unknown, or other
  misc_feature (700)..(700): n is a, c, t, g, unknown, or other
aaagctggagctccccgcggtggcggccgctctagaactagtggatcccccgggctgcaggaattcgtctcacccctagaaaaaagcaaataagacgacttgtttcattgattcttgaagagatcgagcttcttttgcaccacaaggtcgaggatgtcttgcaactgcggatcaagctgcggctgcggctcaagctacaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacgcctgcggctgcggtagcagctgcaagtgcgacccctgcaactgctgatcacatcgatcgacgaccatggatatgnnatatatctatctagcttgtgggtggtgttgaacaaatataagcgaggccgagctggctgccatacatangtattgtgtggtgtgtgaaagagagagagaaacagagttcctcagtttgctatctctctctctgcatgtttggcgtcagtctttgtgctcatggacggggggctacatgcatgttgggttgatccaaatgcgtcttgctgtaacatttattaaatgggccccaaggaatggatttgaaaccttatttttataaattacccaaaacccggaattctttn

SEQ ID NO: 56339 - protein, 76 aa, Zea mays
  misc_feature: Ceres CLONE 1495617
  misc_feature (1)..(76): Pfam Name: Metallothio_2 Pfam Description: Metallothionein
MSCNCGSSCGCGSSYKCGKKYPDLEETSTAAQATVVLGVAPEKKAAPEFVEAAAESGEAAHACGCGSSCKCDPCNC

SEQ ID NO: 56340 - DNA, 783 bp, Zea mays
  misc_feature: Ceres CLONE 1495627
  misc_feature: Encodes the peptide sequence at SEQ ID NO. 56341
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (14)..(14): n is a, c, t, g, unknown, or other
  misc_feature (15)..(15): n is a, c, t, g, unknown, or other
  misc_feature (21)..(21): n is a, c, t, g, unknown, or other
nnnnnttaaccccnntttggnaacgttaaaggtgttggcgcttgagtttttttcaaactggtactccccgcggtggcggccgctctagaactagtggatcccccgggctgcaggaattcgtctcacccctagaaaaaatcctactgtcacacacacacagagagagacaagtggtttccaaagccaagtgtgtactagcagtctagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagctgcacctcggcgaggccggcgccatcgccgccggcgccttcgcactctacgagaagcacgaggcgaagaagggaccccgagcacgcgcacaggcacaaaatcacggaggaggtcgctgccgcggcggccgtcggcgccggctactacgtattccacgagcaccactaagattaattatgaccacaatgacgcctaaggaggctagcgtccgagaataagcaccaccaccctctttcggctagaccgtaagtaccgggccggggcgcgcgaacccgagtagcctagcttagccttccggtgtaacaacaaacctcccgccccgggtgttaattcctggtactcgctatggccgcggtgcttagattctcattgcgcttcacaa

SEQ ID NO: 56341 - protein, 125 aa, Zea mays
  misc_feature: Ceres CLONE 1495627
  misc_feature (41)..(109): Pfam Name: ABA_WDS Pfam Description: ABA/WDS induced protein
MSEEKHHHFFNHHKKDEEQPAGEYGYSETEVVTATGEGEYERYKKEEKEHKHKLHLGEAGAIAAGAFALYEKHEAKKGPRARAQAQNHGGGRCRGGRRRRLLRIPRAPLRLIMTTMTPKEASVRE

SEQ ID NO: 56342 - DNA, 914 bp, Zea mays
  misc_feature: Ceres CLONE 1495637
  misc_feature: Encodes the peptide sequence at SEQ ID NO. 56343
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
nnnnnnnnnnnnnnnnnnnnnnnnngggtaatcccctttttnnnnnnccaaagctggactccccgcggtggcggccgctctagaactagtggatcccccgggctgcaggaattcgtctcacccctagaaaaactcttttcataatcaagatgagccgtggtgctagtgacggtggtggtcaaagttctctgggttatctctttggaagcggtgagccccccaaaccagcagtgacaccagttgcaagtgctccacctgttgagaaaccatctgctgcacagactgatgcggccaaacaggtttgctgctgggagttcccgccaaaccaataactaccaccggcgctcatggtcagaacactggcaacttccttacggtacctttcttttaaccaaaggttcactctttatcccgggcggtgtgtttactccccagccttacccttgtcgggggggaatttgatagcccgggtgctcgcgtggcccccaccaaaagttaaaccctccacttggtcttgtcttgtctccttttgtctttataatacgagacctcaccctgttgcttcctgtgtcgcttgttggaactctccatgtggaaaagctcttgttccgcccaaattataattattttttctatattgtgaccgaaaaatttctatacaacttcatgcactgcgtcgtcttccaccctctaataccttcaataaataacacatctattatcattacttttctattcttatataaattatcaacttttgctgttgttctgtgcgctcatcacataaacttatttgtagcatttggagttcgccctcttgcggcgccccactttatctcactatacgtaagagagtagattataaggtgtggtgggtgtgtaggcagctactccagccatgcaccaaacatacg

SEQ ID NO: 56343 - protein, 60 aa, Zea mays
  misc_feature: Ceres CLONE 1495637
MSRGASDGGGQSSLGYLFGSGEPPKPAVTPVASAPPVEKPSAAQTDAAKQVCCWEFPPNQ

SEQ ID NO: 56344 - DNA, 626 bp, Zea mays
  misc_feature: Ceres CLONE 1495638
  misc_feature: Encodes the peptide sequence at SEQ ID NO. 56345
  misc_feature (366)..(366): n is a, c, t, g, unknown, or other
  misc_feature (375)..(375): n is a, c, t, g, unknown, or other
ctggagctccaccgcggtggcggccgctctagaactagtggatcccccgggctgcaggaattcgtctcacccctagaaaaaaagaaccactttcacctgaactcctgaagcaaaagcaatggccatgagagcgcttccgctgaccccttccaggagctcctcgtttggagctcaccaaaccaggccgagcggcggcggccccagatcagtgagagcttatgcgaagggagacgaggagggcgacaagcagtccctcttcggaagcatcaccgaggcgctggacttctcgcaggtccggtcggagaaggacgccgagctgctgtacgaagcccagggagtccacccagaagtggagggaggatgacnagggagcanttcggaacacttaggcggaaggattggtgggcacctaccaaaattttcttcaagtcctattgtgaagtccacgggcaatacttggaggaagggtgggggtccaacaaaacttgccagaacctgcaaaaaagaccccagggggggaaccccagcccggtttaaacaacttggaaaaaccccctcccctttgcggggccggggaaacccccaaccccgaaaaaatttttttccccaaaaattttcccccaaaa

SEQ ID NO: 56345 - protein, 81 aa, Zea mays
  misc_feature: Ceres CLONE 1495638
MAMRALPLTPSRSSSFGAHQTRPSGGGPRSVRAYAKGDEEGDKQSLFGSITEALDFSQVRSEKDAELLYEAQGVHPEVEGG

SEQ ID NO: 56346 - DNA, 745 bp, Zea mays
  misc_feature: Ceres CLONE 1495640
  misc_feature: Encodes the peptide sequence at SEQ ID NO. 56347
atagctggagctccccgcggtggcggccgctctagaactagtggatcccccgggctgcaggaattcgtctcacccctagaaaattttcgaccatgatcacacttctcacagctagatgactcctgctcccttgcatggacgggtgacctccgacctcgatcatactggcacaactcctgaattccctgatcttcaccgtggagacccagatacaccgccgtctgctgtacctctggcccaatcccgcagtgagcctcctacccatccatgaaatgaagctccaacccctgacctgtctggggatgatgtacaactacatccgctccgcctgctgttgatcctgaactttacgaagacgctccagatggtggttcggattatccatttccgcctcctagagaaccggcagggaaccgcaggccctatgcatggttttacagtaaacctgcctacattagtatcaacccctcctggattccccttcaacctaaaacttggtctgagtgcctctttcggtctcactcctcggaagcctgctactttgaatccaaatccagacccccctgacactccccccccaaatcacccactaaaaaccccaacaccgaacaccctttaaagttcccacttttccccccttttatgaggcccctttaccccgcacgttcctgcccggtggtttaccttttccccggctttggaaaacccctggggtttacccaaatctatccccccttttcaattg

SEQ ID NO: 56347 - protein, 84 aa, Zea mays
  misc_feature: Ceres CLONE 1495640
MVVRIIHFRLLENRQGTAGPMHGFTVNLPTLVSTPPGFPFNLKLGLSASFGLTPRKPATLNPNPDPPDTPPPNHPLKTPTPNTL

SEQ ID NO: 56348 - DNA, 733 bp, Zea mays
  misc_feature: Ceres CLONE 1495641
  misc_feature: Encodes the peptide sequence at SEQ ID NO. 56349
aaagctggagctccccgcggtggcggccgctctagaactagtggatcccccgggctgcaggaattcgtctcacccctagaaaaaatcgcactaatcctcttcgtcgaggtctcctcaaccaaattcaaagtcgcagcggcaaagctctcggcgatgtctggccgtcggaagggcgggaagggtctgggcgagggcggcgccaaccgccaccgcagggcgctgcatgacaacatccagggcatcaccacgccggccatccgcaggttggcgaggaggggcggcgtcaaccgcatctccgggctcctctacgacgatacccgcgacgcgctcaagatcttccacgagaacgtcgtccgccacgccgtttccctacccggagcacgccccccgaaagactgtgacagccctggacgtactctacgctttcaagcgccagggggcgcaccctctacggattccgcggataggtcctccctctcccggtggcgaaatacggagggcggggggtgcacgggttggtggtctaggactcattccaacggagttccctttttcccggcctgtttttctgggggggggggtccggccgcgctccaattttttaccccctggggctgaataaaacaaggcgggggtaactctatgggagtgtccccatttccgagcccccgtgaccaacacaaaaaaaaaaatggtaccgctccccggttcccaaatcccgccccaatagggg

SEQ ID NO: 56349 - protein, 154 aa, Zea mays
  misc_feature: Ceres CLONE 1495641
MSGRRKGGKGLGEGGANRHRRALHDNIQGITTPAIRRLARRGGVNRISGLLYDDTRDALKIFHENVVRHAVSLPGARPPKDCDSPGRTLRFQAPGGAPSTDSADRSSLSRWRNTEGGGCTGWWSRTHSNGVPFFPACFSGGGGPAALQFFTPWG

SEQ ID NO: 56350 - DNA, 724 bp, Zea mays
  misc_feature: Ceres CLONE 1495642
  misc_feature: Encodes the peptide sequence at SEQ ID NO. 56351
aaagctggagctccccgcggtggcggccgctctagaactagtggatcccccgggctgcaggaattcgtctcacccctagaaaaatcgtgctctctcagaggtgggctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggctaccgaagcggtggcggctacggcggtcggcccgagggtggtggtggcggctaccgcggccgccggcggcgctggaaggactgatgtgttgggccatccctggcttcggccgagtatcttatctatctatagtatcggggttaccgttcgcttctgtcac

SEQ ID NO: 56351 - protein, 157 aa, Zea mays
  misc_feature: Ceres CLONE 1495642
  misc_feature (10)..(81): Pfam Name: RRM_1 Pfam Description: RNA recognition motif. (a.k.a. RRM, RBD, or RNP domain)
  misc_feature (48)..(152): Pfam Name: GRP Pfam Description: Glycine rich protein family
  misc_feature: SWISSPROT Homolog: EC 5.2.1.8 Peptidylprolyl isomerase
MAAADVEYRCFVGGLAWATSNESLENAFASYGEILDSKVITDRETGRSRGFGFVTFSSENSMLDAIENMNGKELDGRNITVNQAQSRGGGGGGGGYGGGRGGGGYGGGRRDGGYGGGGGYGGRREGGGGGYRSGGGYGGRPEGGGGGYRGRRRRWKD

SEQ ID NO: 56352 - DNA, 830 bp, Zea mays
  misc_feature: Ceres CLONE 1495644
  misc_feature: Encodes the peptide sequence at SEQ ID NO. 56353
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (30)..(30): n is a, c, t, g, unknown, or other
nnnnnnnnnnnnnnaaaaaaaatacattanttaatattttattttttcatactggtactccccgcggtggcggccgctctagaactagtggatcccccgggctgcaggaattcgtctcacccctagaaaaaaaccgctgcgtaaacgaatccatcgccatggcgtctcgtctcgttgcggcggcggcctcctcctcctccctctcctcagcgtcccccctcgctcgcctaatctctcgccgcggccttgccggtgccgcagacggccatgggtctgcgaaggtgcccttgtggaaagatccgttgagcccgagcatctggaaggaagagcactttgttctagcaagcctctcaattgtggggggttattttttatggtggttacaagcttttttatggaaagaaggaagccaagactgaggcctgcatccccacaggcatagcgtggcggagaatggatttattcccgttatctctggccccggcaaccatggttaaataaaaggaatgcttttatagttgacgcctttctaaattgaataaattggaggcaacaaggaagatttttgcctttaccttacaggaaatatttatttgaataaagcttcctcctttacctccgtcccacccttgaatatatctcttttccttgtccgttggagacttctctggttcgaccaaaacaatggcgaaacctttgtaccgcccttttcacgcctaattcgtagttctcccatggttttcaccctccggggcgcccgccacccggtttcagccctgcccctccgccggatgggtcaaaaatctcctgggcctttctaaaaaattaaa

SEQ ID NO: 56353 - protein, 86 aa, Zea mays
  misc_feature: Ceres CLONE 1495644
MASRLVAAAASSSSLSSASPLARLISRRGLAGAADGHGSAKVPLWKDPLSPSIWKEEHFVLASLSIVGGYFLWWLQAFLWKEGSQD

SEQ ID NO: 56354 - DNA, 649 bp, Zea mays
  misc_feature: Ceres CLONE 1495646
  misc_feature: Encodes the peptide sequence at SEQ ID NO. 56355
  misc_feature (366)..(366): n is a, c, t, g, unknown, or other
  misc_feature (375)..(375): n is a, c, t, g, unknown, or other
  misc_feature (387)..(387): n is a, c, t, g, unknown, or other
  misc_feature (460)..(460): n is a, c, t, g, unknown, or other
  misc_feature (486)..(486): n is a, c, t, g, unknown, or other
  misc_feature (489)..(489): n is a, c, t, g, unknown, or other
  misc_feature (495)..(495): n is a, c, t, g, unknown, or other
  misc_feature (496)..(496): n is a, c, t, g, unknown, or other
  misc_feature (519)..(519): n is a, c, t, g, unknown, or other
  misc_feature (520)..(520): n is a, c, t, g, unknown, or other
  misc_feature (525)..(525): n is a, c, t, g, unknown, or other
tggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcnggaacgccnatcgagggcatngaacggcaaggagctggacggccgcacatcaccgtcaacgaggccagtccccgcgcgccgtggagcggcggcngtgggtaccgtggtggcccgtgagcngcngctacnngcgtggcggccgccctgatggcnngcgcngctacggcggtggcggcggcggctacggtgggcggcggcgctacggtggtggtgggcgcggctacggcgggggcgaacgtgggcggcgggtaacggaacttcccacgggaatgggaggaactgg

SEQ ID NO: 56355 - protein, 111 aa, Zea mays
  misc_feature: Ceres CLONE 1495646
  misc_feature (10)..(82): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (63)..(63): Xaa is any aa, unknown, or other
  misc_feature (66)..(66): Xaa is any aa, unknown, or other
  misc_feature (70)..(70): Xaa is any aa, unknown, or other
  misc_feature (103)..(103): Xaa is any aa, unknown, or other
  misc_feature (104)..(104): Xaa is any aa, unknown, or other
  misc_feature (106)..(106): Xaa is any aa, unknown, or other
MAASDVEYRCFVGGLAWATDDHSLHNAFSTYGEVLESKIILDRETQRSRGFGFVTFSTEEAMXERXSRAXNGKELDGRTSPSTRPVPARRGAAAVGTVVAREXXLXAWRPP

SEQ ID NO: 56356 - DNA, 562 bp, Zea mays
  misc_feature: Ceres CLONE 1495649
  misc_feature (144)..(144): n is a, c, t, g, unknown, or other
aactggagctccccgcggtggcggccgctctagactagtggatcccccggctgcaggattcgtctccccctagaaaacctccatcacccgcctccactcccccctcccaggtgctgcccaggtaagtcggcggcggcgatgacnacgcgctttcaggaagaaccggcaggaagcgcggccccgtttcccccgggacgggccccttcgggaaaaccggggaaaccccccgggagggcccccggaaaacccccgggtgggttttcccccccccccccctttttcctccttttttcaaaaaaaaatcccccccggggggggttttttttttttaaaaaaaggggggggggaaaaccctttttttttcccccccccaaaaaaaccccccccccccacaaaaaattttttttttttccccccccccccccccctgtggggaaaaaaaattataagcccccccccccccctcttccgttggggggggaggaggggccccccccccccccccccacaaaagaaagggggcgcccgtgcgcccaaccctacccccctcggggggaaaaaa

SEQ ID NO: 56357 - DNA, 722 bp, Zea mays
  misc_feature: Ceres CLONE 1495654
  misc_feature: Encodes the peptide sequence at SEQ ID NO. 56358
atagctggagctccccgcggtggcggccgctctagaactagtggatcccccgggctgcaggaattcgtctcacccctagaaaaacctagaaaaatcgcatctggcacgagcagccaagcaaataaaagtagagcggcgagcgacgaccggcctgggccactctttcggccgagcgtagccagcaggtcgtcgtcgtcgtcgtcgtcgcagcacccggccggctagcatggccacgaggaggcagtggtggtggtggtgcctgctgctgctggcggcgtggtgctgcgccgcggccgcgcagtcgccgccggcggcggacccgctgcagagcaagtgccagggggacttcgggaagctgacggactgcatggactacgcgacggggcacgcggcgtcgccctcgtccacctgctgcggcgacgccggcgacacggagaatgcgcgccccgagtgcctctgctacatcatccagcagacgcacacgggggcgcaaccaggtgcagtcgctcggactgcgcttcgaccgactcatggcgctccccgcccgcctgcaacctcccccactccaacgtctcgctctgcatcaccctgctgaacctgaaggcggggctctgccggactacgccccttcttcgccatacccctccaaagatcaccgcctttcaggccgggcgggcaacccttgcgaaggcaacagccgcccccgggccagcgggcttcca

SEQ ID NO: 56358 - protein, 122 aa, Zea mays
  misc_feature: Ceres CLONE 1495654
MATRRQWWWWCLLLLAAWCCAAAAQSPPAADPLQSKCQGDFGKLTDCMDYATGHAASPSSTCCGDAGDTENARPECLCYIIQQTHTGAQPGAVARTALRPTHGAPRPPATSPTPTSRSASPC

SEQ ID NO: 56359 - DNA, 701 bp, Zea mays
  misc_feature: Ceres CLONE 1495660
  misc_feature (701)..(701): n is a, c, t, g, unknown, or other
ctagaactagtggatcccccgggctgcaggaattcgtctcacccctagaaaaagatatctaaaaaaacgtcgacaccctgccaccaacgacaggttaccttcttcgggcccttctcaccatttcctcatttaagccccgtgtgccttgctcctcggtgtttcctccagatagtagtgtttcctcagtggactagtgtgaagctgtgcttagcgtagcgcggaagggaggaaggacaaggcaaggcaactgatggcggcgggcggcggaggcggctcggcggcgcctttcgtgtggaagacttacacgatggtggaggacctcgggacggcaggggttattttgttccgcaccggagaggaggggcggcggcggcccccaacccctttctcttctccccaacgtttgttccccacggaatttcaggcacgacatcttctcccagcttcctacccccaactcaacccctgttgtccggtaaatttccacactcctgcctagctttatttgattgcccttctctccttcaccaagctcaaccccacctctttggggagtccttgtcactctctcatactttcgcggggtgcacccaagacctccctcccagcctttataccaccccccatcccctcacctggcctttttattggagataagaacgtggctcttcccgaactctccttcccctccccccatcccn

SEQ ID NO: 56360 - DNA, 694 bp, Zea mays
  misc_feature: Ceres CLONE 1495661
  misc_feature: Translation starting site: 169
ctccccgcggtggcggccgctctagaactagtggatcccccgggctgcaggaattcgtctcacccctagaaaaaacgcgcctcctctcgccctcgctccgccgccgccgccgccgccgcatcaagcacccgccccgccgtcgcctgaggtagacaccaatccgccgccatggggcgtatgcacagccgcgggaagggtatctcatcgtcggcgctgccgtacaagaggacgcctcctacctggctcaagaccgctgcctccgacgtggaggagatgatcacaaaggcagcgaagaagggacagatgccgtcgcagatcggcgtcctgctccgtgaccagcacggtatcccccttgtcaagagcgtcaccggcagccaaatcctccgcatcccaaggcccatgggctggcacccaaaaaccccgaggacctgtacttcctcatcaaaaaggcggtggggaataagaacaccttgagagaacaaggaaggacaaagacccctaaattcgggctcatttttggggagaacaaggatcccccgccttggcccggtttattaaaccgcacaaagaaaccttcccccccccgggaaagtcacacccaaccccccggggagacctctgggggcgcctaaagtggggtttcccccccaaaaacctggtttcaaaaaaaaaaaattttgggggcaggggtttt

SEQ ID NO: 56361 - DNA, 955 bp, Zea mays
  misc_feature: Ceres CLONE 1495662
  misc_feature (13)..(13): n is a, c, t, g, unknown, or other
  misc_feature (15)..(15): n is a, c, t, g, unknown, or other
aagaaaaaacaananaacaccaggaccacacacgctcatgagctacatttaaaactggagctccccgcggtggcggccgctctagactagtggatcccccgggctgcaggaattcgtctcacccctagaaaaattttctctggttacaaggttgagcagccaattgagggagatgaaatggatcttgattctgaggatgaagaggaggagctaaacattccagtaatcaaggtaaaatggtgatgggaaggaggagcagaaaaatcaagagaaggcagtagctgctacagcttacacatcagtcttggccttgaaatgaaagcacgggatgactcttatgattctgatataggatgagtctgcattgaattctcaatgagggataatcctaatggattacgattgaggagcgagggcattttccctcctgcacaaaaggcctatggattggactcgaaggcgaatggagggatggatcccacctcgaatagaacaacaaagaaaaaaaaccccccacacttccccaaaacaaggcccgagaaggaccagggccaggaactagaggaggtgggcctacaaaaaactgacatcctagacacataccgacgcttcctttttcctgtgatgtagagtgaccggcccgctcaggggatgggcgccacaactctagactcatacacctcaagaaaaagaacagggctgcgcactaagataagggggaggcccgtaccaccaatgggggcaacaaaagtatgcgagaagcctcgggcatacagagtggtggaggcgccgcacatgagacaaataatgtggaagcgcaattgacgaagcgagaaaaaagaccctcccacaaacaaccgcgggcggaacaccacaaccccaattggtaatagttatgagaacacagagatatgtaatcgaataaggggagaacaggggtatgtggcaacaagcg

SEQ ID NO: 56362 - DNA, 752 bp, Zea mays
  misc_feature: Ceres CLONE 1495663
  misc_feature: Encodes the peptide sequence at SEQ ID NO. 56363
  misc_feature (737)..(737): n is a, c, t, g, unknown, or other
  misc_feature (752)..(752): n is a, c, t, g, unknown, or other
tccccgcggtggcggccgctctagaactagtggatcccccgggctgcaggaattcgtctcacccctagaaaaagagcctctgagaacaaaggcagcacactcacttatccagcaaaagagatccagactcaggattcatggccaccgtcagcaccgccgtggtgaccaccatcattgcccgcgcctcgatcgccaggtccaatgctctagggctgcctgcgctgagggcgaggatccagagggtgcggtgcagctactccaaggacgcggcccctgtctccaccaacggcgcaggcgcgtcgctgctcgtctcatcgcgtgctgtgaccacatcggatgggcccgcgctggcactctttgatcagcccatctccacggagggggcggggctcagcctccgattccacaccccctgctgggcgggatcctccctgggggctatcagctcttttggcccttttaaaattttacacctctgacctcgccgaggactaggatcccgtcgtcctctctctctagaaccacgctcatccgttaatgattatcatgcaacactgcctcccgccccaccgcgggtaattttagaacaggggtttttggcgttctacaaccccggcctcatcctgattgaaaaaggttcagcacacctccctatcgccctcaaactaagtgcgaacgcttatatcttggttctgtgtagttccccccatgtaacccatattgctgaggctcttttntgtgaccccacccan

SEQ ID NO: 56363 - protein, 113 aa, Zea mays
  misc_feature: Ceres CLONE 1495663
MATVSTAVVTTIIARASIARSNALGLPALRARIQRVRCSYSKDAAPVSTNGAGASLLVSSRAVTTSDGPALALFDQPISTEGAGLSLRFHTPCWAGSSLGAISSFGPFKILHL

SEQ ID NO: 56364 - DNA, 830 bp, Zea mays
  misc_feature: Ceres CLONE 1495665
  misc_feature: Encodes the peptide sequence at SEQ ID NO. 56365
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (28)..(28): n is a, c, t, g, unknown, or other
  misc_feature (29)..(29): n is a, c, t, g, unknown, or other
  misc_feature (33)..(33): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
ggttggtgtgtttntnnttnnntttagnngagnccnnnnnnnttcatactggagctccccgcggtggcggccgctctagaactagtggatcccccgggctgcaggaattcgtctcacccctagaaaaatcctgccgccgccgccgctcccgctcccagctcgtgttccgcttcttgcagccgtcgccgcgaagcgctccggagaacttccgtcaacatggggaagacacgtggtatgggagccgggagctagctcgagacccaccgcatgacccatcggcgggctgacaaggtgtaccagaagagccttttgggctatgagcggaagaaacccttcgctggggcgtcctcatgccaagggcattgtcctgcagaggattggtcttgaggcccaggagcccagctccgctatccgtaagtgtgctcccgggccgcctgctaagaatggcaagaacattgctgccttcgagcacaatgacggttgctccgaactacttctggggacatcgaccgcggcgtgcattgctggatttgctccaaacggggcacgctgtgggaacagtttccgtggtgtccgggttcaaggcccttcaaggggttcccggtgtgggccccccctggccccttcccagcgagtatgaaagcagaagcccaatggtctttagagttgctccttgcctgcccaaaaccccaccatggcgtgggagtttagaaaccggggagggccccttgccatccatttaacaaacaaatgcggcgggcctttctttattgtttttcacggggcctttttcctgcactttggcgcaacccccaagaatttttgttttg

SEQ ID NO: 56365 - protein, 107 aa, Zea mays
  misc_feature: Ceres CLONE 1495665
MSGRNPSLGRPHAKGIVLQRIGLEAQEPSSAIRKCAPGPPAKNGKNIAAFEHNDGCSELLLGTSTAACIAGFAPNGARCGNSFRGVRVQGPSRGSRCGPPLAPSQRV

SEQ ID NO: 56366 - DNA, 710 bp, Zea mays
  misc_feature: Ceres CLONE 1495671
  misc_feature: Encodes the peptide sequence at SEQ ID NO. 56367
  misc_feature (710)..(710): n is a, c, t, g, unknown, or other
aaagctggagctccccgcggtggcggccgctctagaactagtggatcccccgggctgcaggaattcgtctcacccctagaaaaaacccggcagtcacacctcgaaagcaacagcaagtcagcaacctacctagctagagctatcactatatcagtatcaggtacctagacctagcagcagccacacccacaccgtacgtcggcatggctaggtggtcgtcgtcagctctggtcgccgtcctcgtggtcctggccgcggcggtggcgtgctccgcggcgcgccccgtccccgcgcagcagcagcaggcggtagaggacgtgaagcggccggacacgctgcacgaggggacggtgctgatcccggggatggggcgctacgagatcggcagccactacatcccggacatcggcgggctggaccacagcatccccgccgccacccacggccagttcctccccggcgccgacgacacctgggtgcccaaccccggcttcgaggtccccaacccccttcatgcccggcgcggccactccctgaacacgtacccgcgctggcgagagtggctctcggtcgatctgaacgtcgagcgccgccccccgcccctgaacgaataatactactagctaccctcggtctgctaccgaaacctagcttagcttaactagcccggctttgctgctccatgtacccctgtcttcctgggggcccgn

SEQ ID NO: 56367 - protein, 136 aa, Zea mays
  misc_feature: Ceres CLONE 1495671
MARWSSSALVAVLVVLAAAVACSAARPVPAQQQQAVEDVKRPDTLHEGTVLIPGMGRYEIGSHYIPDIGGLDHSIPAATHGQFLPGADDTWVPNPGFEVPNPLHARRGHSLNTYPRWREWLSVDLNVERRPPPLNE

SEQ ID NO: 56368 - DNA, 704 bp, Zea mays
  misc_feature: Ceres CLONE 1495672
  misc_feature: Encodes the peptide sequence at SEQ ID NO. 56369
  misc_feature (600)..(600): n is a, c, t, g, unknown, or other
  misc_feature (609)..(609): n is a, c, t, g, unknown, or other
  misc_feature (640)..(640): n is a, c, t, g, unknown, or other
aaagctggagctccccgcggtggcggccgctctagaactagtggatcccccgggctgcaggaattcgtctcacccctagaaaaaataccaacctacaattgtcacttccattttctcaataccttaagcaaggaccaatgtctcaagcccagccccctcgttcccaagcccagtggaaacacgttaaatttcaggataaccaagctaatgccatgaaggaaccaggaaccggtgggtatggctatgggacgaaaaatgacaagaataaggatgtggatacaatagcttcggacttcatcaagctgaagcacaaggcttgggcactccagaagagcacaaccatgtaccaaccttctacctaaaggtgtcaatagttcaagaagttgatactatatacttatgcttgtctctgtatagtctataagtcctaattcaaataacaggtgctgcttgcagccttggatatttgcggatgcggagtgaagttaccatggcatccttgctaagaataagaaagtaatgtggttatgaggagatgtgtaattttgtggcgatatatttgcaacaatgatgtatatatgggcatgtttgggtcaaaanaaaaaaaanaaaaaaaaaaataaaataaacaacaatactnagggtaaaaaaaaaaaaaaaacgaaaaccctcggaggaccccaatttcccccctaaaggggagc

SEQ ID NO: 56369 - protein, 74 aa, Zea mays
  misc_feature: Ceres CLONE 1495672
MSQAQPPRSQAQWKHVKFQDNQANAMKEPGTGGYGYGTKNDKNKDVDTIASDFIKLKHKAWALQKSTTMYQPST

SEQ ID NO: 56370 - DNA, 710 bp, Zea mays
  misc_feature: Ceres CLONE 1495673
  misc_feature: Encodes the peptide sequence at SEQ ID NO. 56371
aaagctggagctccccgcggtggcggccgctctagaactagtggatcccccgggctgcaggaattcgtctcacccctagaaaaaatctccctgtttaatcaatccttcaagcgcaagctgcctcctcctcgtcgtccggtcgtgagaagggatggcgggccgtggcaaggctatcggcgctggcgccgcgaagaaggcaacgtcgaggagctccaaggccggactccagttccccgtcggcaggattgccaggttcctcaaggcgggcaagtacgcggagcgcgtcggcgccggcgcccccgtgtacctcgccgccgtcctcgagtacctcgcggctgaggttctcgaacttgccgggaacgccgcgagggacaacaagaagacccgcattgtgccgcgccacatccagcttgctgtgcgcaacgacgaggagctgaccaaactgttgggtggtgccaccatcgcgagcggaggtgttatgcctaacatccatcagcatctgctccccaagaaggctgcctcctccaaagccagtgtcgacgaccaccacaactgaaactgcttcctgcagaaatgatccgaccaccgccttgttttggaggaataggatgatgttgtcttcaatcggggaggagtcgggtatgctgggaaagagaattaaattagtatctgttttttttaaatgggatgtgaaaccggcctgtgaatcc

SEQ ID NO: 56371 - protein, 134 aa, Zea mays
  misc_feature: Ceres CLONE 1495673
  misc_feature (19)..(92): Pfam Name: Histone Pfam Description: Core histone H2A/H2B/H3/H4
MAGRGKAIGAGAAKKATSRSSKAGLQFPVGRIARFLKAGKYAERVGAGAPVYLAAVLEYLAAEVLELAGNAARDNKKTRIVPRHIQLAVRNDEELTKLLGGATIASGGVMPNIHQHLLPKKAASSKASVDDHHN

SEQ ID NO: 56372 - DNA, 667 bp, Zea mays
  misc_feature: Ceres CLONE 1495680
  misc_feature: Encodes the peptide sequence at SEQ ID NO. 56373
aagtggatcccccgggctgcaggaattcgtctcacccctagaaaaaacctcagcactagtctcctcttcgcacgagcgcaacaccatccacccaccagttcgaagcggaggcgaccggcaacctgcggcggagatgtcaggcaggggcaagggcggcaaggggctcgggaagggcggcgcgaagcgtcaccggaaggtgctgcgcgacaacatccaggggatcacgaagccggcgatccggaggctggcgaggaggggtggcgtgaagcgcatctccgggctgatctacgaggagacccgcggcgtgctcaagatctttctcgagaatgtcatccgcgacgctgtgacctacacggagcacgcccgtcgcaaaaaccgtcaccgctatggacgtcgtgtacgccctcaaacgccagggccgcactctctatggcttcggcgggctaggttaggtgtgggtaattgccttgtccaggtgtctcggatctgtggtactagtttggctgccttcctgggttcgaattgtgttaattgtgggagctggttgctttgtctccctgtagtcgtgcttcttttgggtctgtaaaaacccctggttccatggggatggaattggacggtgaaaataggaattgttggcattttagaccttttctccaaccttagc

SEQ ID NO: 56373 - protein, 150 aa, Zea mays
  misc_feature: Ceres CLONE 1495680
  misc_feature (25)..(90): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKIFLENVIRDAVTYTEHARRKNRHRYGRRVRPQTPGPHSLWLRRARLGVGNCLVQVSRICGTSLAAFLGSNCVNCGSWLLCLPVVVLLLGL

SEQ ID NO: 56374 - DNA, 652 bp, Zea mays
  misc_feature: Ceres CLONE 1495831
  misc_feature: Encodes the peptide sequence at SEQ ID NO. 56375
cagagctggagctccccgcggtggcggccgctctagaactagtggatcccccgggctgcaggaattcgtctcacccctagaaaaaaccgaaatcttccgtctccaaatcctcctagcgaattcaccacagcttctcaccaccgctaccttcgatggcacccaaggcggacaagaagccggcggcgaagaagcctgcagaggaggagcccgcgacagagaaggcggagaaggctccggcggggaagaagcccaaggccgagaagcgcctcccggcgggcaagtccgccggtaaggagggcggcgagggcaagaaggggaaaaagaaagcgaagaagtccgtggagacctacaagatctacatcttcaaggtgctgaagcaggtgcaccccgacatcggcatctcgtccaaggccatgtccatcatgaactccttcatcaacgacatcttcgagaagctcgcggccgagtccgccaagctggcgcgctataacaagaagcccaccgtcacctcccgcgagatccagacctcggtgcgcctcgtcctccccggcgagcttgcaagcacgccgcctcccagggcaccaggcccgtcacaagttcactccttcttaggttcatagtactaggctggttggtgtgggagacttggctc

SEQ ID NO: 56375 - protein, 155 aa, Zea mays
  misc_feature: Ceres CLONE 1495831
  misc_feature (60)..(130): Pfam Name: Histone Pfam Description: Core histone H2A/H2B/H3/H4
MAPKADKKPAAKKPAEEEPATEKAEKAPAGKKPKAEKRLPAGKSAGKEGGEGKKGKKKAKKSVETYKIYIFKVLKQVHPDIGISSKAMSIMNSFINDIFEKLAAESAKLARYNKKPTVTSREIQTSVRLVLPGELASTPPPRAPGPSQVHSFLGS

SEQ ID NO: 56376 - DNA, 661 bp, Zea mays
  misc_feature: Ceres CLONE 1495832
  misc_feature: Encodes the peptide sequence at SEQ ID NO. 56377
  misc_feature (448)..(448): n is a, c, t, g, unknown, or other
  misc_feature (530)..(530): n is a, c, t, g, unknown, or other
  misc_feature (569)..(569): n is a, c, t, g, unknown, or other
  misc_feature (570)..(570): n is a, c, t, g, unknown, or other
  misc_feature (576)..(576): n is a, c, t, g, unknown, or other
aaagctggagctccccgcggtggcggccgctctagaactagtggatcccccgggctgcaggaattcgtctcacccctagaaaaaccccaaaaccaaaataatcgccaccgctctccgcaccgaaccgaagcagcggcgatgtcggcggagaagccggctcccgtgcgcgtgctctactgcggcgtctgcggcctcccggccgagtactgcgagttcggccccgacttcgagcgctgcaagccctggctgcgcgcgcacgcgcccggcgtctaccccgacgaccttgtcgccgcctcctcctcacccggcggcggcgacaaggacgtcgacaaggtcggggatcgcctccagggcgtcgggatctccgacggctccaccggcgccgcaggggatgcttccgcgtctaagccccaagaggcgaaacgcctgcctggtggtaagctcaagnaaaaagagaagcaagaagtggtcattgagaagattgtccctgtacagcgcaaatgtgttactgtggtgaaagggcttgattngtttggtgtaaagcttagtgatgcttcgaagaagcttgnngagaangttgcaaccggagcttctgttgttaggggcctacgggagaggagcgaatccacgtacaaggggacatctcatatgaaattgtggg

SEQ ID NO: 56377 - protein, 174 aa, Zea mays
  misc_feature: Ceres CLONE 1495832
  misc_feature (104)..(104): Xaa is any aa, unknown, or other
  misc_feature (131)..(131): Xaa is any aa, unknown, or other
  misc_feature (144)..(144): Xaa is any aa, unknown, or other
  misc_feature (146)..(146): Xaa is any aa, unknown, or other
MSAEKPAPVRVLYCGVCGLPAEYCEFGPDFERCKPWLRAHAPGVYPDDLVAASSSPGGGDKDVDKVGDRLQGVGISDGSTGAAGDASASKPQEAKRLPGGKLKXKEKQEVVIEKIVPVQRKCVTVVKGLDXFGVKLSDASKKLXEXVATGASVVRGLRERSESTYKGTSHMKLW

SEQ ID NO: 56378 - DNA, 738 bp, Zea mays
  misc_feature: Ceres CLONE 1495833
  misc_feature: Encodes the peptide sequence at SEQ ID NO. 56379
  misc_feature (309)..(309): n is a, c, t, g, unknown, or other
  misc_feature (399)..(399): n is a, c, t, g, unknown, or other
  misc_feature (413)..(413): n is a, c, t, g, unknown, or other
acagctggagctccccgcggtggcggccgctctagaactagtggatcccccgggctgcaggaattcgtctcacccctagaaaaaaaaaaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggataagaaggccgcgcccgagttcgtcnaggccgcggcggatttcggcgaggccgcccacggctgcagctgccgtgtttttttcccccccccccccgggggggggggggacccctccnatccaccaccattntaattgattattatcctacccaccccccgggtcggccgccggaacaatcgctccccctagcccccaactggcttcccctaccattagcccccgcgtcgcggcgccccccccacatatcccaccccccccgtccttaccccttcccctcccctctccccacgcaaggtcagcccaacccccccccttccccccccttcccccccacccccctccctttaccctatcccccaccacctcccccacccacattgggccccctaccccgcctcacatccaaaatccacccgcgcgctcccgcgcatctacacacccacaaataccacac

SEQ ID NO: 56379 - protein, 84 aa, Zea mays
  misc_feature: Ceres CLONE 1495833
  misc_feature (1)..(65): Pfam Name: Metallothio_2 Pfam Description: Metallothionein
  misc_feature (51)..(51): Xaa is any aa, unknown, or other
  misc_feature (81)..(81): Xaa is any aa, unknown, or other
MSCNCGSSCGCGSSCKCGKKYPDLEETSTAAQATVVLGVAPDKKAAPEFVXAAADFGEAAHGCSCRVFFPPPPGGGGDPSXPPP

SEQ ID NO: 56380 - DNA, 668 bp, Zea mays
  misc_feature: Ceres CLONE 1495837
  misc_feature: Encodes the peptide sequence at SEQ ID NO. 56381
  misc_feature (436)..(436): n is a, c, t, g, unknown, or other
  misc_feature (488)..(488): n is a, c, t, g, unknown, or other
  misc_feature (491)..(491): n is a, c, t, g, unknown, or other
  misc_feature (524)..(524): n is a, c, t, g, unknown, or other
  misc_feature (539)..(539): n is a, c, t, g, unknown, or other
  misc_feature (540)..(540): n is a, c, t, g, unknown, or other
  misc_feature (584)..(584): n is a, c, t, g, unknown, or other
  misc_feature (650)..(650): n is a, c, t, g, unknown, or other
aaagctggagctccccgcggtggcggccgctctagaactagtggatcccccgggctgcaggaattcgtctcacccctagaaaaagctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccantccccgcgcggcccgtgaagcggcggcggtgggtacggtggtggccgtgaangcngcggctacggcggtggcgggcgccctgatggcngtggcggctacggcnngtggcgcggctaccgtggcggccgcggctacggtggtggtggcngcggctacggcggtggcacccgtggcggcggctacggcaactccgacgggaactgggaggactgancggtggggccccgcgcgc

SEQ ID NO: 56381 - protein, 90 aa, Zea mays
  misc_feature: Ceres CLONE 1495837
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (85)..(85): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAXSPRGP

SEQ ID NO: 56382 - DNA, 671 bp, Zea mays
  misc_feature: Ceres CLONE 1495838
  misc_feature: Encodes the peptide sequence at SEQ ID NO. 56383
taaagctggagctccccgcggtggcggccgctctagaactagtggatcccccgggctgcaggaattcgtctcacccctagaaaaagccgatccagtcccccggcaaattcccaaccgccgcacggcaacaccagcggtcggatcgggggagaaacggaagggcaacagcagagcgcgaattccaccgacaaatccaagatttcgagcacagacacaggcgaaactcgatggcggaggggtccaagccggacgtgccgctgttccagctcctcagcgatcttctccagcaggtggagtcaatgagcaatcaggaagaagtagagctgcgcgctaagattgaagcattaggattagaagtcactaaggtaccagagcagcccgctaatcatctcagcgagctagaaatagctgcagagttggacaagctgtcatcgcggcttgataatgtcgacaagatgatatcatctgccatggcctcagatccagagggggaagtctcttctgagcagcacatctgatatctggatgccggtcataacagcgtctgccaatgagagggcggggtttgtttgggaccagcacccaagggcgccagaaaaaaacaggaagaattccaagaaaatactgggtatttgggcctgttaaaaaattttccgttttgggggggcctg

SEQ ID NO: 56383 - protein, 96 aa, Zea mays
  misc_feature: Ceres CLONE 1495838
MAEGSKPDVPLFQLLSDLLQQVESMSNQEEVELRAKIEALGLEVTKVPEQPANHLSELEIAAELDKLSSRLDNVDKMISSAMASDPEGEVSSEQHI

SEQ ID NO: 56384 - DNA, 684 bp, Zea mays
  misc_feature: Ceres CLONE 1495839
  misc_feature: Encodes the peptide sequence at SEQ ID NO. 56385
caaagctggagctccccgcggtggcggccgctctagaactagtggatcccccgggctgcaggaattcgtctcacccctagaaaaaccggctcagacttctgctgcagcgcctccgccgccgccgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgctctttccccatgaagggagactagagccgatgtggtcttcaagttttgctctatgccagatactagcgtcacgaactgcctttaagctaagattttccataagttggtctcaagcaactatggggttgcatggttggctaccttccaaacttaaatacggggtttgggttgggattgagaagaaccaaatggctcttttgaatttaattttttgaaggttggaccatattttgggggaaaaaaaaacaaatagaacaccaaaacccgctccggaggtacccc

SEQ ID NO: 56385 - protein, 86 aa, Zea mays
  misc_feature: Ceres CLONE 1495839
  misc_feature (30)..(84): Pfam Name: Ribosomal_S27e Pfam Description: Ribosomal protein S27
MVLQNDIDLLNPPAELEKLKHKKKRLVQSPNSFFMDVKCQGCFSITTVFSHSQTVVVCPGCQTVLCQPTGGKARLTEGCSFPMKGD

SEQ ID NO: 56386 - DNA, 660 bp, Zea mays
  misc_feature: Ceres CLONE 1495842
  misc_feature: Encodes the peptide sequence at SEQ ID NO. 56387
  misc_feature (487)..(487): n is a, c, t, g, unknown, or other
aaagctggagctcaccgcggtggcggccgctctagactagtggatcccccgggctgcaggaattcgtctcacccctagaaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaagcggcggcggtgggtacggtggtggccgtgnaggcggcggctaccgcggtggcggccgcctgaatggcgtggcggctaccgcggtggcggcggctacggtggggccggcgctacggtggtggtggcgggggctacggcgggggaaaccgtgggggcgggttccggcatctccaacgggaacttgaagaactgaaccggggggcc

SEQ ID NO: 56387 - protein, 152 aa, Zea mays
  misc_feature: Ceres CLONE 1495842
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (102)..(102): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGSGGGGYGGGRXGGGYRGGGRLNGVAATAVAAATVGPALRWWWRGLRRGKPWGRVPASPTGT

SEQ ID NO: 56388 - DNA, 709 bp, Zea mays
  misc_feature: Ceres CLONE 1495844
  misc_feature: Translation starting site: 185
  misc_feature (311)..(311): n is a, c, t, g, unknown, or other
  misc_feature (403)..(403): n is a, c, t, g, unknown, or other
acaactggagctccccgcggtggcggccgctctagaactagtggatcccccgggctgcaggaattcgtctcacccctagaaaaaatatcccccatctcttcgactcctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggattcgcagaccatccgccacatgatcgaggatgactgcgccnacaacggcctccctcttcctaacgtcaactccaagatcctatccaaggtttttcaccccccccccaagggggggggggggggccccctcctnaccccccccctccccaagccggttcccaacaacctggggtgcccgcccccccccaaagggcccgcctgcctcctgtggaggacccccagaaaccggggatcccgacttcctcccagggcctacccgggtcccgccctttcctcactcccctttgccctgccccccccatcccaacccttattcgcgctccgttttgaccccccccttgcctcaattccttcctccaccattcttttccggcctcccacccctctgtcccacattctgacccccccttctcaatctctcacaatgcccctccccccc

SEQ ID NO: 56389 - DNA, 713 bp, Zea mays
  misc_feature: Ceres CLONE 1495850
  misc_feature: Encodes the peptide sequence at SEQ ID NO. 56390
  misc_feature (19)..(19): n is a, c, t, g, unknown, or other
  misc_feature (225)..(225): n is a, c, t, g, unknown, or other
  misc_feature (235)..(235): n is a, c, t, g, unknown, or other
  misc_feature (310)..(310): n is a, c, t, g, unknown, or other
  misc_feature (427)..(427): n is a, c, t, g, unknown, or other
ccgtggtggcggccgctcnataactcgatggatcccccgggctgcaggaatttctctcacccctagaaaaagtcaagcttttccaaggaacctagctagctagctagtaagaggcacaggccggcaccatgtcgcaccaccattcccaccacaaatctcattctcacaaccgtacccaccaccactctcactctcactccggaggaggtggaggaggcggccccnccgcccgccnccccggaggcgcaggcggagtgcctacatgcccatgtgattggccccaaaatgaacagacgaccacacggaaaanctctcatttctaccatccaccaactaaaaaatagcaagtataataaaaaaatcattaaccctcctcttcaacgtaacacacaacgaaaccaccgtaaagataattcatccaattggngaaaatgttgagtgactcccgaaaaaacgcgccaccccaccaccttccccctggtcaaagaaaacgccaaaccaccggcggtcctcccaatatcgccaccactccacacaggtccaatacaactcgtaacaacatgagaagagtaacgcccgattgaaccagaccccctttactaccgccagcaccaaaggaaagctaaacacaggtgcaaacctcacagccgcgtaagcgcaacgtataataatagtactctcaccgggagagctcgcacatcgtaccacaacag

SEQ ID NO: 56390 - protein, 71 aa, Zea mays
  misc_feature: Ceres CLONE 1495850
  misc_feature (33)..(33): Xaa is any aa, unknown, or other
  misc_feature (36)..(36): Xaa is any aa, unknown, or other
  misc_feature (61)..(61): Xaa is any aa, unknown, or other
MSHHHSHHKSHSHNRTHHHSHSHSGGGGGGGPXARXPGGAGGVPTCPCDWPQNEQTTTRKXSHFYHPPTKK

SEQ ID NO: 56391 - DNA, 659 bp, Zea mays
  misc_feature: Ceres CLONE 1495857
  misc_feature: Encodes the peptide sequence at SEQ ID NO. 56392
  misc_feature (492)..(492): n is a, c, t, g, unknown, or other
  misc_feature (607)..(607): n is a, c, t, g, unknown, or other
aaagctggagctccccgcggtggcggccgctctagaactagtggatcccccgggctgcaggaattcgtctcacccctagaaaaaagcctcgccgccccaccaccccagcattgccttaccttgccttgccttgccctgccctccattccacctccacctcgccgcccaaatccccccacccaacaatcccccatggggtcgcaggccatcgaggcgcaccgcgcgggcgcggaggtgtaccgcggcgcggcgctgtgcgcggagaagtcgacggagctgctggcagaggcgcacctcccgctgggcctgctgccgctggccgacatggaggaggtcggctacaaccgcgccacgggcttcgtgtggctgcgccagaggaagtcgctcacgcacacgttccgcccgatcgcgcgccaggtctcgtacgccgccgaggtcaccgccttcgtggaagaacggcggatgaagcgcatgaccggggtcaagaccaangagctcctcatctgggtcaccctctccgacatgttcgtcgacagggacgacccctccaagatcaccttcaagagccccaccggggctcgcaggaactaccccgtctccgccttcnctaaggaaagcgcgggtgacaacggccccggcgccaaacacaaggaagaagc

SEQ ID NO: 56392 - protein, 155 aa, Zea mays
  misc_feature: Ceres CLONE 1495857
  misc_feature (4)..(150): Pfam Name: DUF538 Pfam Description: Protein of unknown function, DUF538
  misc_feature (100)..(100): Xaa is any aa, unknown, or other
  misc_feature (139)..(139): Xaa is any aa, unknown, or other
MGSQAIEAHRAGAEVYRGAALCAEKSTELLAEAHLPLGLLPLADMEEVGYNRATGFVWLRQRKSLTHTFRPIARQVSYAAEVTAFVEERRMKRMTGVKTXELLIWVTLSDMFVDRDDPSKITFKSPTGARRNYPVSAFXKESAGDNGPGAKHKEE

SEQ ID NO: 56393 - DNA, 641 bp, Zea mays
  misc_feature: Ceres CLONE 1495863
  misc_feature (641)..(641): n is a, c, t, g, unknown, or other
aaaactggagctccccgcggtggcggccgctctagaactagtggatcccccgggctgcaggaattcgtctcacccctagaaaaacgacagaacatttggggcttctccgggcgacagcccactattgacgattgtagccagatgacatgagatctctcaccctgtaaatagggatcgttgtgcccgagccgattgtacatatcaccatcttctcgccggctaaagttattatatgcagcggaaaataacgagagctgaccatgtcaaatcaacacatctgataggattcgatcctgcaggtctctggatcggatgatgtcccatctaatttgcaagcgtcatcgtgccatatctcttctatcgtctagatagaacagaaccacccattggtactctacatataatggaaaaagttctataacgaatatgaccatgtggtctgagatgacatgcaagaaatctcccacttgatcttgaccttagcatgctgatcttgatggagactgactgcacaaatgcactcaggttctgcatgatgggaaatccaattagatcgcagcgggagccttatgatcaacctgtttgatcgactacatgttcttttcaaaaagaaaaaaaaaaaaaaattcttcttgtttttn

SEQ ID NO: 56394 - DNA, 681 bp, Zea mays
  misc_feature: Ceres CLONE 1495865
  misc_feature: Encodes the peptide sequence at SEQ ID NO. 56395
  misc_feature (133)..(133): n is a, c, t, g, unknown, or other
aaagctggagctccccgcggtggcggccgctctagaactagtggatcccccgggctgcaggaattcgtctcacccctagaaaaaaaaaaatctcggcgcggcccaacactatgttgcgtgagctgagagcctngagacgatggtccgactactaccacgcgcggcagggcgcatgtactccaacactgtacgagtgctatgacgccggcaggcacgcgtggcagtcgtgagggcgtactcgcgcaccgacgagtactactacaacgtggacgaccgcatgaggaggcccgcgtacggcgcctaccactgcggctacggctgcaggcagaccgccgtgtacgccgacgagtactcccgcggcggccgctactaaggctacggcgtcgagcaggagcacttcaagagggaggagaaggagcataagcacaaggagcgcctcgccgacgtgggcgccctcgcgggcggcacctttgctctgtacgaggggcaccgtgctaaagaggacccggcctaactcgcagaggcccaagatcgaagccgggttgacaactgcagcagctcctgggcgccagcggttacccctaccacgaagcaccgcaagccgaaggaggtcccactaccagaaccagtgcagcatgaaccccgggtggcccccccgggcaccgggaacggtttctccct

SEQ ID NO: 56395 - protein, 31 aa, Zea mays
  misc_feature: Ceres CLONE 1495865
MRRPAYGAYHCGYGCRQTAVYADEYSRGGRY

SEQ ID NO: 56396 - DNA, 464 bp, Zea mays
  misc_feature: Ceres CLONE 1495870
aagctggagctccccgcggtggcggccgctctagaactagtggatcccccgggctgcagattcgtctcacccctagaaaaactgttctgcgaaggctgcttgtatggtggcacctaagagcatcatctcctacccacagggtctggaaagggcaaggggtcgaggaagtgggaagctttgacccagaggcggacgggtttctttccgttgcaaattcgagggcacgggcccttaagggaaaaaaaattggttttggtggcccaggccccaaagaaaaagggacgggacttttggccggaacccctaggcctggaaatcggcatcacgaagggccccccgtttttcaagggggggctttagcccaaaaagggggaagggccggggttcccaaaccccccaaaccttttttgaattttttcctctggaaccccgggaaaaaaaaaaaaatccccccccaaaaaaac

SEQ ID NO: 56397 - DNA, 530 bp, Zea mays
  misc_feature: Ceres CLONE 1495873
  misc_feature: Encodes the peptide sequence at SEQ ID NO. 56398
  misc_feature (101)..(101): n is a, c, t, g, unknown, or other
  misc_feature (102)..(102): n is a, c, t, g, unknown, or other
aaatctggactccccgcggtggcggccgctctagaactagtggatcccccgggctgcaggattcgtctcacccctagaaaaactcctctatcttcgcatcnntggcacgagcagccaagcaaataaaagtagagcggcgagcgacgaccggcctgggccaccctttcggccgagcgtagccgagcaggtcgtcgtcgtcgtcgcagcaccccgccggctagcatggccacgagagcagtggtggtggtggtcctgctgctgctggcggcgtggtgctgcgcccgcgccgcgcagtcgccggcgggcggcggaccccgctgcagagcaagtgccaggggggactttcggaagctgacggactgcatggactacgcgacggggcacgcggggtcccctcgtccactgctggcgcgaccccgggaaccggaaaaggcccgccccgagtgctctgctaaatcatccagaaggtggcccgggggcgccaacccggtggcattcccttcggccttgggccttttaaccgaattatt

SEQ ID NO: 56398 - protein, 102 aa, Zea mays
  misc_feature: Ceres CLONE 1495873
MATRAVVVVVLLLLAAWCCARAAQSPAGGGPRCRASARGDFRKLTDCMDYATGHAGSPRPLLARPREPEKARPECSAKSSRRWPGGANPVAFPSALGLLTEL

SEQ ID NO: 56399 - DNA, 729 bp, Zea mays
  misc_feature: Ceres CLONE 1495875
  misc_feature: Encodes the peptide sequence at SEQ ID NO. 56400
cccagctggagctccccgcggtggcggccgctctagaactagtggatcccccgggctgcaggaattcgtctcacccctagaaaaactgatccactctccgcttcccgctccgatcgacctgctccctccccaccaccgagcccatggcggaccagctcaccgacgaccagatcgccgagttcaaggaggccttcagcctcttcgacaaggacggggatggttgcatcacgaccaaggagctgggcactgtcatgcgctcgctggggcaaaatcctacagaggctgagctccaggacatgatcacagaggtccatgctgatgggaaccgcaccatcgattttcccagagtttctccaccttatggttcgcaagaagaaggaagccggcgccgaagaaaaactccaggaggccttccccgcgtttgaataggaacagaactgcttctttttgggccccgaaccccccccattgtatggaaaagctgtggttaggaacccacctggtgatgacggtgttcaaactctttccgcggaggctttaatttcagacgctgcaggccccaactctaacttcgacgggagtgttctccaggtgtactggtcgcctcaacgcggggccgccaataaatgattgtactccaagggtcacaacgctaatctcctcgactgggccccatttcgttcgtcctctctctccgcggctcattgggtgcgcgggaatagcggatga

SEQ ID NO: 56400 - protein, 93 aa, Zea mays
  misc_feature: Ceres CLONE 1495875
  misc_feature (12)..(40): Pfam Name: efhand Pfam Description: EF hand
  misc_feature: SWISSPROT Homolog: EC 2.7.11.1 Non-specific serine/threonine protein kinase
MADQLTDDQIAEFKEAFSLFDKDGDGCITTKELGTVMRSLGQNPTEAELQDMITEVHADGNRTIDFPRVSPPYGSQEEGSRRRRKTPGGLPRV

SEQ ID NO: 56401 - DNA, 730 bp, Zea mays
  misc_feature: Ceres CLONE 1495876
  misc_feature: Encodes the peptide sequence at SEQ ID NO. 56402
  misc_feature (78)..(78): n is a, c, t, g, unknown, or other
  misc_feature (395)..(395): n is a, c, t, g, unknown, or other
  misc_feature (427)..(427): n is a, c, t, g, unknown, or other
  misc_feature (429)..(429): n is a, c, t, g, unknown, or other
  misc_feature (512)..(512): n is a, c, t, g, unknown, or other
  misc_feature (535)..(535): n is a, c, t, g, unknown, or other
  misc_feature (537)..(537): n is a, c, t, g, unknown, or other
  misc_feature (570)..(570): n is a, c, t, g, unknown, or other
  misc_feature (593)..(593): n is a, c, t, g, unknown, or other
  misc_feature (690)..(690): n is a, c, t, g, unknown, or other
aagctggagctccccgcggtggcggccgctctagactagtggatccctcgggctgcaggaattcgtctcacccctagnaaactgcccctcctccgccttttcgcctctctccactttccccgtccttcgccgtcgcggccgcgtcctagtctgatggccagccgctgggtccgacccgaggtgtacccgctgttcgcggcgatgggagttgccgttggcatctgcgggtttcagctcttccggaacatcaccggcaacccggaagtccgggtaaacaagggatgtagggcagccggggggcttgagaaccatgacgaggggaagctttacgccatgcatggcctttaaagttttttttttttttccccccccccgggggggggggggggggggtnaacaattttcttcccctgctttcttcctcttngnggaaggagggttatagggtaggtcgtttcaggaacgaggggggtgtgcgggcattagttttccctgtgccgaggggggggggnccgctttgggcgagcaaccgccntnggcaggggttcggtgcccgccctcggccagagngctctgttaataattaatgttcnttctcccctcctttcctcgtcacagtaaggcgcgcacctctataacgttgtcgcacagcccgctcccccttcggagcgcgctacgctccgtcgacgngggtgctgtttcctctctgcctcttccgcactcacccccc

SEQ ID NO: 56402 - protein, 64 aa, Zea mays
  misc_feature: Ceres CLONE 1495876
  misc_feature (2)..(64): Pfam Name: B12D Pfam Description: B12D protein
MASRWVRPEVYPLFAAMGVAVGICGFQLFRNITGNPEVRVNKGCRAAGGLENHDEGKLYAMHGL

SEQ ID NO: 56403 - DNA, 664 bp, Zea mays
  misc_feature: Ceres CLONE 1495877
  misc_feature: Encodes the peptide sequence at SEQ ID NO. 56404
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (615)..(615): n is a, c, t, g, unknown, or other
  misc_feature (616)..(616): n is a, c, t, g, unknown, or other
  misc_feature (619)..(619): n is a, c, t, g, unknown, or other
  misc_feature (620)..(620): n is a, c, t, g, unknown, or other
atcgcaaacacaaacacattcgtctctcactagctaggtagcacaagtgtaactagctagctagtagtcgtctctgtctctttgagagttctcatggctaattcctcacacaaaacaggtgtgttcgtgcttctcttgttgacagcgtcatcgtccatgctacaggctactagggtggcggcgccgcctactgaccgccggcatgcacaagctgcacatcatcaagcgcacgtcaaggagaccttaccgagccccgcagcttcccaagaatcgacgacaagagatatggcaccgccttccagcgatgctgagacgactaccgccgtcgccaagcgttgggggacgacgacgacgacgtcgacgcaggtgccggacgggtcggtgccgagcccaggcataggccatcagcaaatactactgcagcaataaactgcgcgaacaaatgtctatacatacatatagatatatacaaaataaagctaggtataccttggacctagctagctataaatattatattgctggagttatacgtatatatcgatcgtcactactatatgcatatgtacggtaatctgtcatatacgaaatggcatttcctagnnncnnnnncgnncannacaaaaaaaaaaaaaaaaaaaaagaagaaaaaaaaaaaaaaaaa

SEQ ID NO: 56404 - protein, 111 aa, Zea mays
  misc_feature: Ceres CLONE 1495877
MANSSHKTGVFVLLLLTASSSMLQATRVAAPPTDRRHAQAAHHQAHVKETLPSPAASQESTTRDMAPPSSDAETTTAVAKRWGTTTTTSTQVPDGSVPSPGIGHQQILLQQ

SEQ ID NO: 56405 - DNA, 635 bp, Zea mays
  misc_feature: Ceres CLONE 1495878
  misc_feature: Encodes the peptide sequence at SEQ ID NO. 56406
  misc_feature (635)..(635): n is a, c, t, g, unknown, or other
ggagctccccgcggtggcggccgctctagaactagtggatcccccgggctgcaggaattcgtctcacccctagaaaaaccaacatattcaagtggactgctcttatcaagggcccttctgaaacaccttatgaaggtggtgtgtttcaacttgcgttcgcaattccagagcagtatcctctactgcctcctcaagttcgatttttaaccaaaattttccacccaaatgtgcatttcaagacaggtgaaatttgtcttgatatattgaagaatgcatggagccctgcatggacccttcactctgtttgtagagcgataattgctctgatggcccatcctgaaccagacagcccacttaactgtgattcaggcaatctcctgcggtcgggtgacatcagacgctatcaatcaatggcccacatgtatacaaggctggcatgcatgccaaaagaaagttagatgtagaacatgtgcctagccaagagcctatgtcagtccaatatgtgacacggtggctgtgtgctgtctgtctgtaaactcgtggttccttgtttcctactaaccctaacccatcatgggatggtattctggaatctggaacccggaatcccaatgcttggtctgagaagaaccaan

SEQ ID NO: 56406 - protein, 43 aa, Zea mays
  misc_feature: Ceres CLONE 1495878
  misc_feature: SWISSPROT Homolog: EC 6.3.2.19 Ubiquitin--protein ligase
MAHPEPDSPLNCDSGNLLRSGDIRRYQSMAHMYTRLACMPKES

SEQ ID NO: 56407 - DNA, 684 bp, Zea mays
  misc_feature: Ceres CLONE 1495977
  misc_feature: SWISSPROT Homolog: EC 3.2.1.4 Cellulase
  misc_feature (219)..(219): n is a, c, t, g, unknown, or other
  misc_feature (227)..(227): n is a, c, t, g, unknown, or other
  misc_feature (230)..(230): n is a, c, t, g, unknown, or other
  misc_feature (238)..(238): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (430)..(430): n is a, c, t, g, unknown, or other
  misc_feature (590)..(590): n is a, c, t, g, unknown, or other
cgattgggtaccgggccccccctcgagcactgcagtggtaaaggtaccggggcaagtacgacagcagcatcgcggaggtgaagagctactacgcctccgtcagcggctaccacgacgagctcctctgggccgcgctctggctccaccgcgccaccggacgcgccgagtacctggactacgtcgtcgacaacgccgacgacttcggcggcaccggctggngcctatcnacnccgaaagntttccaaannnnnnnccccttttggggggggggggggaaaaccgcgggttttttcccccaaaaaaagggggggtgtttttttttaataaaaaccccccctcccgccggtgttggggggggggaggggagtttatttgtgcacccccacgttataagtttttaactcttaccccctcccctttctatataatntgtgatggtgtggtgagaggggggggggggatgttttttggaaaggcggtttttttcccctaattccccggcggcgagaatcggtggcgggtccatattatgccactttttgtgggcgtgtatagagcgttcatcttgtaatactcgtctctgtcccctnctcgcctcttctcccttgcttgcctcgcttctgctttatcggagggtggagtgggaatattttaagaaaagggtgttttgaggcggtataaaga

SEQ ID NO: 56408 - DNA, 662 bp, Zea mays
  misc_feature: Ceres CLONE 1495985
  misc_feature: Encodes the peptide sequence at SEQ ID NO. 56409
cgattgggtacgggccccccctcgagccactgcagtggtaaagggaagcagcaacatatcaagctcagagcctcagagcgccagccaagtcttgcggtcgcgaagagcaacgcaacaagatggtgaagctcgcattcggaagcgtcggcgactccttcagcgtcacctccatcaaggcctacgtggcggagttcatcgccaccctcctcttcgtcttcgccggcgtgggttccgccatcgccttcgggcaactgacgaatggcggcgcgctggaccctgcgggactggtggcgatcgcggtggcgcacgcgctggccctcttcgtgggcgtctccgtggccgcgaacacctccggcggccacctgaaccccgccgtgacgttcggcctggccgtgggcggccacatcaccgtcctcaccggcctcttctactgggtggcccagctgctgggcgcgtccgtggcgtgcctgctcctcaggttcgtgacccacggcaaggccatcccgacgcacggcgtctccggcggcaccaccgagctggagggcgtggtgttcgagatcgtcatcaccttcgcgctcgtctacaccgtctacgccaccgccgccgaccccaagaagggctccctcggcaccatcgcgcccatcgccatcggcttcatcgtc

SEQ ID NO: 56409 - protein, 181 aa, Zea mays
  misc_feature: Ceres CLONE 1495985
  misc_feature (11)..(181): Pfam Name: MIP Pfam Description: Major intrinsic protein
MVKLAFGSVGDSFSVTSIKAYVAEFIATLLFVFAGVGSAIAFGQLTNGGALDPAGLVAIAVAHALALFVGVSVAANTSGGHLNPAVTFGLAVGGHITVLTGLFYWVAQLLGASVACLLLRFVTHGKAIPTHGVSGGTTELEGVVFEIVITFALVYTVYATAADPKKGSLGTIAPIAIGFIV

SEQ ID NO: 56410 - DNA, 1124 bp, Zea mays
  misc_feature: Ceres CLONE 1495990
  misc_feature: Encodes the peptide sequence at SEQ ID NO. 56411
gatgcatctgtgtggcaaacagttctgaggtctgagcaatggcggccggccagtttgcagcagcaggagtcctcacgggccttctcgccctcgcaacacttgcaagctgcaacactgatggcgacatactgtacaagcagaggctagcatgggaggatccaaacaacgtgctgcagagctgggatccaaccctcgccaatccctgcacgtggttccatgttacctgcaacctgaacaactccgtcgtccgtgtggatttgggaaaggcaggcatctccggccccctgcttccagatcttggagcacttgagagcctccagtacatggagctgttcggcaacagcctgaacggttcgattccggcaacgctgggcaacctgactgatctcatcagcttggatctctgggacaacctgcttaccggcccaatcccaactacgcttggttccatcagcacgctgcaatatctgaggttgtacgagaacaacctgacagggcctataccaccatcgttgggcaatctgactagccttgtggaactgaagctccacaggaattcgttgagcggttcgattccggcctcccttggcgacatcaaatcgttgcagttcttgaaattgaacgagaatatgctgaccggcacggttccattggaagtcctctcccttgtcgttgttggcaacctgaccgagctaaatattgcaagaaacaaccttgatggcactgagagatcatccggacttagagtgactgcggttatccaggacatgaggactgcatgatatggcttgaagagtcctggatcaaggctttattttaatttgcttcatgtagacaccggaaataaatgaataattgcaatgggatgcattggccttgattattcaattatgtgtctagtgttgttcacatatgtgtccagtgttgtcatatgttataccatatgaccacttcaggcccacatgcgtcatgcgccatatgcctgaacctctagtccacacacgtttgtaaaactttgagagtcagctctaatatcatttgtaacaccctagccaccctggaccggtgttacttactcctagcagccctctaagatcagaccattcccacaaaaaaaaaaaaaa

SEQ ID NO: 56411 - protein, 247 aa, Zea mays
  misc_feature: Ceres CLONE 1495990
  misc_feature (24)..(64): Pfam Name: LRRNT_2 Pfam Description: Leucine rich repeat N-terminal domain
  misc_feature: SWISSPROT Homolog: EC 2.7.11.1 Non-specific serine/threonine protein kinase
MAAGQFAAAGVLTGLLALATLASCNTDGDILYKQRLAWEDPNNVLQSWDPTLANPCTWFHVTCNLNNSVVRVDLGKAGISGPLLPDLGALESLQYMELFGNSLNGSIPATLGNLTDLISLDLWDNLLTGPIPTTLGSISTLQYLRLYENNLTGPIPPSLGNLTSLVELKLHRNSLSGSIPASLGDIKSLQFLKLNENMLTGTVPLEVLSLVVVGNLTELNIARNNLDGTERSSGLRVTAVIQDMRTA

SEQ ID NO: 56412 - DNA, 673 bp, Zea mays
  misc_feature: Ceres CLONE 1495999
  misc_feature: Encodes the peptide sequence at SEQ ID NO. 56413
  misc_feature (382)..(382): n is a, c, t, g, unknown, or other
  misc_feature (409)..(409): n is a, c, t, g, unknown, or other
  misc_feature (445)..(445): n is a, c, t, g, unknown, or other
  misc_feature (457)..(457): n is a, c, t, g, unknown, or other
  misc_feature (458)..(458): n is a, c, t, g, unknown, or other
  misc_feature (556)..(556): n is a, c, t, g, unknown, or other
cgattgggtaccgggccccccctcgagccactgcagtggtaaaggatggaacttgcaaattcgatattgagaatttgcgatacccgataccgatctaggagaagagaaaggcgtcatgtcgtcgttcggacgcaattcatggtgtatcctcgtgctggcctccgtgctcctcctgtcctgcctcgccgagacggccgtggccaaccgaacaggcgagctcaccgtcttctggggccggaacaaggaggagggcaccctgcgtgaggcctgcgacacaggactctacaacaccgtcatcatctccttctacagcgtcttcggccacggccgctacgccctcgacctctcccggcacccgctggacggcgtcagcgccgacatncagcgctgccagtccccagggcatccngtcttccctctcatcggcggcgggggaaacactacntcatcccttccnntcgcgtcgcggaggccgtcgcggaacacctgtggaaccgttcctcggggggggaaaaaacgacgtggcccgcccctccgggaccggggggccaggggnttaatttttaatttaaaaacaggggcaccggggaaacctaaaaaaaattcgcgcccctttttatttttttaaatgtgttcccccccccccaaaaaatttttgggtgaaggggccccc

SEQ ID NO: 56413 - protein, 170 aa, Zea mays
  misc_feature: Ceres CLONE 1495999
  misc_feature: SWISSPROT Homolog: EC 3.2.1.14 Chitinase
  misc_feature (89)..(89): Xaa is any aa, unknown, or other
  misc_feature (115)..(115): Xaa is any aa, unknown, or other
MSSFGRNSWCILVLASVLLLSCLAETAVANRTGELTVFWGRNKEEGTLREACDTGLYNTVIISFYSVFGHGRYALDLSRHPLDGVSADXQRCQSPGHPVFPLIGGGGNTTSSLPXASRRPSRNTCGTVPRGGKKRRGPPLRDRGARGLIFNLKTGAPGKPKKNSRPFLFF

SEQ ID NO: 56414 - DNA, 787 bp, Zea mays
  misc_feature: Ceres CLONE 1496001
  misc_feature: Encodes the peptide sequence at SEQ ID NO. 56415
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (24)..(24): n is a, c, t, g, unknown, or other
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (46)..(46): n is a, c, t, g, unknown, or other
  misc_feature (55)..(55): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
nnnnnccccnnnnnaaggtagagnaagagagggggngnnnnnnggnagagggggntaggagtccccnnnnnnnnnnnnannnnnnnnngcggatgggtacgggccccccctcgagccactgcagtggtaaagggttgaggtgattgctctaagcgtgcacaggagactatccacctcctcttggacctcctggaggccccagatccgtccaccctggagaagttccttggaacgatccccatggtgttcaatgtcgttatcctctcccctcatggttacttcgctcaagctaatgtcttgggttaccctgacaccggaggccaggttgtctacatcttggatcaagtgcgcgctatggagaacgaaatgctgctgaggatcagccagtgtggttctggacatcacgcccaaaaatccttattgtcccccaggttgctcccctgaatgcaaccttggcaccaccctggggcccaaggaatagtgaaaaaggtctttggaaacattaaacacttccccccacccccccccttgggtggcctgttcaaaacaagaaaaaatggaaacctcgtccgcgaatgtgggaaattttgggaatttttgaagactctcggcccttatccgttggaaatccttttacctggctaattaccaggggcgctaaagaaactatccatccgtaagagcctttccagggggataatccttgtgcattctgctatctttttcgttaatccaccctgttgcgccgggtaaacccccactctactattttgttacaatactccac

SEQ ID NO: 56415 - protein, 67 aa, Zea mays
  misc_feature: Ceres CLONE 1496001
  misc_feature: SWISSPROT Homolog: EC 2.4.1.13 Sucrose synthase
MVFNVVILSPHGYFAQANVLGYPDTGGQVVYILDQVRAMENEMLLRISQCGSGHHAQKSLLSPRLLP

SEQ ID NO: 56416 - DNA, 662 bp, Zea mays
  misc_feature: Ceres CLONE 1496015
  misc_feature: Encodes the peptide sequence at SEQ ID NO. 56417
  misc_feature (662)..(662): n is a, c, t, g, unknown, or other
cgattgggtacgggccccccctcgagccctgcagtggtaaaggctttggtggcttcctcggcctccccgcggacctcgaacccgaagtgccgcggcgcacgccgagtgccagtgtaagcgtatttggggtttcacctacctctctgcaatgttcatatgatccaagaggaaacagtgtgcccacaatattgctaatgatgcagaggaagttatatgatcgcggaggacttaaggttgaagggatctttaggattaatgcagaaaatagccaggaagtctatgtgagggaccaattaaacagtggagtggttccaaatgaagttgacttgcactgccttgccgggttgataaaggcatggtttcgggagcttccttcaggtgtattggatgcactgacaccagaacaagtgatgcactgcaacacggaaggggggtgcgctctccttgcttctatgctaccaccagtggaagcagcattacttgactgggcaattaatctgatggccgatgttgtagagcaagaaaactacaacaagatgaacgcccggaacatcgcgatggtttttgcgcccaatatgactcagatggccgatccgttaactgccctgatacatgcggttcaggtgatgaatttcctcaagaccttaatcttgaagactctn

SEQ ID NO: 56417 - protein, 220 aa, Zea mays
  misc_feature: Ceres CLONE 1496015
  misc_feature (60)..(197): Pfam Name: RhoGAP Pfam Description: RhoGAP domain
  misc_feature: SWISSPROT Homolog: EC 2.7.11.1 Non-specific serine/threonine protein kinase
IGYGPPLEPCSGKGFGGFLGLPADLEPEVPRRTPSASVSVFGVSPTSLQCSYDPRGNSVPTILLMMQRKLYDRGGLKVEGIFRINAENSQEVYVRDQLNSGVVPNEVDLHCLAGLIKAWFRELPSGVLDALTPEQVMHCNTEGGCALLASMLPPVEAALLDWAINLMADVVEQENYNKMNARNIAMVFAPNMTQMADPLTALIHAVQVMNFLKTLILKTL

SEQ ID NO: 56418 - DNA, 657 bp, Zea mays
  misc_feature: Ceres CLONE 1496029
  misc_feature: Encodes the peptide sequence at SEQ ID NO. 56419
cgattgggtccgggccccccctcgagccctgcagtggtaaagggggtcggctctcggactgggtctggcatattcgtgcttggtcccacgatctcttcgttggagtgggaccctttctcctcacctcagctgccggagacgactgcctcagtgtccacgttgagaatacgggtgattggacaccggagctcaagcgcatctgcctctaccagtacttcgcgccgggcgtgcccagacgggctgccttcggcgacctaggggcgctgcacttacttacgcaaagcccgtcgaggttggtggtctacggaccctacggagcctccgcgcaggacttcagaaactgcgacgtgctgctccatcgtcggtctcggaatgcgcgccacgtccgatatcatcatccgcagagatgtctgcactaactgagatctggacgacgactggatggatgtgccgctgcagaccggccgtgttcgaggactgctcgcccacctgcacgcagcaactgtgagcggcgtcaacatgaggaggctgtacttcacgagctgcgacctctgctactgcgtcacggtgcagcctgttactctcgagtaggtagtagctgtcatggacgcagtgacgatatgcacactatggggtcattcgactgctcactacagc

SEQ ID NO: 56419 - protein, 138 aa, Zea mays
  misc_feature: Ceres CLONE 1496029
IGSGPPLEPCSGKGGRLSDWVWHIRAWSHDLFVGVGPFLLTSAAGDDCLSVHVENTGDWTPELKRICLYQYFAPGVPRRAAFGDLGALHLLTQSPSRLVVYGPYGASAQDFRNCDVLLHRRSRNARHVRYHHPQRCLH

SEQ ID NO: 56420 - DNA, 664 bp, Zea mays
  misc_feature: Ceres CLONE 1496034
  misc_feature: Encodes the peptide sequence at SEQ ID NO. 56421
cgattgggtccgggccccccctcgagccctggagtggtaaaggggagtggaatctacaggggaaaacaagcctgtgtttcacatacaagtcatgcgacgcgatggcgatggcggcgctgcgacgcgaggggaggcgcctcctcctcgcccccaccgtccccaaccggtcttcagcggccgcttccgctgcggggactcgatcctccgccatgtcgcaaccggagatgggtccacttggtgcacgttctatttcaactcaagttgtgagaaaccggatgaagagtatcaaaaacatccggaagatcacaaaggctatgaagatggttgcagcatcgaagcttccggctgttcaaacgacgactgaaagttcacgcggcttgtggcagccgttcaccgcccttcttggggacgctcctagtgttgacgtcaagaagaatgtgattgtggccattacctctgataagggactctgtggtggtatcaattcaacctcgagtgaaagttagcacggcccttcacaaactgacgtctggtccagataaagaaagcgagtatgttatattaggagaaaaaggcacagttcagctgttgcgtgactcgaacacatgattgaaatgagcgcacgtgaactaccgaacaaccctatcaactatacgctgattgt

SEQ ID NO: 56421 - protein, 134 aa, Zea mays
  misc_feature: Ceres CLONE 1496034
  misc_feature (50)..(135): Pfam Name: ATP-synt Pfam Description: ATP synthase
  misc_feature: SWISSPROT Homolog: EC 3.6.3.14 H(+)-transporting two-sector ATPase
MAMAALRREGRRLLLAPTVPNRSSAAASAAGTRSSAMSQPEMGPLGARSISTQVVRNRMKSIKNIRKITKAMKMVAASKLPAVQTTTESSRGLWQPFTALLGDAPSVDVKKNVIVAITSDKGLCGGINSTSSES

SEQ ID NO: 56422 - DNA, 670 bp, Zea mays
  misc_feature: Ceres CLONE 1496036
  misc_feature: Encodes the peptide sequence at SEQ ID NO. 56423
cgattgggtccgggccccccctcgagccctgcagtagtagcgcgcacacaccactgcacaaagcacgtcactgctcggcttgccttgtcgtcctcttcccttgcaatggctaccaaaatggtcctgctgtgtcgctttgtggccatcacggcggctctcgcctgcctcctccgccccggcgcgcccgtcgagctccaccgcaagctctccgggtggtccgacgacgccggcgcgacatgttacggtgcagccaccggcgctggaagcgacggtggtgcatgcgggtaccaaaacgccgtcgaccagccgcctttcgcgtccatgatcgccgccggtagaccgtccatcttcctgaacggcaagggctgcggctcctgctaccaagtgaaatgcaccggccacgcgtcgtgctccgacagcccggtgacggtggtcctcaccgacgagtgccccggctgcgcgtgcctggacgagcccgagcacttcgacctgagcggaacggctttaggagccatggcgattcccggtcaggacgaccagctccgcagcgccggacgcctcaagatccagaacaccccggttgccgtgcaacttggaacgggatgaacatcgcgtttcagggtggacgccgggctcgaaggctaaactacttgggggtagcttgttccaa

SEQ ID NO: 56423 - protein, 166 aa, Zea mays
  misc_feature: Ceres CLONE 1496036
  misc_feature (74)..(156): Pfam Name: DPBB_1 Pfam Description: Rare lipoprotein A (RlpA)-like double-psi beta-barrel
MATKMVLLCRFVAITAALACLLRPGAPVELHRKLSGWSDDAGATCYGAATGAGSDGGACGYQNAVDQPPFASMIAAGRPSIFLNGKGCGSCYQVKCTGHASCSDSPVTVVLTDECPGCACLDEPEHFDLSGTALGAMAIPGQDDQLRSAGRLKIQNTPVAVQLGTG

SEQ ID NO: 56424 - DNA, 671 bp, Zea mays
  misc_feature: Ceres CLONE 1496039
  misc_feature: Encodes the peptide sequence at SEQ ID NO. 56425
  misc_feature (576)..(576): n is a, c, t, g, unknown, or other
  misc_feature (630)..(630): n is a, c, t, g, unknown, or other
cgattgggtaccgggccccccctcgagccctgcagtggtaaaggtcgctgcggagacggggagtcttccgactcttccccaacgggaattcctcattcacatccctacgcacgaacggaaacgccccatgctgcgctcgcagtctcgcatggactccaccactgctgctgctaccgcggccgcggctgcggcgccggcgccggtgctgctggtgacgaacgacgacggaatcgacgcgccggggctccgcttccttgtcgaccgtctcgtcgccgcagggcgataccgcgtactcgtctgcgcgcccgacacagacaaatcgggtgtgagccactgcatcacatggcgccctgcactccgctgtaaacgtgttgatataataggtgctacagcatttggagtttcaggaactcctgctgactgtgcttctttaggcatctctggaaaactatttgatggtttggttcctgatctggtacttagtggaatcaacattggaaataattgtgggtaccatgtcatttattctggaacagttgctggtgctagggaggcattcttatatgggattcctgncatagctatgtcatatgattgggttgcgggtcggagcagtgttatgacctcaangtgtctgcagaagtctgcatgcctctgataatgctatcgtg

SEQ ID NO: 56425 - protein, 169 aa, Zea mays
  misc_feature: Ceres CLONE 1496039
  misc_feature (18)..(170): Pfam Name: SurE Pfam Description: Survival protein SurE
  misc_feature: SWISSPROT Homolog: EC 3.1.3.5 5'-nucleotidase
  misc_feature (143)..(143): Xaa is any aa, unknown, or other
  misc_feature (161)..(161): Xaa is any aa, unknown, or other
MDSTTAAATAAAAAAPAPVLLVTNDDGIDAPGLRFLVDRLVAAGRYRVLVCAPDTDKSGVSHCITWRPALRCKRVDIIGATAFGVSGTPADCASLGISGKLFDGLVPDLVLSGINIGNNCGYHVIYSGTVAGAREAFLYGIPXIAMSYDWVAGRSSVMTSXCLQKSACL

SEQ ID NO: 56426 - DNA, 666 bp, Zea mays
  misc_feature: Ceres CLONE 1496046
  misc_feature: Encodes the peptide sequence at SEQ ID NO. 56427
  misc_feature (526)..(526): n is a, c, t, g, unknown, or other
cgattgggtaccgggccccccctcgagccactgcagtggtaaaggggggtttcgtcgcttccagccgccgccgcgtccgcctcgccaagcgcagcagccgccgcagcacatcgctctctcgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcgggacgttactccaagaagcggttccgcaaggcgcagtgcccgatcgtcgagcgcctcacaaactcgctcatgatgcacgggcgcaacaacggcaagaaggtcatggctgtccgcatcatcaagcataccctggagatcatccacctgctcaccgatgccaaccccatccaggtcgtcgtcgacgcgatcatcaacagtggaccccgtgaggatgccacccgtattggttccgctgggtgtgtgaggaggcangccgtgaatatctcacccctgaagagggtgaaacagccatctacctccctcacactggtgcccaggagagtgctttccgaacatcaaaaccattgccgagtgccttgcagatgtgctgatcaacgctgccaaaggctcat

SEQ ID NO: 56427 - protein, 178 aa, Zea mays
  misc_feature: Ceres CLONE 1496046
  misc_feature (44)..(162): Pfam Name: Ribosomal_S7 Pfam Description: Ribosomal protein S7p/S5e
  misc_feature (132)..(132): Xaa is any aa, unknown, or other
MAEVEQQQDTPKLFNRWTFDDVQVNDISLNDYLAVNATKHAMYLPHTAGRYSKKRFRKAQCPIVERLTNSLMMHGRNNGKKVMAVRIIKHTLEIIHLLTDANPIQVVVDAIINSGPREDATRIGSAGCVRRXAVNISPLKRVKQPSTSLTLVPRRVLSEHQNHCRVPCRCADQRCQRL

SEQ ID NO: 56428 - DNA, 670 bp, Zea mays
  misc_feature: Ceres CLONE 1496048
  misc_feature: Encodes the peptide sequence at SEQ ID NO. 56429
  misc_feature (637)..(637): n is a, c, t, g, unknown, or other
  misc_feature (670)..(670): n is a, c, t, g, unknown, or other
caattgggaccgggccccccctcgagccactgcagtggtaaaggagtcgtcaccgagaagcagaagcagcagctgctgcctgctggtcgttcgttcgcctcgttctctccgcctccccccaccccccgcctcgcttcctcctccgcgcttccttcgccgaggcgtcagcgtcagcgagggcgtataaagcgctccccctccgcgcgcgtccgcacaatcgccaccgcctctccgctcctcgacaagaccaatggcggctgctgcgtcctccgctctgcacgccgttggcgccgtcgcctccgccaagcctagatccgtcgcccccggtacttgtactccccccccgaaagctaatctgcttaccctgtcgcctccgccgcgccgcgccaaccggcgggtgactgccctgaccgatctgcgtcgctcgtgcagcggtggcgacgaggaggagcgtgcgcgtggcgcccgcggccaagcgaggaccaggctcgggaggaggcaggctcgtggctcgcagcgccgttgcagccaaggcggatgaagcggccgcggcggcgggatccaagtcaggcggccatgagttgctgatgtttgaggcccttcgtgaagccttgatagagagatgaatttggatccnacagtgtgcgtcatgggtgaagatgttggtcan

SEQ ID NO: 56429 - protein, 96 aa, Zea mays
  misc_feature: Ceres CLONE 1496048
MAAAASSALHAVGAVASAKPRSVAPGTCTPPPKANLLTLSPPPRRANRRVTALTDLRRSCSGGDEEERARGARGQARTRLGRRQARGSQRRCSQGG

SEQ ID NO: 56430 - DNA, 667 bp, Zea mays
  misc_feature: Ceres CLONE 1496055
  misc_feature: Encodes the peptide sequence at SEQ ID NO. 56431
cgattgggtaccgggccccccctcgagccactgcagtggtaaagggagacccattcagcccaccggctacacggcccatattccgtactcgtgaacctcgtgctgacgtgctcacacagtcactccgtttagctcaaatccttatcggcgactcggcgtcggaggctcggagcccacgaccacgaccgcttccacgccctcgaccccgaacccccaatcccggacgcgaccgctgaaccctagcatactccggccatctgccgccggccccggcgatcccccgccatggcctcccccgagggcacaacgtgggtcttcgactgtccccttatggacgacctcgcggtcgccgccgacttcgcggcagcccccgcgggaggatttttctgggcagcgccgccgtcgctgcagccgcaggcgccagtgcagtctgtcgttgccgcgtcggctcccaacccatgtatggaaatcagtagctctgtggactgtggtcaggaaaaagaacagccaacaaataaacgtccaaggtcagaaagtactacagaatcaagcacaaaagcatccagggagaaaattagaagggacaagctgaacgagagattcttggaattgggtgccattttggagccagggaaaactcctaaaatggacaaaacagctatattga

SEQ ID NO: 56431 - protein, 127 aa, Zea mays
  misc_feature: Ceres CLONE 1496055
MASPEGTTWVFDCPLMDDLAVAADFAAAPAGGFFWAAPPSLQPQAPVQSVVAASAPNPCMEISSSVDCGQEKEQPTNKRPRSESTTESSTKASREKIRRDKLNERFLELGAILEPGKTPKMDKTAIL

SEQ ID NO: 56432 - DNA, 691 bp, Zea mays
  misc_feature: Ceres CLONE 1496058
  misc_feature (1)..(1): n is a, c, t, g, unknown, or other
  misc_feature (691)..(691): n is a, c, t, g, unknown, or other
ncgattgggtaccgggccccccctcgaggtctagccgtatctataagctttcttgtcgccgatgcccgcggtccccatcgtcaacgtgcccagtgccttttgcggctccgccttcggcggcgtacactctcgcggcgcgctcttgcatgattgcattcgtcgtgcccaccatgcacagcgggtggtggtgaccggtgtacgtgagagtgatgcctttgtttgtcaatacttttgcacctgtgtgtctcgtgctttcatgttgagtgtaacattttaccgttgtacgtatctcctttgcatttgtaccacattcatttatgctgtatatgtctggtctacacccttctcctttttaaaaaaagacagtaaaccagagctctgggaattcctgccgcctgggggatccactagttctagagaggccgccccgcggtggagctccagcttttgtcccatttagtgagggttaatttcgagcttggcgtaataatggtcatagctcgttcctgtgcgaaatttgtttcccgcttccaatttcccccctccttccgaacccggaaaccaaaaagcggtaacggccttgcgggtcccctaaatgaatggacccttacctccaccattaattggccgttcgcccctccactggccccacttttcccagcccggggaaaaccttgatacctgcccaaan

SEQ ID NO: 56433 - DNA, 645 bp, Zea mays
  misc_feature: Ceres CLONE 1496061
  misc_feature: Encodes the peptide sequence at SEQ ID NO. 56434
  misc_feature (575)..(575): n is a, c, t, g, unknown, or other
  misc_feature (620)..(620): n is a, c, t, g, unknown, or other
  misc_feature (621)..(621): n is a, c, t, g, unknown, or other
cgattgggtacgggccccccctcgagccctgcagtggtaaaggctggggcccacacgaaaaatagcccgcaagatcttgcacatcttccccttttgcccggcagcactcgtcctagtgtactatcatctcgtcgctcggctcccgaccgcatcgcgatcagtcatctcctgcgtctcgttctcgccggagatcagacgcgccaccgccgggcgatggatgcctcctaccgccgcgccggtgccggaagcggttctgctccccgctccgtcgaggacatctacaaggactaccgcgcccgccgctccgccgtcctccgcgccctcacccacgacgtcgaggagttctacgcgctgtgcgatccagagaaggagaacctgtgcctatacgggtacgcaaacgaagcgtgggaggtggcgctgccggcggaggaggtgcccacggagctgccggagcctgcgctcgggatcaacttcgcgcgcgacgggatgaaccgtcgcgactggctcgcgctcgtcgccgtccactccgactcgtggctcatatccgtcgcattctactacgccgcgcggctcanccgaagtgatcggaagcgtttgtttggcatgatgaatgacctgcnncactgttttgaagtcgtctccggt

SEQ ID NO: 56434 - protein, 144 aa, Zea mays
  misc_feature: Ceres CLONE 1496061
  misc_feature (121)..(121): Xaa is any aa, unknown, or other
  misc_feature (136)..(136): Xaa is any aa, unknown, or other
MDASYRRAGAGSGSAPRSVEDIYKDYRARRSAVLRALTHDVEEFYALCDPEKENLCLYGYANEAWEVALPAEEVPTELPEPALGINFARDGMNRRDWLALVAVHSDSWLISVAFYYAARLXRSDRKRLFGMMNDLXHCFEVVSG

SEQ ID NO: 56435 - DNA, 678 bp, Zea mays
  misc_feature: Ceres CLONE 1496063
  misc_feature: Encodes the peptide sequence at SEQ ID NO. 56436
cgattgggtaccgggccccccctcgagccctgttgtggtaaaggcggaagcacttcccgaataaaggaagacagagaaggaaacggcagtgaagtcgccggcgccgccgcgacaggaggaagtagggagtagcagcggcaggggaggtccggcgatctcggctgctgtggcgcggtaagggaggaagcggagccgcgacaggatgcactcgtttgggcaccgcgccaacgcggtggcaacgtttgcggtcaccatactggccgcgatgtgcttcgccgcctccttctccgacaattttaacaccctgacacccaccgcatccgtcaagatcttgaatataaactggttccagaaggaggccaacggcaatgacgaggtcagcatgacgctgaacatttcggctgacctttcatctcttttcacgtggaacacaaaacaggtatttgtttttgtggcagcagagtatgagactcgacaaaatgctttaaatcaagtttccctttgggatggcattatacctgcaaaggagcatgccaagtttttgatccatacaacaaataagtacagatttattgaccagggaaagcatctaaagggcaaggaattccacttgacaatgcactggcacattatggcaaagactggcaaaatgtttgcagataagatagtcatgaacgg

SEQ ID NO: 56436 - protein, 158 aa, Zea mays
  misc_feature: Ceres CLONE 1496063
  misc_feature (1)..(156): Pfam Name: SPC22 Pfam Description: Signal peptidase subunit
MHSFGHRANAVATFAVTILAAMCFAASFSDNFNTLTPTASVKILNINWFQKEANGNDEVSMTLNISADLSSLFTWNTKQVFVFVAAEYETRQNALNQVSLWDGIIPAKEHAKFLIHTTNKYRFIDQGKHLKGKEFHLTMHWHIMAKTGKMFADKIVMN

SEQ ID NO: 56437 - DNA, 641 bp, Zea mays
  misc_feature: Ceres CLONE 1496066
  misc_feature: Encodes the peptide sequence at SEQ ID NO. 56438
cgattgggtacgggccccccctcgagccactgcagtggtaaagggcacttggcagctgataggcaggcgataccgtaccgagagagttgaagctgagaaagaatggcggggctctacgagaagcagtcggagacgtacgccaagaagcgtccgcagtaccccaaggagtggttctccatgctggccggcctcaccgcggggcaccagcgcgcctgggacgccgggtgtggcaccggccaggccgccatcagcgtaagtttttttttatcgaatggtcagcagctgcttcaccgtttgatctggttaattctgaaaggaacatgtggcgaaaacaactcagatggcggagcactacgagagcgtggtggcccacggacgtgagcgaggggcagctccggcacgccaccgcgcacccgaaggtgcggtacctccacaccccggagcacctctcggaggacgagctggtgtcgctggtcggcggcgagggctccctggacctggtcgtggcggccacctccatccactggttcgacgtcccgctcttctacgccgtcgtgagccgcgccctgcggaagcccgggggcgtgctccccgtgtggggctacaactacgagatccccccgttcaaggacccgctgcac

SEQ ID NO: 56438 - protein, 107 aa, Zea mays
  misc_feature: Ceres CLONE 1496066
MWRKQLRWRSTTRAWWPTDVSEGQLRHATAHPKVRYLHTPEHLSEDELVSLVGGEGSLDLVVAATSIHWFDVPLFYAVVSRALRKPGGVLPVWGYNYEIPPFKDPLH

SEQ ID NO: 56439 - DNA, 640 bp, Zea mays
  misc_feature: Ceres CLONE 1496068
  misc_feature: Encodes the peptide sequence at SEQ ID NO. 56440
cgattgggtaccgggccccccctcgagccctgcagtggtaaagggcggtagtcctcgcaaacgtgcagcaatggaggtcggcggcggcgagaagcactttgtgctggtgcacggcctctgcctcggcgcgtggagctggtacaaggttgccacggcgctggacctggcggcgtcgggcgcgcacccggcgcgcctgcacgaggtgcgctcgttcgaggagtactcgcgcccgctgctggacgcggtcgccgcggcgcccgacggcgacaggctggtccttgtcggccacagccatggtggcgccagcctcgcgctcgccatggagaagttcccgcgcaaggtcgccgccgccgtgttcgtggacgccgcgatgccgtgggtcggcaagcacatcggcgtcaccaccgaggggttcatgaagaaagctgcttccaaagggctgctcatggactgccaaatcgtgcctatcactggcagtgaagaaggcgccgggcagcgagggacagcgatcgtgatgggtccagagttcttgaagaatgctacaaggagagccccgcggaggacctgaccctggcgacgctgctggtgaggcccggcaaccagttcatggacgacccggtgatgaaggacgaagcgctgc

SEQ ID NO: 56440 - protein, 165 aa, Zea mays
  misc_feature: Ceres CLONE 1496068
  misc_feature: SWISSPROT Homolog: EC 3.1.1.78 Polyneuridine-aldehyde esterase
MEVGGGEKHFVLVHGLCLGAWSWYKVATALDLAASGAHPARLHEVRSFEEYSRPLLDAVAAAPDGDRLVLVGHSHGGASLALAMEKFPRKVAAAVFVDAAMPWVGKHIGVTTEGFMKKAASKGLLMDCQIVPITGSEEGAGQRGTAIVMGPEFLKNATRRAPRRT

SEQ ID NO: 56441 - DNA, 661 bp, Zea mays
  misc_feature: Ceres CLONE 1496077
  misc_feature: Encodes the peptide sequence at SEQ ID NO. 56442
  misc_feature (492)..(492): n is a, c, t, g, unknown, or other
  misc_feature (638)..(638): n is a, c, t, g, unknown, or other
ccgaatgggtaccgggccccccctcgaggcctaccgtagctataagataatgctcctcatctggtcgtgaagcgcggcgagccgacgctggtgccgccggcggaggcgacgccgacgggcgggcagaactacctgtccaacctggaccagaacatcgcggtgatcgtgcagacggtgtactgctacaagccttcctcgcccggcggcggcgaaggcaaggaggacgtggacgtggcaggcgcgctccgcgacgcgctggcgcgcgtgctggtgcactaccacccgctggcggggcggctgggcgtcagcccggagatgaagctcaccgtggagctgaccggcgagggcgccgtgttcgtggaggccgacgccgcctgcgacctcgacgccgtcggcgacctcaccaagcccgaccccgccgcgctcggccagctcgtctactccgtccccggcgctaagcacatcctcgagatgccccccatgaccgcgcangtgacgaggttcaagtgtgggggcttcgcgctcggcctggccatgaaccactgcatgttcgacggcatcggcgccatggagttcgtcaactcgtgggcggagacggcgcgcggcgtccccgagctcaccgtgcccgcgttcctggnacgaagcgtcctgaaggcgcgcg

SEQ ID NO: 56442 - protein, 115 aa, Zea mays
  misc_feature: Ceres CLONE 1496077
  misc_feature: SWISSPROT Homolog: EC 2.3.1.162 Taxadien-5-alpha-ol O-acetyltransferase
  misc_feature (59)..(59): Xaa is any aa, unknown, or other
  misc_feature (108)..(108): Xaa is any aa, unknown, or other
MKLTVELTGEGAVFVEADAACDLDAVGDLTKPDPAALGQLVYSVPGAKHILEMPPMTAXVTRFKCGGFALGLAMNHCMFDGIGAMEFVNSWAETARGVPELTVPAFLXRSVLKAR

SEQ ID NO: 56443 - DNA, 739 bp, Zea mays
  misc_feature: Ceres CLONE 1496081
  misc_feature: Encodes the peptide sequence at SEQ ID NO. 56444
cgattgggtaccgggccccccctcgagccctgcagtggtaaaggaagggacccccattcgcatccgcctccttttccttggagccgaagaagagggaaaggaagggaggacagccgccgccgccgccatcaccaccgtcaggatgcattccacgaacctcctgctcgaggagcccatccggatggcctccatcctcgagccctccaagcccagctacttcccggcgatgaccaagatcgtcggcactctcggcccccagtcgcgctccgtcgacacgatctccgcctgcctcaagcccggcatgtccgtcgccccggttcaatttctcgtgggggggacgccgcgtaccacccaggagacgctggagaaacctccagctctccatcaagtcccccaaagaacctctgcccctgtcatgcttcaacaccggggggccccggaaactgcagggtggtaaaaaaaaagcgaaaaccccaattctccctcaaggaaaaatggcacgggtcctttctccacccctccacccggggcccaaaaaccccctccttccaggtttgggtgccccatccacttttctctggggactccccccaaggggggggggcaacccccgggggcaaacaaaaatttttccgtggggcaacaaatatttttttgttcacctgggaaaggtgaaaaacacacctcccctttttgtggttgggaacaggtttttctaaaacacaacaaaaaaggagat

SEQ ID NO: 56444 - protein, 104 aa, Zea mays
  misc_feature: Ceres CLONE 1496081
  misc_feature: SWISSPROT Homolog: EC 2.7.1.40 Pyruvate kinase
MHSTNLLLEEPIRMASILEPSKPSYFPAMTKIVGTLGPQSRSVDTISACLKPGMSVAPVQFLVGGTPRTTQETLEKPPALHQVPQRTSAPVMLQHRGAPETAGW

SEQ ID NO: 56445 - DNA, 657 bp, Zea mays
  misc_feature: Ceres CLONE 1496082
  misc_feature (381)..(381): n is a, c, t, g, unknown, or other
  misc_feature (382)..(382): n is a, c, t, g, unknown, or other
cgattgggtccgggccccccctcgagccctgcagtggtaaaggagagcaccctccacttggtgctgcgcctcaggggaggcatgcagatcttcgtgaagaccctgactggcaagactatcaccctcgaggtggagtcttcagacaccatcgacaacgtcaaggccaaagatccagacaaggagggcatcccaccggaccagcagcgtttgatcttcgctggcaagcagctggaggatggccgcacccttgcggattacacatccagagggagagcaccctccacctggtgctccgtctcaggggtggcatgcagatctttgtgaagacactcactggcaagaccatcacccttgaggtggagtcttcggataccattgacnnatgtcaggccaagatccaggacaaggagggcatcccaccggaccagcagcgcctcatcttcgccggcaagcagctggaggatggccgcacctttggcgaactacacatccagaaggagagcccccctccactgttgcctccgcctcaggggtggcatgcaaaatttttgtgaaaaacttggactgggcaagaaccttcccccttggaagggtggaaaaacttcttaaaccccctttttacaaatgtgaagggccaaaaccccgggaaaggggggg

SEQ ID NO: 56446 - DNA, 670 bp, Zea mays
  misc_feature: Ceres CLONE 1496084
  misc_feature: Encodes the peptide sequence at SEQ ID NO. 56447
  misc_feature (453)..(453): n is a, c, t, g, unknown, or other
  misc_feature (482)..(482): n is a, c, t, g, unknown, or other
  misc_feature (554)..(554): n is a, c, t, g, unknown, or other
  misc_feature (574)..(574): n is a, c, t, g, unknown, or other
  misc_feature (575)..(575): n is a, c, t, g, unknown, or other
cgattgggtaccgggccccccctcgagccactgcagtggtaaagggagcacaactccacgtcacacacctcacagagctgcaacagcatcagctgccacctccttccttccttcctgcataggttgctacacgtatatattctgaagaagagatcgagatgaccagcgtgtggaagaccaaggttctgcctggcctcaacaagatctttgacaaggatggcaagaaggctgcagctgcaggcttcttgaagtccttcaacaaggaggagattgacaaggagattgaggacaagaagacagagctggagcccaaggtcgtggaggcctacgaagcatctcctcctgaggtcaaggctctgttcaaggataagaagccagtcaaggtcagcaagaagaactcggctgcagtcaccaagttcctcgatgagctggctaagattgacttccctgganccaaggtggtgagcgaggcggtggccaantccggcacctcgcccctgcttccggcgatcaccttcatcttggacaaggtcgcaccgtttatccccaaggangagcccaaggcggagccggnncgcgaggccaccctccgggaagtcgccgtggaagagaagaaggaggaggccgagccagctgcagcgacggaggcggcaccgcgcccgcagagaca

SEQ ID NO: 56447 - protein, 170 aa, Zea mays
  misc_feature: Ceres CLONE 1496084
  misc_feature (2)..(170): Pfam Name: DREPP Pfam Description: DREPP plasma membrane polypeptide
  misc_feature (99)..(99): Xaa is any aa, unknown, or other
  misc_feature (108)..(108): Xaa is any aa, unknown, or other
  misc_feature (132)..(132): Xaa is any aa, unknown, or other
  misc_feature (139)..(139): Xaa is any aa, unknown, or other
MTSVWKTKVLPGLNKIFDKDGKKAAAAGFLKSFNKEEIDKEIEDKKTELEPKVVEAYEASPPEVKALFKDKKPVKVSKKNSAAVTKFLDELAKIDFPGXKVVSEAVAXSGTSPLLPAITFILDKVAPFIPKXEPKAEPXREATLREVAVEEKKEEAEPAAATEAAPRPQR

SEQ ID NO: 56448 - DNA, 695 bp, Zea mays
  misc_feature: Ceres CLONE 1496085
  misc_feature: Encodes the peptide sequence at SEQ ID NO. 56449
  misc_feature (203)..(203): n is a, c, t, g, unknown, or other
  misc_feature (207)..(207): n is a, c, t, g, unknown, or other
  misc_feature (267)..(267): n is a, c, t, g, unknown, or other
acgattgggtaccgggccccccctcgagccctgcagtggtaaaggcgggcgtcgagacggagacgtcggcggcgtccgacggcgacggcggctctcctcgtcgtcgtgagcagtccaagtacgtgctgaagaccagcctcgacctgcggcggtacgactactacaccgtcggcacgtacgaccgggcggccgagcggtacgtngccngacgaccccgcggggagacgagcgccacctgccggtacgactaccggcaacttttctacncgtcccaaaacttttcttccacccccttgaagcggccggcgggtgcttcctgggctgggccaaactaattcccaccccccccccccaacaacctggcccaagggggtgggctgggacccccccccccttcccggggggggggggtgggtaaaaccccaaggggaaaaaaaatttttttgcacttggcccatctcagggaaggggggaagccttctagagggggggggcccccccccttcccccaaacaaaggggtggatttaaccccaaaacctcgacctggtgggggttcccccggttataaaaaccgcgcacaggccgcacgtggggaagggagattttttataggtgttcacccctgcggcaccccccccgagcctcttttttgaacccgtggctctgccacaacacacggaggagggcggcggg

SEQ ID NO: 56449 - protein, 110 aa, Zea mays
  misc_feature: Ceres CLONE 1496085
  misc_feature: SWISSPROT Homolog: EC 3.2.1.26 Beta-fructofuranosidase
  misc_feature (69)..(69): Xaa is any aa, unknown, or other
  misc_feature (89)..(89): Xaa is any aa, unknown, or other
DWVPGPPSSPAVVKAGVETETSAASDGDGGSPRRREQSKYVLKTSLDLRRYDYYTVGTYDRAAERYVAXRPRGETSATCRYDYRQLFYXSQNFSSTPLKRPAGASWAGPN

SEQ ID NO: 56450 - DNA, 677 bp, Zea mays
  misc_feature: Ceres CLONE 1496089
  misc_feature: Encodes the peptide sequence at SEQ ID NO. 56451
  misc_feature (383)..(383): n is a, c, t, g, unknown, or other
  misc_feature (422)..(422): n is a, c, t, g, unknown, or other
  misc_feature (618)..(618): n is a, c, t, g, unknown, or other
cgattgggtaccgggccccccctcgagccctgcagtggtaaagggtaggcggcggcggccatggacttcgtgctccaggtcctgctgcgagtggtgatgagaagaagcatccgcaggctgcaagaggtcgttgacatcgccgtggacatcggcacggctgtcttcgtggccgtgcgggtctccggcctcgtcttccgccgccggctgcccacgccgactacgacatcgtcgtcgtcgacgacgtactactactccccggggacgtcctcctcgatcggcatgcatgtccaggaggattaattattggcaggcactagatgagctagctagctagctagggccagaagatgtatacttctcgcgggggggcatgtaagtaccanggtcatatatctgtgcgttctttttttgtggatcaaacntatttcgctagctaccctatatatatgtggtgtgctattgctctagctatatctatacatgtgtaattttgaggatttgaggcccgcaatccaaacaaaaactttttgagccaaaaaaaaaaaaaaaaccagagctctgggaatttcctgcagcccggggggatcactagttctagagcggccgccaccggcgggnagctccggcttttgttccctttagtgagggttatttccgagctttgcgtaatcatggcc

SEQ ID NO: 56451 - protein, 79 aa, Zea mays
  misc_feature: Ceres CLONE 1496089
MDFVLQVLLRVVMRRSIRRLQEVVDIAVDIGTAVFVAVRVSGLVFRRRLPTPTTTSSSSTTYYYSPGTSSSIGMHVQED

SEQ ID NO: 56452 - DNA, 702 bp, Zea mays
  misc_feature: Ceres CLONE 1496090
  misc_feature: Encodes the peptide sequence at SEQ ID NO. 56453
  misc_feature (274)..(274): n is a, c, t, g, unknown, or other
  misc_feature (336)..(336): n is a, c, t, g, unknown, or other
  misc_feature (369)..(369): n is a, c, t, g, unknown, or other
cgattgggtaccgggccccccctcgagccctgcagtggtaaaggaggcccaccgctagcatccgcagttcccccgcgcccgagacgcaaccccgcgccaggagtaagtttgttcttttatcgatatggcgagggaggagaatgtctacatggccaagctggctgagcaggccgaaaggtatgaagagatggttgagtatatggagaaggtggctaagactgtagatgtggaagagctcactgttgaggagcgtaacctcttgtcggtcgcatancagaatgtgattggggctcgccgtgcttcatggcgcattgtctcttctattgacaagaggangagtcccgtaagaacgaagagcatgtgaccttnatcaaggataccggtgcgagatccgagctgacctgaacatttctgggatgcatcctgaaactgctggaccccacctagggcttcttccaggggccgaaaccaaggcttccacctcaaaagaaggggcacttcccggttttttgggaaatttaaaacggccccaaagaaaaaaatctttttaaaaccaaaaaggggcccaaaaggtctcccaaaaatttgcgggtgggaacgggccccccccccaaaaaagagggggggggggccttcataccccccgggtttttttagagaaaaccccccccccccaaaatttttttctttccttaaaagggt

SEQ ID NO: 56453 - protein, 79 aa, Zea mays
  misc_feature: Ceres CLONE 1496090
  misc_feature (50)..(50): Xaa is any aa, unknown, or other
  misc_feature (71)..(71): Xaa is any aa, unknown, or other
MAREENVYMAKLAEQAERYEEMVEYMEKVAKTVDVEELTVEERNLLSVAXQNVIGARRASWRIVSSIDKRXSPVRTKSM

SEQ ID NO: 56454 - DNA, 704 bp, Zea mays
  misc_feature: Ceres CLONE 1496091
  misc_feature: Encodes the peptide sequence at SEQ ID NO. 56455
  misc_feature (309)..(309): n is a, c, t, g, unknown, or other
  misc_feature (375)..(375): n is a, c, t, g, unknown, or other
  misc_feature (399)..(399): n is a, c, t, g, unknown, or other
  misc_feature (631)..(631): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (642)..(642): n is a, c, t, g, unknown, or other
  misc_feature (644)..(644): n is a, c, t, g, unknown, or other
cgattgggtaccgggccccccctcgagccactgcagtggtaaaggtctccgccctagcgccactgagccactcaacgtcgagatcgagacgacccgagtccgccgcgcccgtgcaccaccgaccgtcgaactcccgaaagtaactctatttcttgatcaacatcaacatgtcgcgggaggataatgtttacatggccaagctggctgagcaagcagaacgatacgaggaaatggttgagtacatggagaaggtggctaagactgtagatgtggaagagctcaccgttgaggagcggaacctcttatctngtgcctacaagaacgtaattggggccccgcgtgcctcatggcgcattatctcctccatcgagcatnaaggaggagtcccgttagaatgangaaacatgtattcagatcaaggagtacggtgccagaattgagctgaattgaccacattttgggatggatcctgaaagttgatcaactctcacctggggctttctcccctgctgaaaatccaaagggtttttacctccaaaagaaggggaattttccccggccccctggctaaatttaaaaactgggccaaaaaaaaaaaaacttcccaaaaataacattatttctttattangnnnnagaacncnacaagaaattttgtttggggaaaaggggcctcccccccccccaaaaaatttggagtttcg

SEQ ID NO: 56455 - protein, 76 aa, Zea mays
  misc_feature: Ceres CLONE 1496091
  misc_feature (48)..(48): Xaa is any aa, unknown, or other
  misc_feature (70)..(70): Xaa is any aa, unknown, or other
MSREDNVYMAKLAEQAERYEEMVEYMEKVAKTVDVEELTVEERNLLSXAYKNVIGAPRASWRIISSIEHXGGVPLE

SEQ ID NO: 56456 - DNA, 668 bp, Zea mays
  misc_feature: Ceres CLONE 1496099
  misc_feature: Encodes the peptide sequence at SEQ ID NO. 56457
  misc_feature (526)..(526): n is a, c, t, g, unknown, or other
  misc_feature (527)..(527): n is a, c, t, g, unknown, or other
  misc_feature (544)..(544): n is a, c, t, g, unknown, or other
  misc_feature (545)..(545): n is a, c, t, g, unknown, or other
  misc_feature (607)..(607): n is a, c, t, g, unknown, or other
cgattgggtccgggccccccctcgagccctgcagtggtaaaggaggggcctttcgcggcgtcggacaacgcgggctgggtggagccggaccccgacgaccttctcttccccggccgcgaccgcgcggcgctctggtcgcactcgtcctccgacggggagaggcccgaggtcgaggtcgaggttgaggccgccgatcaggtggaacgggccggggtcacggcggcggctgacgcgggcgagggggccgtggcgaagggaggagggccggcccagtggtggaggctgccgctggacgtgctgcgggtgtgggcgctgcgtgcggccaggagcgtctggtcggtgccgctcgccgtcgcgctgctcgggttcgccgtgctcgggcgccggctgtaccggatgcgccgccagagcaaggccgtcgcgcgcgtccgcctcgtcctcgacgagaagaaggtctcccaattcaagggccaaggatcacgtctgaatgaatccatgacggtggcgcggcgaactcctatcatannacctatgcttcctgccnnacgagtgactccatggcctgtgctgggacacctgtgagatgacgtgatcgagctagtagtancagtacaactgccccagcccacgttgcccacagcgggcatattatgcgatgcccagcagcc

SEQ ID NO: 56457 - protein, 193 aa, Zea mays
  misc_feature: Ceres CLONE 1496099
  misc_feature (176)..(176): Xaa is any aa, unknown, or other
  misc_feature (182)..(182): Xaa is any aa, unknown, or other
RLGPGPPSSPAVVKEGPFAASDNAGWVEPDPDDLLFPGRDRAALWSHSSSDGERPEVEVEVEAADQVERAGVTAAADAGEGAVAKGGGPAQWWRLPLDVLRVWALRAARSVWSVPLAVALLGFAVLGRRLYRMRRQSKAVARVRLVLDEKKVSQFKGQGSRLNESMTVARRTPIIXPMLPAXRVTPWPVLGHL

SEQ ID NO: 56458 - DNA, 647 bp, Zea mays
  misc_feature: Ceres CLONE 1496105
  misc_feature: Encodes the peptide sequence at SEQ ID NO. 56459
  misc_feature (373)..(373): n is a, c, t, g, unknown, or other
  misc_feature (413)..(413): n is a, c, t, g, unknown, or other
  misc_feature (439)..(439): n is a, c, t, g, unknown, or other
  misc_feature (466)..(466): n is a, c, t, g, unknown, or other
  misc_feature (498)..(498): n is a, c, t, g, unknown, or other
  misc_feature (506)..(506): n is a, c, t, g, unknown, or other
  misc_feature (509)..(509): n is a, c, t, g, unknown, or other
  misc_feature (510)..(510): n is a, c, t, g, unknown, or other
  misc_feature (515)..(515): n is a, c, t, g, unknown, or other
cgattgggtaccgggccccccctcgagccctgcagtggtaaagggtggagtacggcagcgagggcggcaaggactactggatcgtgaagaactcgtggggcacccagtggggcgaggccgggtacgtccggatggcgcgcaacgtcagggtgagggccggcaagtgcggcatcgccatggagccgctgtacccggtgaaggagggcccgaacccgccgccgggcccgacgccgccgtcgcccgtgaagcctcccaacgtgtgcaacgcggagtactcgtgcccggaggccaccacctgctgctgcgtctccgagtaccgcggcaaatgcctcgcctacggctgctgcgagctggagaacgccacctgctgtgnagaccactcgtcctgctgcccgcacgactaccccgtctgncacatccgggacgggacctgccgtangagcgcaacagcccgatgatggtgaangctctgcagcgcaagccggcgatgtatactgncggcggcngcnngcgcnaacaaagcggggagagcagctgggtgagagattgagactgtggtggtgcgtggcgtgtactgttcatcgttcaaacagatgacttgctggccatgctgtgggctcaagaactgctttctcccagtggcgatg

SEQ ID NO: 56459 - protein, 108 aa, Zea mays
  misc_feature: Ceres CLONE 1496105
  misc_feature (81)..(81): Xaa is any aa, unknown, or other
  misc_feature (94)..(94): Xaa is any aa, unknown, or other
  misc_feature (103)..(103): Xaa is any aa, unknown, or other
MARNVRVRAGKCGIAMEPLYPVKEGPNPPPGPTPPSPVKPPNVCNAEYSCPEATTCCCVSEYRGKCLAYGCCELENATCCXDHSSCCPHDYPVXHIRDGTCRXSATAR

SEQ ID NO: 56460 - DNA, 654 bp, Zea mays
  misc_feature: Ceres CLONE 1496109
  misc_feature: Translation starting site: 120
  misc_feature: SWISSPROT Homolog: EC 3.4.25.1 Proteasome endopeptidase complex
  misc_feature (402)..(402): n is a, c, t, g, unknown, or other
  misc_feature (453)..(453): n is a, c, t, g, unknown, or other
  misc_feature (478)..(478): n is a, c, t, g, unknown, or other
  misc_feature (554)..(554): n is a, c, t, g, unknown, or other
  misc_feature (582)..(582): n is a, c, t, g, unknown, or other
  misc_feature (633)..(633): n is a, c, t, g, unknown, or other
ccgattgggtaccgggccccccctcgagccactgcagtggtaaaggggcaggaagaaatcgagcctcactcgatccatcgtctcgccgcagcgcacacgaggccggcggcgccatgaccatgaagctggacatgtctgcgctcgagaccaacttcgccaacctgaccgcctccgccggcgacgacacgtacttctccgccgaggcccccgacgtgccgtccatggtgctccccatctgcgacgacttcgacggcttccaggcggccaccaaggatatggtgaagaataagaaggggacgaccacgcttgccttcatcttcgacaagggcgtcatcgtcgccgctgattccagggccagcatgggcggttatatatcctcacaaaccgtgaggaaattattgnaataaatccttacatgctggggacaatggctgggagtgctgctgattgccnattttggcataggaacctaggaccnaagtgtcgtctccatgagctttcaacaagcgaaggatctctattgctggtgcttccaaactggtgggctacatccntttatcatatcgtgggatgggactgtcnattggtacatgatcgctggatggggatgagaaggtcctggcttgtactatngtgacagtgagggtccgcggg

SEQ ID NO: 56461 - DNA, 661 bp, Zea mays
  misc_feature: Ceres CLONE 1496114
  misc_feature: Encodes the peptide sequence at SEQ ID NO. 56462
  misc_feature (432)..(432): n is a, c, t, g, unknown, or other
  misc_feature (524)..(524): n is a, c, t, g, unknown, or other
cgattgggtaccgggccccccctcgagccactgcagtggtaaaggaattttgcttacgaggctgggcttcaggagaagttccctccagttcctcttctgaagtcctacctggaggactctaagaagacgtcgaccgccgcttcagataattcaagcactagcagcagtgggcaatcagggagcaacgcgaacaagaaagagcagtctgcactgcgagctgtcatcaagtgtgtcgaggaccgtaatcttgaagccgagtttccactggaggatctccggaagcaactcgaagagctggagaaagccaagaccgagaagaagaaggcggcatcaagcgctaccagcggcggcagcagcagcggccctgcaaccaagcgcatccgcgcgagcaacggaggcccaatgcctcctgccaaggcaggtcgtctcgcntacaatgcctgcgcgtcttctttcccagtcccgccacattcaccagtctccctcccacgcacacacgccaatacctcctccccttccacgcnacacacgccgccacagcctccccttccacacatcctatgccacgccgccttcttacccggttggacatggcctgtactgcagccggagcccgccggtgatcaagggggaaccatacgcttacccacagccgaggagg

SEQ ID NO: 56462 - protein, 86 aa, Zea mays
  misc_feature: Ceres CLONE 1496114
  misc_feature (41)..(41): Xaa is any aa, unknown, or other
MPPAKAGRLAYNACASSFPVPPHSPVSLPRTHANTSSPSTXHTPPQPPLPHILCHAAFLPGWTWPVLQPEPAGDQGGTIRLPTAEE

SEQ ID NO: 56463 - DNA, 647 bp, Zea mays
  misc_feature: Ceres CLONE 1496115
  misc_feature: Encodes the peptide sequence at SEQ ID NO. 56464
  misc_feature (647)..(647): n is a, c, t, g, unknown, or other
cgattgggtaccgggccccccctcgagccctgctttggtaaaggcatcagcggccagataagctatagccatcttctctgaattccagcccaagggccggaataccgtcagagggagtgtgggaggggaaaaaaaaagatggtgaagctcgcatttggaagctttcgcgactctttgagcgccgcgtcgctcaaggcctatgtggccgagttcatcgccacgttgctcttcgtgttcgccggcgtcgggtccgccattgcctactcgcaattgacgaagggcggcgctctggaccccgccggcctggtggccatcgccatcgcccatgcgttcgcgctcttcgtcggcgtctccatggccgccaacatctccggcggccacctgaaccccgccgtcaccttcggcctcgccgtcggcggccacatcaccatcctcaccggcatcctctactgggttgcccagcttctcggcgcttccgtggcgtgctttctcctgcagtacgtcacacacggacaggctatcccgacgcacggcgtctccgggatcagcgagatcgagggcgtggtgatggagatcgtgatcaccttcgcgctggtgtacaccgtgtacgccacccgcgcccgaccgaagaaggggtccctgggcan

SEQ ID NO: 56464 - protein, 169 aa, Zea mays
  misc_feature: Ceres CLONE 1496115
  misc_feature (11)..(168): Pfam Name: MIP Pfam Description: Major intrinsic protein
MVKLAFGSFRDSLSAASLKAYVAEFIATLLFVFAGVGSAIAYSQLTKGGALDPAGLVAIAIAHAFALFVGVSMAANISGGHLNPAVTFGLAVGGHITILTGILYWVAQLLGASVACFLLQYVTHGQAIPTHGVSGISEIEGVVMEIVITFALVYTVYATRARPKKGSLG

SEQ ID NO: 56465 - DNA, 763 bp, Zea mays
  misc_feature: Ceres CLONE 1496117
  misc_feature (10)..(10): n is a, c, t, g, unknown, or other
  misc_feature (35)..(35): n is a, c, t, g, unknown, or other
  misc_feature (38)..(38): n is a, c, t, g, unknown, or other
  misc_feature (41)..(41): n is a, c, t, g, unknown, or other
  misc_feature (42)..(42): n is a, c, t, g, unknown, or other
  misc_feature (48)..(48): n is a, c, t, g, unknown, or other
  misc_feature (49)..(49): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
cccctccttnttttgtttgccccttattacgcttnaanaanntttttnntnnnntcccaattgggtacgggccccccctcgagccctgcagtggtaaaggggagacaagcagcaacatcactgatcgccgtgcagcctggtacgtaccacacacacacacacatacagaagaagaagacgtaccttgcgctacaaccccgtcgccgccgactacgccgatcgtgtccacgggaaccaagcaaagcaaagcaagcgacgcatcggaagaagccggagaccgaccgaccgaccgaccgagctagctacagctcatcagcccatggtgaagacggcgacggccacggcgacggcggcggcgaggcacggcggcgctaataagaggacgtacaaaggcgtgcggatgcggagctgggggctcctgggtgtcggaggtgcggggtcccgggccaaaaaaagagaatttgggttgggttcccccccgctcgccaaagcccccgggcgggcctaaaaacgccgcccttgctcttccttaggggcttgggccgccccggccgaaccttaaatttcccgccccgcccgcccgggttggcccagggggccttcatccggttgccccccccgcccgccatgtgctcctctaagggcctttccaaggccccggtgggcccccgggcctgccagccgcccctccctcccggcccggggttggcccttcctccaataaaacaacccggccattttgacccagatcccctgtggtcgc

SEQ ID NO: 56466 - DNA, 668 bp, Zea mays
  misc_feature: Ceres CLONE 1496119
  misc_feature: Encodes the peptide sequence at SEQ ID NO. 56467
  misc_feature (668)..(668): n is a, c, t, g, unknown, or other
cgattgggtaccgggccccccctcgagccactgcagtggtaaaggctgctcagctcgaacgaacaaaaagaactcccctcggccctctcctcttgtgcttctgcttcgccaccgagtctcctcgaccccaggcactcgccctctgtcggtctgtcccctcccttcctcgcctccgatgccgccgccgccgccgcttctcgagccgcgcgactacctcggcgccggcgccacctcgtcgtgctgctcgtcatcctgctcctccggccgcgagggcgcggggccccacctcgcgctgcggctcgagcttccggggtccgactactcccccggccgcaacgcgtacgcggatcacgccggtgcccacgtcgacgccgggctcaccttcggccccgccaccgcccccgtgcctcctaggggcagcgccaagcgcgggttcgccgactccctcgacaggtccgcgaagcgagacggcattgtcgcgtatgacgctgctgagggcgtcacgcgggtagcatgagctgctgccggagctacgcctgctgacaaggcacaagatgttggatggcctgctgataggcactaccggaagaatacctagctgccgtgccacaaacacaaatggcggagatgaatgtacgaatgaggccggatcctgttatgtcaccgtn

SEQ ID NO: 56467 - protein, 113 aa, Zea mays
  misc_feature: Ceres CLONE 1496119
MPPPPPLLEPRDYLGAGATSSCCSSSCSSGREGAGPHLALRLELPGSDYSPGRNAYADHAGAHVDAGLTFGPATAPVPPRGSAKRGFADSLDRSAKRDGIVAYDAAEGVTRVA

SEQ ID NO: 56468 - DNA, 698 bp, Zea mays
  misc_feature: Ceres CLONE 1496120
  misc_feature: Encodes the peptide sequence at SEQ ID NO. 56469
  misc_feature (1)..(1): n is a, c, t, g, unknown, or other
  misc_feature (274)..(274): n is a, c, t, g, unknown, or other
  misc_feature (276)..(276): n is a, c, t, g, unknown, or other
  misc_feature (594)..(594): n is a, c, t, g, unknown, or other
ncgattgggtaccgggccccccctcgagccctgcagtggtaaagggggctggcgcgatggctgggcagaaccagcggctcaacgtcgtgccgacggtgacgatgctcggcgtcatgaaggcccggctcgtcggcgcgacccgcggccacgcgctgctgaagaagaagtccgacgcgctgacggtccagttccgcgcccatcctcagaagatcgtcgcccgcaaggagtcgatgggcgagacgatgcgcgcctcctccttctcccctcgcgaggncnagtacgtcgctggcgacggcgtccgccacgtcatcctccagtccgtccgcgcggcatccgtccgcgtccgctcccaccaggagaacgtggccgggggtcagctccccgagttcacccacttcgtcgaccccgccgcggcctccggggcccccctccacgcgtccccgagcctcacgggcctgggcccgcggcgggcagcaggtccgccgcctgccgctccgcgcacgtcaaggccattcgaggtgctcgtccgagttcccctcttctgcagaccttccttcctcacggcttcgaggagggccatcaagacccaccaanccggccgcggtcaacggggcttcgagaacgtccgtccaagccccaggattgaagaaccccccttccgcttacattcaggggggggagcctccgacgaagttcgg

SEQ ID NO: 56469 - protein, 214 aa, Zea mays
  misc_feature: Ceres CLONE 1496120
  misc_feature (15)..(197): Pfam Name: ATP-synt_D Pfam Description: ATP synthase subunit D
  misc_feature: SWISSPROT Homolog: EC 3.6.3.14 H(+)-transporting two-sector ATPase
  misc_feature (73)..(73): Xaa is any aa, unknown, or other
  misc_feature (74)..(74): Xaa is any aa, unknown, or other
  misc_feature (180)..(180): Xaa is any aa, unknown, or other
MAGQNQRLNVVPTVTMLGVMKARLVGATRGHALLKKKSDALTVQFRAHPQKIVARKESMGETMRASSFSPREXXYVAGDGVRHVILQSVRAASVRVRSHQENVAGGQLPEFTHFVDPAAASGAPLHASPSLTGLGPRRAAGPPPAAPRTSRPFEVLVRVPLFCRPSFLTASRRAIKTHQXGRGQRGFENVRPSPRIEEPPFRLHSGGGASDEVR

SEQ ID NO: 56470 - DNA, 736 bp, Zea mays
  misc_feature: Ceres CLONE 1496126
  misc_feature: Encodes the peptide sequence at SEQ ID NO. 56471
  misc_feature (414)..(414): n is a, c, t, g, unknown, or other
cgattgggtaccgggccccccctcgagccctgcagtggtaaagggcgccgcttgctttgtccgttgtcgcagagcgaggaagcacgcagagagtgagtaaaagaaagagagggatgccgatggagaggtcggtgtcgtgcgcggagaggggcagcacgttcggcggcggggcggcggtggacgtccggagctacagcgcctcctacgcgaggccccagccgcggccgccgacgtccagggtgcagcgcgccaggagcgtgagcgcgtggacgcgcccggcgccgccgcccgtgcagcggaccgggagcaccaagagcggcgccgccgcgggccggccccaccccgggggctcaacctgcgctcgtacagcgcctccctacgcgggcctcctacggcccccaccctttgtcggcnggcggccggtggtgggcggttggccgccggttacctttaaccgcttccgggcagcctcccccaaattgggccctcccgccaaccggcggcttccgtcaaaccttcaggggggttacaacgccctccctttcctccgcccttggacaaaaccccccccgtgggtgggtccctccggcccccaaaaaaaggttccccgggccgtttgatggaatcaacccccctaacctgtccgccggtaaaaaaacgccccctttgcccccttttacaaaaaacccctaccaacctttctaagggggaaaaggtcccctgggaaattcccgtg

SEQ ID NO: 56471 - protein, 168 aa, Zea mays
  misc_feature: Ceres CLONE 1496126
  misc_feature (101)..(101): Xaa is any aa, unknown, or other
MPMERSVSCAERGSTFGGGAAVDVRSYSASYARPQPRPPTSRVQRARSVSAWTRPAPPPVQRTGSTKSGAAAGRPHPGGSTCARTAPPYAGLLRPPPFVGXRPVVGGWPPVTFNRFRAASPKLGPPANRRLPSNLQGGYNALPFLRPWTKPPPWVGPSGPQKKVPRAV

SEQ ID NO: 56472 - DNA, 659 bp, Zea mays
  misc_feature: Ceres CLONE 1496128
  misc_feature: Encodes the peptide sequence at SEQ ID NO. 56473
  misc_feature (364)..(364): n is a, c, t, g, unknown, or other
  misc_feature (533)..(533): n is a, c, t, g, unknown, or other
cgattgggtccgggccccccctcgagccctgcagtggtaaaggcgttcgtttctcttctcgacggggacgaccgccagagccgccgccttacgtccagctgccacggtacttcatcgggccctttgccggtgcaggcggcgcagcacccaccgcaccaggattctgattgctcttcattaggctataaatggcaggaaggcaccgggcaccccgacaataccatgatgaacctcgaggataccgtgatggtccaccacctccacttccacgaccaagacctctctcaccgcgtcgcatggcagaagaactgtctaggcgccgtgctgagatccgtagaatccatgaagaacatcagcgtctggncgatgaaatttgtagtctcaagcaaaccatgccccgttttgcaagaagacctccgaatctcaggccaggcctgtccaaagctcccggcagaagaagagctcgagtcgagggagctgactcaaaggaacctgaagctgaaagctgagctgcttgcctttaaacccctcangcaagacgctctgcatctgcgatctgaagcaagtaaactgcattctctgaagcaagagtgggctgcaaaagttccaggcctatcaaaaaagcttgaacttcagaaatctgaaaaccaaaaaatgac

SEQ ID NO: 56473 - protein, 145 aa, Zea mays
  misc_feature: Ceres CLONE 1496128
  misc_feature (48)..(48): Xaa is any aa, unknown, or other
  misc_feature (104)..(104): Xaa is any aa, unknown, or other
MMNLEDTVMVHHLHFHDQDLSHRVAWQKNCLGAVLRSVESMKNISVWXMKFVVSSKPCPVLQEDLRISGQACPKLPAEEELESRELTQRNLKLKAELLAFKPLXQDALHLRSEASKLHSLKQEWAAKVPGLSKKLELQKSENQKM

SEQ ID NO: 56474 - DNA, 711 bp, Zea mays
  misc_feature: Ceres CLONE 1496130
tcgagccctgcagtggtaaaggtcgtggcggctgcggcggagcacggaggcgaaggaggaggagcagcagcagcaggcggcgccgagtagcggcatcccactcagtgcttgcaaccatggctaggggattgaagaacacttgaagaggctcaatgcgccccaagcattggatgctcgacaagcttggcggagcttttgctcccaagccatcttctggacctccacaagtccagggagtgccttcctctgatcctcatcatcaggaacaggctcaagtatgctctgaactaccgtgaggtcatttctatcctgatgcaacgccatgtacttgttgatggtaaggttaaggaccgacaaaacctaccctgctggggttcatggatgccatttccttccctaagacaatggaaaaactccggcctgctttatgacaccaaggggccgttttccgtcttcccccaattcagggatgaagaatcccaagttcacagctcctgccgggtgaaggccccgttcaccttttggcgaagaaggggcctcccccctatctgaaaccacttacgaaaggggccgaaaccctcccggtaaacccccaacctccgctttattaaggggccccagtgaccccccctccaaaaattccgctccttgggacaccccaaccaagacccctggggcaccttcccacccaaggtttttcaccacccccac

SEQ ID NO: 56475 - DNA, 883 bp, Zea mays
  misc_feature: Ceres CLONE 1497485-R
  misc_feature: Encodes the peptide sequence at SEQ ID NO. 56476
ttggtgaaagctggagctccccgcggtggcggccgctctagaactagtggatcccccgggctgcaggaattcccagagctctggttttttttttttttttttcaggacgtaaaattcttcataatatttttctcatgctccgtttatgtaatgcctcttctcttcattttcatttctcaggaagacgacaacatttacttactggacagagcagtgacaccgggcaggtccttgccctcgagcaactccaagctggctccgccgccggtggagacgtggctgagctggtcctcgaccttgtagttggcagcaacagtagcggtgtcaccaccaccgatgatgacagtcttgccggccttggtagccttgagcgccgcgtccatggtcttcttggtgccgttggcgaacttgtccatctcgaagacgccgggagggccgttccacaggatggtctcggccttgttgatggcggcctcgtagagcttgatcgactcctcaccgcagtcgagacccatccagccttcgggaatgccgtccttgtcggtggcggtagaggtgttggcggtggcgctgaaagcgtcggcggtaatgtagtcgcagggcaggacgagctcaacgttgttcttcttggccttctcgacgagaccggcgaccttggtagcgccgtccttgtcgaagagagagtcgccgatgctgacgttctcgagagtcttcttgaaagtgaaggccatgccgccgcagacaatgagcatgttgaccttgtcgaggaggttgtccatcagctggatcttgtcgctgacccttggcgcccccctaggatggcaagagaagggactcttggggcaactcaagggccctgggcggaataaatccaagcttccta

SEQ ID NO: 56476 - protein, 244 aa, Zea mays
  misc_feature: Ceres CLONE 1497485-R
MLRLCNASSLHFHFSGRRQHLLTGQSSDTGQVLALEQLQAGSAAGGDVAELVLDLVVGSNSSGVTTTDDDSLAGLGSLERRVHGLLGAVGELVHLEDAGRAVPQDGLGLVDGGLVELDRLLTAVETHPAFGNAVLVGGGRGVGGGAESVGGNVVAGQDELNVVLLGLLDETGDLGSAVLVEERVADADVLESLLESEGHAAADNEHVDLVEEVVHQLDLVADPWRPPRMAREGTLGATQGPWAE

SEQ ID NO: 56477 - DNA, 663 bp, Zea mays
  misc_feature: Ceres CLONE 1497485
  misc_feature: Encodes the peptide sequence at SEQ ID NO. 56478
tcgattgggtaccgggccccccctcgagccactgcagtggtaaagggtacgacattgtcatacatcatacagcaatcatgtctctctccaataagctctccatccaggacgtcgacctcaagggcaagagggtgctcatccgcgttgacttcaacgtgcccctcgataaggagaccaactccaagatcaccaacaaccagcgcatcgccggcgccgtgcccaccatcaagtacgccattgacaatggcgccaaagccgttgtcctgatgtcccacctcggccgcccggacggcaagcccaaccccaagtactccctcaagcccgtcgtcgccgagctcgagaagctccttggcggcaagaaggtcaccttcaccgacgactgcgttggcgaggccgccgagaagaccgtcaacgagaccaccgatggcggtgtcgtgctcctcgagaacctgcgcttccacgccgaggaggagggcagcagcaaggacgccgagggaaagaaggtcaaggctgacaaggctgatgtcgagaagttctgcaagggccttaccgctctcggcgacatcttcatcaacgacgccttcggcactgcccaccgcgcacacagctccatggtggggcgtcgatctcccccagaaagcctccggcttcctcatgaagaag

SEQ ID NO: 56478 - protein, 195 aa, Zea mays
  misc_feature: Ceres CLONE 1497485
  misc_feature (3)..(195): Pfam Name: PGK Pfam Description: Phosphoglycerate kinase
  misc_feature: SWISSPROT Homolog: EC 2.7.2.3 Phosphoglycerate kinase
MSLSNKLSIQDVDLKGKRVLIRVDFNVPLDKETNSKITNNQRIAGAVPTIKYAIDNGAKAVVLMSHLGRPDGKPNPKYSLKPVVAELEKLLGGKKVTFTDDCVGEAAEKTVNETTDGGVVLLENLRFHAEEEGSSKDAEGKKVKADKADVEKFCKGLTALGDIFINDAFGTAHRAHSSMVGRRSPPESLRLPHEE

SEQ ID NO: 56479 - DNA, 807 bp, Zea mays
  misc_feature: Ceres CLONE 1497485-R2
  misc_feature: SWISSPROT Homolog: EC 2.7.2.3 Phosphoglycerate kinase
attcttctaatatttttctcatgctccgtttatgtaatgcctcttctcttcattttcatttctcaggaagacgacaacatttacttactggacagagcagtgacaccgggcaggtccttgccctcgagcaactccaagctggctccgccgccggtggagacgtggctgagctggtcctcgaccttgtagttggcagcaacagtagcggtgtcaccaccaccgatgatgacagtcttgccggccttggtagccttgagcgccgcgtccatggtcttcttggtgccgttggcgaacttgtccatctcgaagacgccgggagggccgttccacaggatggtctcggccttgttgatggcggcctcgtagagcttgatcgactcctcaccgcagtcgagacccatccagccttcgggaatgccgtccttgtcggtggcggtagaggtgttggcggtggcgctgaaagcgtcggcggtaatgtagtcgcagggcaggacgagctcaacgttgttcttcttggccttctcgacgagaccggcgaccttggtagcgccgtccttgtcgaagagagagtcgccgatgctgacgttctcgagagtcttctttgagggtgaggccatgccgccgcagacgatgagcatgttgaccttgtcgaggaagttgtcgatcagctggatcttgtcgctgactttggcgccgccgaagatggcaaggaagggacgcttgggcgactcgagggcctgggcgaagtagtcgagctccctcctcatgaggaagcgggaggccttctgggggagatcgacgcccact

SEQ ID NO: 56480 - DNA, 651 bp, Zea mays
  misc_feature: Ceres CLONE 1497500
cgattgggtaccgggccccccctcgagccactgcagtggtaaagggtcagcaatcctaatccaaaccgccgcggccacggccgcagccttccatagttctgtcagaaattccccttctcatccctgatccctccaactcccaccccaatacatcctgccgacgccatcagccggcgggacgcacacacgaggtcgaccttcgaaccctagtccttggccgagccgccttgcgggatcgtccccgccgcgcggcagctctgcctcgacccttttagtctccgtccgacaccgcttggatcagagatggaatcaccacccctcacagctgaagcaattgctttttaccgagaaaagatggacatgacttttggagattaatcaagatgtcaaagaaaaagaatcctggaggcaagaaccccctagggcagcgatccaaagcgtccattccagatggcaaccctattaagggatggcgagttccacgggttattggaatttaatccaccctttaaaaaaggggttctgccaaaaaaaaggccaaatttgggggaaaacaattttgcctcccaaaaaaggggtgcaaaaaaaggtggtgtttttcccaaaggccacggggggttttttttttgaaaaagactctggggagatccc

SEQ ID NO: 56481 - DNA, 652 bp, Zea mays
  misc_feature: Ceres CLONE 1497504
  misc_feature: Encodes the peptide sequence at SEQ ID NO. 56482
  misc_feature (652)..(652): n is a, c, t, g, unknown, or other
cgattgggtccgggccccccctcgagccctgcagtggtaaaagtcagtcgtccaccccaccgccgcagcctcgatcccgaggagacaggagaacagcacgatgccgggcgacgcccacgatcatcggcgccctcctgggactgggcactcatatgtactccaacgccctccgcaagcttccctacatgcaccatccttgggagcatgtgttggggatgggtctcggtgcagtatttgtgaaccagctggtaaaatttgacgagaaactcaaggaggacctctacaagatgcttgagcgcgccaggctagccaacgagcaacgctacattgatgatgatgaatagctgttcagatttgtttgtaaatgacctgtatttttttgcaacatgttgtcagcacacatggtcaagactgtggatcccccatgacttatgtgttgcactcagcttccacatttcaactgtggccttgtaataaaatgtcgatgcccaatggatctgatggatcacaattgtaagctacagattatgggctttgaatatgatcgcttactttcaaaaaaaaaaaaaaaaaaccagagctctgggaaattgatgagcatcgggggatccactagttcatagagaggccgccaccccggaggagattcagn

SEQ ID NO: 56482 - protein, 113 aa, Zea mays
  misc_feature: Ceres CLONE 1497504
IGSGPPLEPCSGKSQSSTPPPQPRSRGDRRTARCRATPTIIGALLGLGTHMYSNALRKLPYMHHPWEHVLGMGLGAVFVNQLVKFDEKLKEDLYKMLERARLANEQRYIDDDE

SEQ ID NO: 56483 - DNA, 699 bp, Zea mays
  misc_feature: Ceres CLONE 1497511
  misc_feature: Encodes the peptide sequence at SEQ ID NO. 56484
  misc_feature (301)..(301): n is a, c, t, g, unknown, or other
cgattgggtccgggccccccctcgagccctgcagtggtaaaggagggtttcgtcgcttccagccgccgccgcgtccgcctcgccaagcgcagcagccgccgcagcacatcgctctcttgatctcagccatggcggaggtggagcagcaataggacacgccgaagctcttcaaccgctggaccttcgatgatgtccaggtgaacgacatctcgctgaacgactacctcgctgtgaacgcgacgaagcacgcgatgtacctgccgcacaccgcggggcgctactcccaaaagcggttccgcanggcgcagtgcccgatcgttgagcgccttacaaactccctcatgatgcacgggcgcacaacgggcagaaggtcatggctgttcgcatcatcaagcataccttggaaatcattccctgctcaccgatgccaacccattcaggtcggcctcaacccaacataaaaaggggcccccgggggatcccccccaatggttcccctggtttttaaaaaaggcaccccctggaattcccccccctggggggggggaaaagggggcttttcctccctccccctgggggcggggaaaaggtttttccagaaaccaaaaaacattttcgaaggccctttaaaaaaaaaataaaaaaccccgcgggggggcctccccaaaatttcccccaaaaaaaaaagggggaagttgg

SEQ ID NO: 56484 - protein, 69 aa, Zea mays
  misc_feature: Ceres CLONE 1497511
  misc_feature (17)..(17): Xaa is any aa, unknown, or other
MYLPHTAGRYSQKRFRXAQCPIVERLTNSLMMHGRTTGRRSWLFASSSIPWKSFPAHRCQPIQVGLNPT

SEQ ID NO: 56485 - DNA, 631 bp, Zea mays
  misc_feature: Ceres CLONE 1497531
  misc_feature: Encodes the peptide sequence at SEQ ID NO. 56486
atagctggagctccccgcggtggcggccgctctagaactagtggatcccccgggctgcaggaattcgcacgagaccattacctagaacatcctaatcgaaaaaaaccaaaccgcctccagctccagcctcctgtcctgctcccttcctcccctgcctgcctgccgcgcaccactccactcgagtgactcgagtcgtcctcctcccaccacctcccgtccgttgcgttgctcctgcccgcgcctcctccatccaccacaccagtccgtcgttaaagctgcggcatcggcagcacacgccgacgggtacaaggagcactcattgcctccccatctcgtgtaggctctccccctcctccgcgctccgtccgtctctcatcaccgttccgccgccgccccacctctccctcctctcgccgccgcctccgaacccgccacggcgcggcggagatccaaccggacggatctggatcgacctactccgacaccgggccccccgatcacgagcatggacagaactgccaataatgcggtattggatatcgagagccttcctcaaccgcctgataaatgctgctctgggagtccgaagatgatcagggccttgtcgcgtaagggttcgaaccggatggag

SEQ ID NO: 56486 - protein, 42 aa, Zea mays
  misc_feature: Ceres CLONE 1497531
MDRTANNAVLDIESLPQPPDKCCSGSPKMIRALSRKGSNRME

SEQ ID NO: 56487 - DNA, 961 bp, Zea mays
  misc_feature: Ceres CLONE 1497534
  misc_feature: Encodes the peptide sequence at SEQ ID NO. 56488
actctctctctctccctccaccctctctctctctacccacctcgtgcaattgcattgcacccctctccaccaacgaggagaactcgaccccaatttacagcgccgttgaataagtccgtcggtaattcgagcggggagcgataatggcgtcacccgtcgacgaggatctccccgggttgcctcccatcaagactacacctctgccgcccccggtgccctcgtccgccacggccacggccacgtcctcggcctcgtcctctccgtcgccggtgtcgtcggcggtggacagcgcgaaggccgcggaggaagaggatcgcgagccgtcgacgccgacgtcggaggggagcaggctgcggtcgcccgccgtgtgcccgccggcgccgcgcaagccgccggccccgcggctgcccgccaagcggaagccgccgcccgcgcccgtgcgggtgttcgtcgccgtcccgcgcgacctctccaccgtcttccggtcgctgtcccccaagaagcggatccgggtatcgtgatgccgcgatcgatccggccgtgatttgcctttgccaccggctttcctccaggctcggtcgatttcttggagagttcttccgagttcttggcttcttcttcttccggtcttccccctcgatcttttcttttctctcctctggtttactgctcctgctgcccacgggccacggccatggtataaattaaattatagtttttgttataaataacgtgtgtgttctttgagtattcgttcttttttctccttcttcttctttcttttgttgtgctagcgtgaggcagaagttgcagctctagaaatgaattgctgttactgaatggaagcagttcaaagaaacagaaaagctgtagcggaaattcacagagatcttgtaaattatgatacctgccagaactatctatcataatctgagttttgcttgcaaaaaaaaaaaaaaaa

SEQ ID NO: 56488 - protein, 125 aa, Zea mays
  misc_feature: Ceres CLONE 1497534
MASPVDEDLPGLPPIKTTPLPPPVPSSATATATSSASSSPSPVSSAVDSAKAAEEEDREPSTPTSEGSRLRSPAVCPPAPRKPPAPRLPAKRKPPPAPVRVFVAVPRDLSTVFRSLSPKKRIRVS

SEQ ID NO: 56489 - DNA, 640 bp, Zea mays
  misc_feature: Ceres CLONE 1497536
  misc_feature: Encodes the peptide sequence at SEQ ID NO. 56490
  misc_feature (640)..(640): n is a, c, t, g, unknown, or other
caaagctggagctccccgcggtggcggccgctctagaactagtggatcccccgggctgcaggaattcgcacgagaccattacctagaacatcctaatcgaaaagagcttttcttgtgcgcagccgcagccgctgcttttcgttcgtcttcatcctacgcgagggcgaaacccacaaaccctctccctcctgtactccggccgacacatccaggggcgatgacgctgggtagctccggcgccggatcgagcgtcgtcgttcctcgaaacttcaggctattagaggagctcgagcgtggagagaagggcattggtgatgggacagtgagctatggaatggatgatgctgatgacatctacatgcggtcatggactggtaccatcattgggcctcacaatactgtacatgagggtcgcatctaccagctgaagttgttttgtgacaaagactatccggagaagccaccatctgtcagattccactcaagaatcaacatgacatgcgttaatcaccagacaggaatggggtgatccaaggaaagtttggtttgctaagcgaactggcagcggggactaccccaatggagaacatccctaacccaagctccaagaaaaaagatggcttgccctcgcagaatccan

SEQ ID NO: 56490 - protein, 103 aa, Zea mays
  misc_feature: Ceres CLONE 1497536
  misc_feature: SWISSPROT Homolog: EC 6.3.2.19 Ubiquitin--protein ligase
MTLGSSGAGSSVVVPRNFRLLEELERGEKGIGDGTVSYGMDDADDIYMRSWTGTIIGPHNTVHEGRIYQLKLFCDKDYPEKPPSVRFHSRINMTCVNHQTGMG

SEQ ID NO: 56491 - DNA, 663 bp, Zea mays
  misc_feature: Ceres CLONE 1497539
  misc_feature: Encodes the peptide sequence at SEQ ID NO. 56492
  misc_feature (387)..(387): n is a, c, t, g, unknown, or other
caaagctggagctccccgcggtggcggccgctctagaactagtggatcccccgggctgcaggaattcgcacgagaccattacctagaacatcctaatcgaaaaaaaccataagagcttctgagtctagacactagatacagtaagccttagcaccaacagaggttagtatctcaacaaggatacttcaaatatgtccgcctcacgcagctcctctcccaactccatctcacagtggagccagaaagagaacaagatgtttgaagaggcactcgcatactacggcgagggcacatccaaccggtgggacaaggtgtccagagccatgggaggcatcaagtctgctgagggagtgcgctgccactatgaagatcttgactatgacgtcnagatgattgaatcaggccacgtgccgtaccccagtacaagacacattgaatcctgggacttgagtttgaaatggtggagggcccagggaggcaaaaaaaaaacccccttaaatctaaaatggccctggggtcctaaaagaaacgcaaaaatccccgccctgggtggaaaaataaatggataaaaccgtgggcaattgtttaagaaaggggtaaggaaaaatttttttttccccggggggttggaggaactatggggccccccccaaaaacggggat

SEQ ID NO: 56492 - protein, 104 aa, Zea mays
  misc_feature: Ceres CLONE 1497539
  misc_feature (45)..(45): Xaa is any aa, unknown, or other
MFEEALAYYGEGTSNRWDKVSRAMGGIKSAEGVRCHYEDLDYDVXMIESGHVPYPSTRHIESWDLSLKWWRAQGGKKKTPLNLKWPWGPKRNAKIPALGGKING

SEQ ID NO: 56493 - DNA, 628 bp, Zea mays
  misc_feature: Ceres CLONE 1497556
  misc_feature: Encodes the peptide sequence at SEQ ID NO. 56494
atagctggagctccccgcggtggcggccgctctagaactagtggatcccccgggctgcaggaattcgcacgagaccattacctagaacatcctaatcgaaaaaaccaaactagtggcttgtggagttctggtaagccaaacaagtggcagttaatacttcggcccttgtggatacaggcgacagcaacagggaaactccccgctccccagccggcaaacgccagccccgcgacggcgccgcgccgtcctctcccgaccgacggcaacggaaaccccggtgacttctgatacaggaagattacttttatctatactccaccttctttcgtggctatggcactagcagctatctataaccttttcatcattaacaaatctggcggccttatatactacaaggactatggttcagcagggaggatggataccaatgacagtttaagattagcaagcctctggcattcgatgcatgctatctcgcagcaactgtcccctaccactggctgtactggcattgatctcttacaagctcataactttgatctccattgctttcaatccctcacagggacgaaatttttcgtcgtatgcgaaactggagctccaaatatggaaatgctgctgaaag

SEQ ID NO: 56494 - protein, 98 aa, Zea mays
  misc_feature: Ceres CLONE 1497556
  misc_feature (6)..(98): Pfam Name: Sybindin Pfam Description: Sybindin-like family
MALAAIYNLFIINKSGGLIYYKDYGSAGRMDTNDSLRLASLWHSMHAISQQLSPTTGCTGIDLLQAHNFDLHCFQSLTGTKFFVVCETGAPNMEMLLK

SEQ ID NO: 56495 - DNA, 627 bp, Zea mays
  misc_feature: Ceres CLONE 1497557
  misc_feature: Encodes the peptide sequence at SEQ ID NO. 56496
atagctggactccccgcggtggcggccgctctttcctagtggatcccccgggctgcaggatttcgcacgagaccattacctagaacatcctaatcgaaaaactactctgcctctgactggggcaagcaaagcgttgaggcttgggatttctcgaagccatggaagagtgagccccgaaaagaagcctaccggagggccgatacgaatccgcctccggctccgagagcagcagcctcagtaccaccagtccagtccagcctccagctaggggaagaagaagaagagcgaaggaaggggacgggggcgaggaaggagccagagcagacccaatccctcaatggcttcctctcgcgctctcgctctcgctctcttcctcctctgcgccctgctgcccgcgccccctgtctcggccacattgctgttcggcggcggcgagtctgccaagaaggcgggcgtcgacgcggagtggcggccggccactgcgacgtggtacggcgaggcagagggcgacggcagcgacggtgagcgctctcagctctgctcctcagctcactatcatgccggtcttactgggctccgggactctggtctgggggtagtatgtctccgagcagaatacttgaggga

SEQ ID NO: 56496 - protein, 96 aa, Zea mays
  misc_feature: Ceres CLONE 1497557
MASSRALALALFLLCALLPAPPVSATLLFGGGESAKKAGVDAEWRPATATWYGEAEGDGSDGERSQLCSSAHYHAGLTGLRDSGLGVVCLRAEYLR

SEQ ID NO: 56497 - DNA, 643 bp, Zea mays
  misc_feature: Ceres CLONE 1497559
  misc_feature: Encodes the peptide sequence at SEQ ID NO. 56498
  misc_feature (643)..(643): n is a, c, t, g, unknown, or other
caaagctggagctccgcggtggcggccgctctagaactagtggatcccccgggctgcaggaattcgcacgagaccattacctagaacatcctaatcgaaaaaccgctattaaagtcccatccgcggctccgccctcctctgtgtcttccttccacctgaaaacccaacccacacgctcgcgcctccgcgaagaaaaacaccgaggcccatggcgccgagaacgtcagagagagcgatgacatcagcggcgaccgccgccgcggggctcgggctcgcgcgtggcgccggcccgcattacagaggcgtcaggaagcggccgtggggccggtacgccgcggagatccgcgacccggccaagaagacccgcgtgtggctcggcacgttcgacacgcccgaggacgccgcgcgggcctacgacgccgccgcgcgcgagtaccgcggcgccaaggccaagaccaacttctccttcccttcgtgcctgccgctcgccgccgcggacgtggccggcgccggcgcctgccggagcggcaacagcagcagcaccagcaccaccgtcgactccttcagcggcgacgtgcaggcgccgcccatgcaggccatgccgctcccaccgtccttctgcgccaggggcgccgtacgcttn

SEQ ID NO: 56498 - protein, 144 aa, Zea mays
  misc_feature: Ceres CLONE 1497559
  misc_feature (28)..(79): Pfam Name: AP2 Pfam Description: AP2 domain
MAPRTSERAMTSAATAAAGLGLARGAGPHYRGVRKRPWGRYAAEIRDPAKKTRVWLGTFDTPEDAARAYDAAAREYRGAKAKTNFSFPSCLPLAAADVAGAGACRSGNSSSTSTTVDSFSGDVQAPPMQAMPLPPSFCARGAVR

SEQ ID NO: 56499 - DNA, 672 bp, Zea mays
  misc_feature: Ceres CLONE 1497562
ataactggagctccccgcggtggcggccgctctagaactagtggatcccccgggctgcaggaattcgcacgagaccattacctagaacatcctaatcgaaaatacatttcgactctcaactcccaaggtcccttttttttttctcgatctgggagcgccgcagtagcagccatgggacgtgagccgagcaaggcgtaaagccaaaaaaggcgccgccgggcgcaaaggccgcgggcccacaaaaaaatccgtgtcgcgggcctcccagggccgggtgcagattcccctcagccgcgtcggggggtaactcaaaaaagggccggacacgcaacgtgtaaggaccggtggccccctctaccttcgcgcccgcctggagtatctccccgggcgaagaggtccaactcccccgccaccccgccaagggaaaccaaaaaaaacgcatcattccgcgccacgaggtgctccccatccgcaacaaaaaaagaaatcggcaaaatgctgggccggggtcaccatcgcccacagggggggggctccccaacaaacaacaaagggggccctcccccaaaaagaggggcgaaaaaagggggcaaagaaacccccaaaaaagcccgctaaatccccccaccaaaggggagaaagggaactccctggtcctcaaaaccaaaaaaa

SEQ ID NO: 56500 - DNA, 688 bp, Zea mays
  misc_feature: Ceres CLONE 1497572
  misc_feature: Encodes the peptide sequence at SEQ ID NO. 56501
aagctggagctccccgcggtggcggccgctctagaactagtggatcccccgggctgcaggaattcgcacgagaccattacctagaacatcctaatcgaaaaatttttctctcctcactcaacgcggcgatgccccctagatcggatcacgccgccggcagcggcgccgcggcggcggccacgcaggcccacttcgactccatcgatccactcttccatgtgctccgcgtgctacccttctccttcctcctgccgccgcgcacccgcctgaggctgccgtcgaacctggcgcttccctctcccatgaccgtcttctccctcatcctgctcacctactttgcggtcgtctccggactcgtgtacgacgtcatcgttgagccccctggcatcggcagcgcccaggaccccggtactggcgccgtccgccccgtcgtcttccttccagggcgcgtcaacggccagtacatcatcgagggactctcctccgggttcatgttcctccttggcggcattggcatcatcctcctcgacctcgccgtcgaccgcacgaggccccggaaccctcggcgtctccgtttggaaagcgccggcgccagtcggccgtttgtcatccgcctacccccatggcccatgcttctttccttccgcattcaagaatcccccgggctaaccttccgggtggaaggatg

SEQ ID NO: 56501 - protein, 186 aa, Zea mays
  misc_feature: Ceres CLONE 1497572
MPPRSDHAAGSGAAAAATQAHFDSIDPLFHVLRVLPFSFLLPPRTRLRLPSNLALPSPMTVFSLILLTYFAVVSGLVYDVIVEPPGIGSAQDPGTGAVRPVVFLPGRVNGQYIIEGLSSGFMFLLGGIGIILLDLAVDRTRPRNPRRLRLESAGASRPFVIRLPPWPMLLSFRIQESPGLTFRVEG

SEQ ID NO: 56502 - DNA, 664 bp, Zea mays
  misc_feature: Ceres CLONE 1497575
  misc_feature: Encodes the peptide sequence at SEQ ID NO. 56503
aaagctggagctccccgcggtggcggccgctctagaactagtggatcccccgggctgcaggaattcgcacgagaccattacctagaacatcctaatcgaaaagcgtataaaacgtctcgtgcgtaggcggcgccgcggcgactaggctgtccccgtggcactatattgggggttgcattatcaggcatccgaccgacggcatgaggaggaaagggagcgactgtacacggatcagcccagccgagatcacgcccatgatctccctgccgtccaggcggtccgcgggccggacggcgtcggcgccggaccgggaccgggaggaggagcgacctcggcaacggcgagtgcgaggcgcgtgcggctctcgcctgctgcggaccgcgcggtggacggccgcgcgcttctacaggcgagcgcgggtaagcatcgccagggcgtttcggcccccgtcgacgacggcggccaagagagcacaagcaggcgccggcgccgcttcgcccgactgcggcacgccggcgaagcggcgtagtagcaggcggcagcagcagtcgtccgcgccgacgacagtcgtcgtcgtcgatgactcgcacaagagcgaagcggtggaggagtgcatcagggtcatgaactcgtcgtcgaagaagtacccgtagagtctctggaa

SEQ ID NO: 56503 - protein, 150 aa, Zea mays
  misc_feature: Ceres CLONE 1497575
MRRKGSDCTRISPAEITPMISLPSRRSAGRTASAPDRDREEERPRQRRVRGACGSRLLRTARWTAARFYRRARVSIARAFRPPSTTAAKRAQAGAGAASPDCGTPAKRRSSRRQQQSSAPTTVVVVDDSHKSEAVEECIRVMNSSSKKYP

SEQ ID NO: 56504 - DNA, 648 bp, Zea mays
  misc_feature: Ceres CLONE 1497576
  misc_feature: Encodes the peptide sequence at SEQ ID NO. 56505
aaaactggagctccccgcggtggcggccgctctagaactagtggatcccccgggctgcaggaattcgcacgagaccattacctagaacatcctaatcgaaaaatacttcacaccgctgccaccgcctgtacatggaggtccgtgcattattctcaagttgggctcagcccatgtaggaggagcattccatccgggcccacttgtcatcggactgagtggcgtcttcctcctcccttcgtaactttccagacccgaccgcagcagcccggggcaacaagcgaaccgacggcggcgatggggatcggtgagcacttcgagggcgtcaagcatcactgggcgagcaacttcgccttcctcgactacttcaagaaggtctacggccgcgccgagcccctccccaagtggtccgacgccgacgtcgacgagttcatcgcatccgacccggtctacgggccccagctcaaggccctgcgggagtcgaggaagttcgcgctcgccggggccctcgtcggcgccgcccacctcggcggcgtcgcgctcaagtactccaaggcgccgcacggcgtcctgctggcgaccggcttcggcgcgatcaccggcgccgtgctgggatccgaggtggcggaccactggtaccagctctacgag

SEQ ID NO: 56505 - protein, 118 aa, Zea mays
  misc_feature: Ceres CLONE 1497576
  misc_feature (66)..(110): Pfam Name: Rick_17kDa_Anti Pfam Description: Rickettsia 17 kDa surface antigen
MGIGEHFEGVKHHWASNFAFLDYFKKVYGRAEPLPKWSDADVDEFIASDPVYGPQLKALRESRKFALAGALVGAAHLGGVALKYSKAPHGVLLATGFGAITGAVLGSEVADHWYQLYE

SEQ ID NO: 56506 - DNA, 659 bp, Zea mays
  misc_feature: Ceres CLONE 1497581
  misc_feature: Encodes the peptide sequence at SEQ ID NO. 56507
acagctggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgccggccgccatcgcgctggcgctcatggcggccgggttcgtcacctccggcggccttcgcgtcgctgcgctgtccgtgttctcctggatgtacaagtacctgacggggcaacaccccccgggcgccaaccagctggaacccgccaaggcaaggctggcgtcccaggccgcgacatccaagatgcagcacagccccgcatcgaccaggcgcagg

SEQ ID NO: 56507 - protein, 154 aa, Zea mays
  misc_feature: Ceres CLONE 1497581
  misc_feature (36)..(153): Pfam Name: Oleosin Pfam Description: Oleosin
MADHHRGATGGGGGYGDLQRGGGMHGEAQQQQKQGAMMTALKAATAATFGGSMLVLSGLILAGTVIALTVATPVLVIFSPVLVPAAIALALMAAGFVTSGGLRVAALSVFSWMYKYLTGQHPPGANQLEPAKARLASQAATSKMQHSPASTRRR

SEQ ID NO: 56508 - DNA, 637 bp, Zea mays
  misc_feature: Ceres CLONE 1497584
  misc_feature: Encodes the peptide sequence at SEQ ID NO. 56509
aaagctggagctccccgcggtggcggccgctctagaactagtggatcccccgggctgcaggaattcgcacgagaccattacctagaacatcctaatcgaaaagcgtataaaacgtctcgtgcgtaggcggcgccgcggcgactaggctgtccccgtggcactatattgggggttgcattatcaggcatccgaccgacggcatgaggaggaaagggagcgactgtacacggatcagcccagccgagatcacgcccatgatctccctgccgtccaggcggtccgcgggccggacggcgtcggcgccggaccgggaccgggaggaggagcgacctcggcaacggcgagtgcgaggcgcgtgcggctctcgcctgctgcggaccgcgcggtggacggccgcgcgcttctacaggcgagcgcgggtaagcatcgccagggcgtttcggcccccgtcgacgacggcggccaagagagcacaagcaggcgccggcgccgcttcgcccgactgcggcacgccggcgaagcggcgtagtagcaggcggcagcagcagtcgtccgcgccgacgacggtcgtcgtcgtcgatgactcgcacaagagcgaagcggtggaggagtgcatcaggttcatgaactcgtcgtc

SEQ ID NO: 56509 - protein, 145 aa, Zea mays
  misc_feature: Ceres CLONE 1497584
MRRKGSDCTRISPAEITPMISLPSRRSAGRTASAPDRDREEERPRQRRVRGACGSRLLRTARWTAARFYRRARVSIARAFRPPSTTAAKRAQAGAGAASPDCGTPAKRRSSRRQQQSSAPTTVVVVDDSHKSEAVEECIRFMNSS

SEQ ID NO: 56510 - DNA, 546 bp, Zea mays
  misc_feature: Ceres CLONE 1497587
aaagctggagctccccgcggtggcggccgctctagaactagtggatcccccgggctgcaggaattcgcacgagaccattacctagaacatcctaatcgaaaaaccgaaaaactagcaaaccctacctcctctcctccccctcctcggcggcggaatgtccgaccgccgccgcgacaaggagaagacccgcgaccgcgacatcgaccgtcatcgcgaccgagaccgcgacatcgaccgttcatctgcgaccgaagacccgcgaccggggaccgggaacaggggacaggggatccgcgaggcgagacccacccgccgcccagcgccgagcgggaaagcgctccccgcctccccgggtcccccgttcgggcgggaatccggggaaccggtttcccacccggccggcccacctcttttatttcggcacccccaaggggccgggtccccttttcccccccctcttccccccgaaaagcccccggggcccggccccccccaaaagaagggccccctcccccccccgaaagggggcgcgtttccccccccccg

SEQ ID NO: 56511 - DNA, 672 bp, Zea mays
  misc_feature: Ceres CLONE 1497594
  misc_feature: Encodes the peptide sequence at SEQ ID NO. 56512
  misc_feature (317)..(317): n is a, c, t, g, unknown, or other
ctccccgcggtggcggccgctctagaactagtggatcccccgggctgcaggaattcgcacgagaccattacctagaacatcctaatcgaaaactaaagactggaggggtggaagggctgctagtttcaacatcattcccagcaccactggagctgctaaggctgttggcaaagtgcttcctgtccttaacggaaagttgactggaatgtctttccgtgtcccaaccctcgatgtttctgttgttgatttgactgtcaggcttgagaagtcagcaacctatgatgagatcaaggctgcggtcaaggccgaggcagaangtagcctcaatggcatcctgggttaccttgaggaggaccttgtttccaccgatttccagcatgacaacaggtctagcatctttgatgctaaagctggcattgccttgaacggcgacttcttaaagctcgtgtcctggtacgacaacgaatggggatacagcaccccccgtggtcgacctgatcccgcccccatgaaacaacaccaacttacgattatgaaaaaactcaaggggctgggtgataaaaagcgaagtttgttcttctttccccccccgggagaaaaagtggccttcccgagagagaaaaatttttattcccaaccgggagatggtccgggaaaacctattgttggggg

SEQ ID NO: 56512 - protein, 155 aa, Zea mays
  misc_feature: Ceres CLONE 1497594
  misc_feature (1)..(84): Pfam Name: Gp_dh_C Pfam Description: Glyceraldehyde 3-phosphate dehydrogenase, C-terminal domain
  misc_feature: SWISSPROT Homolog: EC 1.2.1.12 Glyceraldehyde-3-phosphate dehydrogenase (phosphorylating)
  misc_feature (38)..(38): Xaa is any aa, unknown, or other
MSFRVPTLDVSVVDLTVRLEKSATYDEIKAAVKAEAEXSLNGILGYLEEDLVSTDFQHDNRSSIFDAKAGIALNGDFLKLVSWYDNEWGYSTPRGRPDPAPMKQHQLTIMKKLKGLGDKKRSLFFFPPPGEKVAFPREKNFYSQPGDGPGKPIVG

SEQ ID NO: 56513 - DNA, 669 bp, Zea mays
  misc_feature: Ceres CLONE 1497597
  misc_feature: Encodes the peptide sequence at SEQ ID NO. 56514
  misc_feature (47)..(47): n is a, c, t, g, unknown, or other
agagctggagctcaccgcggtggcggccgctctagaactagtggatnccccgcgctgcagggattcgcacgagaccattacctagaacatcctaatcgaaaaacatcgtcaatccctcttccacagtttctgaaatcagaagggaaacacaggaacgacaggcaattcgaggctggcaatctaatcgtctgccatcccgtctcatcgttctcccaaatctgagagcgttcccaggacctagggttcttgagatccagccccaggatggatccgaaccctagagctcccctcctcctcgccatcgtcgttctcgcgcttggcgtatccctggtggccagcgccgaggacgacgcttcgggggtctctctgggccgccgcgccgggggggtcttgccccgcctgaagaaggatgccctggcggaaggcgatcctgcggtgggccttagacgtaggtggaccgggccttttccacgcactctttgcccgcctctccatgatccttaggcggggagattggagataagacatttgttcttggttgcggctgatggctattgcgggtaccccccgggggatttgtagtggtcctgggcgcggcgggcctgcgcctttttcgctgttgacaaccggggggcccaccctgatctttggctctcgatccccaccccc

SEQ ID NO: 56514 - protein, 79 aa, Zea mays
  misc_feature: Ceres CLONE 1497597
MDPNPRAPLLLAIVVLALGVSLVASAEDDASGVSLGRRAGGVLPRLKKDALAEGDPAVGLRRRWTGPFPRTLCPPLHDP

SEQ ID NO: 56515 - DNA, 667 bp, Zea mays
  misc_feature: Ceres CLONE 1497603
  misc_feature: Encodes the peptide sequence at SEQ ID NO. 56516
aaagctggagctccccgcggtggcggccgctctagaactagtggatcccccgggctgcaggaattcgcacgagaccattacctagaacatcctaatcgaaaactgttctatttcctctacacttttttgaccaagttcatccttgggttgttagtttttctggcactttactgttccttactactgaactgaggacacatcctattgatggttatggtcttgttcacacacattcaagatgtgtcatctatctaatgaatgtgatattctcgtccaacgcgtttgttactggcttctctgaatatttcctgaaccacactattgacagtctgaagcttcttcttgagagaccgaggctaccattcgtgatacatttccggtctctcaggaccgatatacgagacgaggagttttattcactgccattcaatctgaataagttcttcccatcggtctgacctcttgctgtggtgaatgctagatgctcttgttactctggattctggaactgcccaccacctgttatccggcggtggcaatgtgatctgaatgttctcggtacatgcaaaaatgactgtatcattaaaacccagctcagctccggatttcaccgtccgttcccgtgctttccccggagaatttggaccacatttccctgaaaaaaaaa

SEQ ID NO: 56516 - protein, 67 aa, Zea mays
  misc_feature: Ceres CLONE 1497603
MNVIFSSNAFVTGFSEYFLNHTIDSLKLLLERPRLPFVIHFRSLRTDIRDEEFYSLPFNLNKFFPSV

SEQ ID NO: 56517 - DNA, 697 bp, Zea mays
  misc_feature: Ceres CLONE 1497612
  misc_feature: Encodes the peptide sequence at SEQ ID NO. 56518
  misc_feature (416)..(416): n is a, c, t, g, unknown, or other
  misc_feature (627)..(627): n is a, c, t, g, unknown, or other
aaagctggagctcaccgcggtggcggccgctctagaactagtggatcccccgggctgcaggaattcgtacgagaccattacctagaacatcctaatcgaaaaacccaggccgcggccgcatcctctccccatcggcagtcttcccccaagacgtctaaaccccaatccctaaatccccgacgcagaccacacgacgcgcacctccgttcacgaggcggaagcatgagtcgccacccgatcactaagtgggcacagaggtccgacagggtgttcttgacgatagagctgcccgacgcccaggatgtgaagctgaacttgaagcctgaaggccatttcaacttctcagctaagggctcagatgacttgccctctcactttgagggggaggggggtgatgctgtgaatgtgaaggaaancaaaccacctattggcccaaggaacatatgctacctgatagagaagctaaaagcgggcggtggcccaggctgctgaacccggagggcaaaccacctgggttcctgaaagttgaacggggacaaagggcccggccaggatgaagaaaaaccgttggcatcaaaggcattttggggggattgggactttttccaactgggcgacataggtcangggccctgattgtaccacccataatggggggcatgcatcataaagacaaaggggggtacaaagacaacgc

SEQ ID NO: 56518 - protein, 89 aa, Zea mays
  misc_feature: Ceres CLONE 1497612
  misc_feature (5)..(80): Pfam Name: CS Pfam Description: CS domain
  misc_feature (65)..(65): Xaa is any aa, unknown, or other
MSRHPITKWAQRSDRVFLTIELPDAQDVKLNLKPEGHFNFSAKGSDDLPSHFEGEGGDAVNVKEXKPPIGPRNICYLIEKLKAGGGPGC

SEQ ID NO: 56519 - DNA, 659 bp, Zea mays
  misc_feature: Ceres CLONE 1497613
  misc_feature: Encodes the peptide sequence at SEQ ID NO. 56520
tggagctccccgcggtggcggccgctctagaactagtggatcccccgggctgcaggaattcgcacgagaccattacctagaacatcctaatcgaaaaatatcttctcgcccagatccacaagtttcgtgggtagaggaggcactagatactgtgccagatcggggtctggtagtggcagttgggtgattacgacggagtgggatgggcctcctcgacaagctgtgggacgacaccgtcgcgggcccgcgcccggacaccggcctcggccgcctccgcaagcagcccgcgcgccccgccgccgttaagatcagtggtggtcgcttcagaaggaaatcatcatccgacgcatatgagagggcaacccctccagggacgaccagccaccctcctcccttcgaagtgtgaaccggctgcaccctcacacttgttttgctccttgacaagcatctcttcacctataataaggtagaggcagggaggagagaagacgacatcaagaggggaacggggatgagttgcgggtttacctctgctgtgatatattgtaggtgccactatgtgtattgttcccccctatctactacgtggcataggttgtattctagtatgttgaaagctcatggtgccgtgctgtatcaataaggtgttatgcgcatag

SEQ ID NO: 56520 - protein, 67 aa, Zea mays
  misc_feature: Ceres CLONE 1497613
MGLLDKLWDDTVAGPRPDTGLGRLRKQPARPAAVKISGGRFRRKSSSDAYERATPPGTTSHPPPFEV

SEQ ID NO: 56521 - DNA, 660 bp, Zea mays
  misc_feature: Ceres CLONE 1497619
  misc_feature (523)..(523): n is a, c, t, g, unknown, or other
aagctggagctccccgcggtggcggccgctctagaactagtggatcccccgggctgcaggaattcgcacgagaccattacctagaacatcctaatcgaaaattgtctcgagctctagtcatagtccaacttgtgggagtggtaatccttgtgtttctgctagtataaaccctctcatcagtcctcaggtttgccctgtacagaaccttgcacgttgtgttcctgcacgtggtgaccaacccacccagttgctcatctcaccgtggccggggtgtcttgaggagtcgcgtgcccagaacagagtcacaccgacgcggtctggcgccgtggacagcttcaccaccaactcatcgtaccacgtcttctccgagtgttttcacacaagcacagtaagacagaacacctagaagaagtggtgtttgaaggaggagtctactccagtggctgctgatcaagtggaggagccatctgactgggtattgggtggaaaggtctttagcctcttctctgcaacaaaggagaangttttttcccttttctttaggttagttacttcatgtggaggacttgaagcttagaaggtttttatatatcttttatggaaaggcttcaccctcccattattgtaatagttatgcacttcgagtactatcaggacttg

SEQ ID NO: 56522 - DNA, 656 bp, Zea mays
  misc_feature: Ceres CLONE 1497623
  misc_feature: Encodes the peptide sequence at SEQ ID NO. 56523
aaagctggagctccccgcggtggcggccgctctagaactagtggatcccccgggctgcaggaattcgcacgagaccattacctagaacatcctaatcgaaaaaaccaaacagcgagcgcaaggaagaaaggtcgaagcgtcgtctctctcggcacggagcctagtgcccggcctcgtgagatccgaaattcagaatcgaggatggcgacgaccgcgactaggcggtggtggaggcggcacgacggcggcgacgatgacccagacgacctcgtccccatggacacccaagagcaagaagagctggtccggtctctggaggctaagcaggcgcagcaaggccgccgttggaggcgcgtcttcgcggggttcctcctaggttacgcggccttccttgtctactccagtttccatcatgcttggtctccctgggagctgcggtaccatgcttacttcatggaagatttgcctgtaccaatggtcataattgcagattggatagctgctctagcatgcctatttgctgtgaaaggattactacagaattcaggcccatcaaagaagtggatgtggtattcttgctatgttggcattttggtagccatcttttggacatactacatcttgaggttgccaagaattcgatgggatgttgcatg

SEQ ID NO: 56523 - protein, 151 aa, Zea mays
  misc_feature: Ceres CLONE 1497623
MATTATRRWWRRHDGGDDDPDDLVPMDTQEQEELVRSLEAKQAQQGRRWRRVFAGFLLGYAAFLVYSSFHHAWSPWELRYHAYFMEDLPVPMVIIADWIAALACLFAVKGLLQNSGPSKKWMWYSCYVGILVAIFWTYYILRLPRIRWDVA

SEQ ID NO: 56524 - DNA, 657 bp, Zea mays
  misc_feature: Ceres CLONE 1497635
  misc_feature: Encodes the peptide sequence at SEQ ID NO. 56525
acaagctggagctccccgcggtggcggccgctctagaactagtggatcccccgggctgcaggaattcgcacgagaccattacctagaacatcctaatcgaaaaatcaccaatcagtcagtcacagctcacagcaaacaccgcgaagccgcccccgctcccaaacccgaccgagcaaagcgcaaagccccccaaccgcggatcaatccgcagcatcgatggcgcccaaggcggagaaaaagccggcggcgaagaagcccgcggaggaggagcccgcgaccgagaaggcggagaaggctccggcagggaagaagccgaaggcggagaaacgcctccccgcgggcaagtccggcgccggcgagggcaagaagggcaagaagatagccaagaagagcgtggagacctacaagatctacatctttcaggtgctcaagcaggtgcaccccgacatcggcatctcgtccaaggccatgtccatcatgaattccttcaatcacgacatcttcgagaaagctcgcgccgaagcccgcaagctcgcccgctacaacagaaggcccacatcacctcccgcaagaatcaaaactcggtccgctcgtccttaccggggaagtcccaaaacacccgtcccgaagggccaaaggcgggccccaagttccttc

SEQ ID NO: 56525 - protein, 147 aa, Zea mays
  misc_feature: Ceres CLONE 1497635
  misc_feature (57)..(126): Pfam Name: Histone Pfam Description: Core histone H2A/H2B/H3/H4
MAPKAEKKPAAKKPAEEEPATEKAEKAPAGKKPKAEKRLPAGKSGAGEGKKGKKIAKKSVETYKIYIFQVLKQVHPDIGISSKAMSIMNSFNHDIFEKARAEARKLARYNRRPTSPPARIKTRSARPYRGSPKTPVPKGQRRAPSSF

SEQ ID NO: 56526 - DNA, 646 bp, Zea mays
  misc_feature: Ceres CLONE 1497641
  misc_feature: Translation starting site: 178
  misc_feature: SWISSPROT Homolog: EC 1.10.2.2 Ubiquinol--cytochrome-c reductase
caaagctggagctccccgcggtggcggccgctctagaactagtggatcccccgggctgcaggaattcgcacgagaccattacctagaacatcctaatcgaaaagtgcttcccggcgcgaaccctagccgagattagattggaggcgagcgccatcaccggaggaagagggcgacacgatgctgcgggttgcgggaagaaggctctcgtcttccgtctcctggcgccccgccgtggcggcggccaggggcccccttgccggtgctggcgcccccgaccgggacgacggctcggctcgcggccggagccagacgcggttctccatcgactcccccttctttgtcactgccaagggtttctcttcgactgaaacacttgtcccaggaaaccaagatgctggcctagctgacctcccagcaagcgtgcatttgcttactttgtcctgagtggtgggaggttcatatatgcatcactgttgcgtctcctcgtattgaagtttgtcctgagcatgtcagcaagtaaggacgtgcttgcccttgcttcactcgaggtggacctctccagcattgagccagggaccacggtgactgtgaagtggcgtgtaaagccagtcttcatcagacgccggacggacgacgacatctagct

SEQ ID NO: 56527 - DNA, 668 bp, Zea mays
  misc_feature: Ceres CLONE 1497648
  misc_feature: Encodes the peptide sequence at SEQ ID NO. 56528
  misc_feature (424)..(424): n is a, c, t, g, unknown, or other
atagctggagctccccgcggtggcggccgctctagaactagtggatcccccgggctgcaggaattcgcacgagaccattacctagaacatcctaatcgaaaaacatgacacaacgacaccaactgtcctcaatccagcagccctcgagtctcgtccccgcacatcagcagagagacgccactaccaccaccgcaagcgacgacggggagatgtttctgcgacggatcctgaccggcggaggtggcctggcggcgctgagggcggcgcgcgccgtgaaggagacgacggggatcgtcggccttgaggtggcgcccaacgcgcgggaggttctcatcgggctctacacgcgtacgctcaaggagatcgaggccgtccccaaagacgagggctaccgcaaggccgttgagtccttcaccaatcaccncctccagatctgccaggaggaggacgactggaagcgcatcgaggaccgaatcggatgcgggcaagtcgaggagctcatcgaggaggccgaggacgagctcaagctcatcgccaaaatgattgaatgggatccggggggtggccccgaatgactacgaatgggagggggaatgaaaaacgacccccccatttcctaaagcatggttcctcaagcacccggacccgttgctccttccctgagggag

SEQ ID NO: 56528 - protein, 121 aa, Zea mays
  misc_feature: Ceres CLONE 1497648
  misc_feature (35)..(91): Pfam Name: ETC_C1_NDUFA5 Pfam Description: ETC complex I subunit conserved region
  misc_feature (72)..(72): Xaa is any aa, unknown, or other
MFLRRILTGGGGLAALRAARAVKETTGIVGLEVAPNAREVLIGLYTRTLKEIEAVPKDEGYRKAVESFTNHXLQICQEEDDWKRIEDRIGCGQVEELIEEAEDELKLIAKMIEWDPGGGPE

SEQ ID NO: 56529 - DNA, 531 bp, Zea mays
  misc_feature: Ceres CLONE 1497655
  misc_feature: Encodes the peptide sequence at SEQ ID NO. 56530
  misc_feature (253)..(253): n is a, c, t, g, unknown, or other
  misc_feature (307)..(307): n is a, c, t, g, unknown, or other
  misc_feature (308)..(308): n is a, c, t, g, unknown, or other
  misc_feature (318)..(318): n is a, c, t, g, unknown, or other
ataactggagctccaccgcggtggcggccgctctagaactagtggatcccccgaggctgcaggaattcgcacgagaccattacctagaacatcctaatcgaaaaatcgacctcctcgatccagacagcaggcagcagccatgtccaaggtcttcaccctcgacgcggtcgccaagcacaactccaaggaggattgctggctcatcatcggcggcaaggtgtatgatgtgacgaagttttcggtagaccacccnagatgtgatgatgtctgttgtccctcactggcaaagatgcaactgatgatttcnnaggattgtcngtcacaagaaccctggccccgccccaataattgattaattccctgggggggggaaatcaaccgcgtcaaaaaatcccttcagggaaaaaaatatggcccccccaaaaaaccccgccttaaccccggaaataaaaccccccaagtttggccccaaaaatcccccccctttttttgggcccccccggagaacaccgggggttggggtttttcccc

SEQ ID NO: 56530 - protein, 70 aa, Zea mays
  misc_feature: Ceres CLONE 1497655
  misc_feature: SWISSPROT Homolog: EC 1.7.1.1 Nitrate reductase (NADH)
  misc_feature (57)..(57): Xaa is any aa, unknown, or other
  misc_feature (60)..(60): Xaa is any aa, unknown, or other
MSKVFTLDAVAKHNSKEDCWLIIGGKVYDVTKFSVDHPRCDDVCCPSLAKMQLMISXDCXSQEPWPRPNN

SEQ ID NO: 56531 - DNA, 675 bp, Zea mays
  misc_feature: Ceres CLONE 1497659
aagctggagctcaccgcggtggcggccgctctagaactagtgatcccccgggctgcaggaattcgcacgagaccattacctagaacatcctaatcgaaaagtactgcccccacgaagcattcgtgctcgtttcgcctcgcgcctgccctgctgtcctgctgctgctattttgccattgcatccatttccgggggacggagtggaggagggcgtcgcctgcgctgcgttgcttcgcgtgggaagcgtagcgtgcttcgtttaggcctctcgccaatatccgagtgctaatctagagaggcctttggctttgccagacgcgcctgtacacgcctttctggaaagcaaccacttgctctcgcctccaatggccgagatctgctgccaaaaaccaagtccaccccggcgaccgccgtgtcccccacttcaaccgccggcacggtcgttgcggccgcccccctggcactggcctcttccgcgttaaagaggaggccaccccagttcgaaaataaggagggtccgcgtctgcggtcgattcccaaggcgcccgctccccagaggacctccgcgtccccccaaaccgccataagcctggcccccccaccctaattccaagcaacctggtgccggaacaccgaggctctaggagtcccggggcgctcggaacttgcggaacct

SEQ ID NO: 56532 - DNA, 660 bp, Zea mays
  misc_feature: Ceres CLONE 1497660
  misc_feature: Encodes the peptide sequence at SEQ ID NO. 56533
ctccccgcggtggcggccgctctataactagtggatcccccgggctgcaggaattcgcacgagaccattacatagaacatcctaatcgaaaagagcaggagtgagggagcgcgatggcggagaagaagcagcgcccaggagggtccaggaaggacgaggtggttacccgcgagtacaccatcaacctacacaagcgcctccacggatgcaccttcaagaagaaagcccccaatgctataaaggaaatcatgaagtttgctcagaaggcaatgggcaccactgacatcaggattgatgtgaaactcaacaagcacatataggaacaaaataatccaagaatgtagccgaggcttgtcccccgctcaattcgcgcggggagtggaacgatttagaattactcccaaggaatagttgtccccccccatgttagggttgttggatatcctcccccggaaagccctgtattgcgctgggttcccaaaggttgaatgacgacgcaccaattagtatcctgcctggatttcgcggatcctatgctcatactgtttcaaacgcgtgtcgcattagcccgggtatttctaattcgtcctggttacctcggtctaagtacccgtgggatattaatatttttcttctgtgggtccgaaatacagcagccgc

SEQ ID NO: 56533 - protein, 68 aa, Zea mays
  misc_feature: Ceres CLONE 1497660
  misc_feature (12)..(68): Pfam Name: Ribosomal_L31e Pfam Description: Ribosomal protein L31e
MAEKKQRPGGSRKDEVVTREYTINLHKRLHGCTFKKKAPNAIKEIMKFAQKAMGTTDIRIDVKLNKHI

SEQ ID NO: 56534 - DNA, 638 bp, Zea mays
  misc_feature: Ceres CLONE 1497664
  misc_feature: Encodes the peptide sequence at SEQ ID NO. 56535
atagctggagctccccgcggtggcggccgctctagaactagtggatcccccgggctgcaggaattcgcacgagaccattacctagaacatcctaatcgaaaaattcttacacggattgagatcgtcttctccaacgctcaacaaccccgcaccccgactccaatcccggcaccaaccctagctcccgaaggggcagaaccgcagaacacaaaattaacggaccaccggaacaggaagcaacagcagcggggcgcgggtgccgtacccttcactcattccgcccctgaaagtgaaacgtacccagatctacaagctactccactcgacttccataaataccactcctgcgattccaccttgcagttggaccggccgttgttgctttgcgtcttcgccaaaaacagaataagcttgtcttgctccgatcaggcgtgttcttaggcttcgctgcccctaccgcgtcttcgccgggatcggtccatggccggcgccgagcgcgcggaggcggtcgcgctggaacaagggctcctcgatccggaggaatccaaccaagtagtatacactggagatggatcagtcgacttttctggaaatcctgttgtcaaggaaagaacgggtagatggaaggcatgtccatt

SEQ ID NO: 56535 - protein, 52 aa, Zea mays
  misc_feature: Ceres CLONE 1497664
MAGAERAEAVALEQGLLDPEESNQVVYTGDGSVDFSGNPVVKERTGRWKACP

SEQ ID NO: 56536 - DNA, 660 bp, Zea mays
  misc_feature: Ceres CLONE 1497672
  misc_feature (322)..(322): n is a, c, t, g, unknown, or other
aaagctggagctccccgcggtggcggccgctctagaactagtggatcccccgggctgcaggaattcgcacgagaccattacctagaacatcctaatcgaaaaatcgcgataggcccgttcgcacgaatcactgctctgctttcaccccccgcatcgaacctcacccccgatctgatcgaatcgaaggctgcggcggcgatgggcggtgaccatggcggtgggcacgccggcggcgacttccgccagaagtatggagcatgacggggcggcccctactgccgcccccgtcactggcgccgtaacaccgccatcggcatgttcnggcgtcttcttcatctgcatccccatcggttttaaatcccccaaaactccaaggtacccaaaacttggcccctttttttcagggttggaaccttggttgcctaaaaaaaaagaaaacgcccccgatttcccccaagtcggggcaaacccctttctaaatggggggggggaaaaaacttttgggaaaaaaagaaaattctgaagggccccccccaccaaaacagaaaaaggggggggcaccctggctttttcccccccttttttgggagaaaccccggggcccccacctaatataggggggggtgaaaagttttagaaagacccccctccgggaaaggt

SEQ ID NO: 56537 - DNA, 658 bp, Zea mays
  misc_feature: Ceres CLONE 1497678
  misc_feature: Encodes the peptide sequence at SEQ ID NO. 56538
aaactggagctccccgcggtggcggccgctctagaactagtggatcccccgggctgcaggaattcgcacgagaccattacctagaacatcctaatcgaaaactctacctcgagctctactcgcataccactgcatgggtgttggggttcttgtatccctgctagtgatgaccctctcccacagccaccaagtctgctctgtccagagaatcaagtgccagtggtgaccatgctcacaattctttaccccaccatagccagaacattctagggagttgctggcctatatgaagcttgttccataatcatctcaggttctctggaggacatggttgctggagtgacttggccgtccatcttgccaccaggttggacagtcgagtgggaccctacctcggctgaggaggagcatgaggagtgatgggacaggcttccccatctctctgtttatttatcgttagttttattccgctgcattttgaacaatgatgactacttttgctaaaactctgatgatgatgtaataagtttaatactccttaatgtatggttttatgcttaaaaaaaaaaaaaaaaaagcttatcgataccgtcgacctcgagggggggcccggtacccaattcgccctatagtgagtcgtattacgcgcgctcactgg

SEQ ID NO: 56538 - protein, 30 aa, Zea mays; identical to SEQ ID NO: 51019
  misc_feature: Ceres CLONE 1497678

SEQ ID NO: 56539 - DNA, 656 bp, Zea mays
  misc_feature: Ceres CLONE 1497683
  misc_feature: Encodes the peptide sequence at SEQ ID NO. 56540
ggagctccccgcggtggcggccgctctagaactagtggatcccccgggctgcaggaattcgcacgagaccattacctagaacatcctaatcgaaaataacatggacagtgatgatgaagagtggatatcaagccggcagaaatccttagtaagagacaacaacgccacacttgagttggcagaagatttgtttgagagggttatggacaaactagagaagtttgcatatagccacgactctaatgaactcagcattgttcagatgaaggaactggagactgatgacctacctctggacattattgaagtgatacatgcatattggcaagctaagaggcagaaaaagggaatgccacttattcgacatttccagttcgctatgtggaaggtctacgagcaacagttacatgaatgggaatcgaaagtatgcagaatgcagggttcatcaaatgggtaccaaggaaaaaaaatgcctcccaagcctgcattgtttgccttctgtttgaggcctcgtggactcgatgtaccatacaagggaccaaagcagcgttctcataagaagcttatgtctacaggctgccatagcttttcaagacagcatgatggcttttaccggcaagtatcaggtaggagatacaatgaatgcactgtggatg

SEQ ID NO: 56540 - protein, 185 aa, Zea mays
  misc_feature: Ceres CLONE 1497683
MDSDDEEWISSRQKSLVRDNNATLELAEDLFERVMDKLEKFAYSHDSNELSIVQMKELETDDLPLDIIEVIHAYWQAKRQKKGMPLIRHFQFAMWKVYEQQLHEWESKVCRMQGSSNGYQGKKMPPKPALFAFCLRPRGLDVPYKGPKQRSHKKLMSTGCHSFSRQHDGFYRQVSGRRYNECTVD

SEQ ID NO: 56541 - DNA, 585 bp, Zea mays
  misc_feature: Ceres CLONE 1497684
  misc_feature: Pfam Name: SBP56 Pfam Description: 56kDa selenium binding protein (SBP56)
  misc_feature (218)..(218): n is a, c, t, g, unknown, or other
  misc_feature (239)..(239): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (256)..(256): n is a, c, t, g, unknown, or other
  misc_feature (257)..(257): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (281)..(281): n is a, c, t, g, unknown, or other
  misc_feature (284)..(284): n is a, c, t, g, unknown, or other
  misc_feature (285)..(285): n is a, c, t, g, unknown, or other
  misc_feature (290)..(290): n is a, c, t, g, unknown, or other
  misc_feature (304)..(304): n is a, c, t, g, unknown, or other
  misc_feature (309)..(309): n is a, c, t, g, unknown, or other
  misc_feature (338)..(338): n is a, c, t, g, unknown, or other
  misc_feature (344)..(344): n is a, c, t, g, unknown, or other
  misc_feature (436)..(436): n is a, c, t, g, unknown, or other
  misc_feature (437)..(437): n is a, c, t, g, unknown, or other
  misc_feature (448)..(448): n is a, c, t, g, unknown, or other
  misc_feature (484)..(484): n is a, c, t, g, unknown, or other
caagctggagctcacgcggtggcggccgctctagactagtggatcccccgggctgcaggattcgcacgagaccattacctagaacatcctaatcgaaaacaagcaacatggtgagatttttcaagaccgcggatggatcgtggagccatgaggttgctatctctgtgaaaccactgaaggtccgcaactggattctgccggaatgccaggatgaaacntggatttcgtcatctctcttnggggnnnnnnnnnnngnnggnnnnnnnnnggggggggggggnggnnggggngggggggggggggnggggnggggggggggggggggggggggggggggngggggngggggggggggggggggggggggggggggggggggggggggggggggggggtgggggggggtggggggggtggggggggggggggggggggnnggggggggggngggggggggggggggtggtgttttgttggttttggntggtttttgtgtggtgggtggtggttggggtgggtgtgtgggttttgtgtggtgttgttcttgttgttgtgtgggtgggggggggggggttttttgggggg

SEQ ID NO: 56542 - DNA, 660 bp, Zea mays
  misc_feature: Ceres CLONE 1497693
  misc_feature: Encodes the peptide sequence at SEQ ID NO. 56543
aagctggagctccccgcggtggcggccgctctagaactagtggatcccccgggctgcaggaattcgcacgagaccattacctagaacatcctaatcgaaaaatcttcacttcacttggcctaccagcagtccagcagagtttccgtctccccgactcccgagtcccgactgccggccctgacctgccctgcgccgcgcggagccgcggaccgcccgcccaccaccgaaaccctagagcaagcagggatgcacagtccggtcccgctcctcctcctcctgctcctctgcacggccgcggcggcctccgacggctcccagccccaggcgcaggcgcaggcacctggcgcggcacggcgggggatggtgccggtggcccccgcggaggcggagctcggcgccgtgaaggcgctcgccctcaacggcacgcggcgccggctcgggggcagcttccagctctgcgcgccctgcacctgctgcggcggggccagcggcgcctgcatcctcgcgccctgctgctactccatcaactgcaacatccccaaccgccccttcgggtactgctccttcacgcccaagtcctgccagtgcgtcggatgcaacctctgagctccgtggccgcgggattcattggattggattggtcagagtgtgtttgtgtgt

SEQ ID NO: 56543 - protein, 119 aa, Zea mays; identical to SEQ ID NO: 43768
  misc_feature: Ceres CLONE 1497693

SEQ ID NO: 56544 - DNA, 665 bp, Zea mays
  misc_feature: Ceres CLONE 1497695
  misc_feature: Encodes the peptide sequence at SEQ ID NO. 56545
  misc_feature (582)..(582): n is a, c, t, g, unknown, or other
  misc_feature (614)..(614): n is a, c, t, g, unknown, or other
aagctggagctccccgcggtggcggccgctctagaactagtggatcccccgggctgcaggaattcgcacgagaccattacctagaacatcctaatcgaaaaacctccgtgtgtgtggtttttcttcatcgtcgccacgggaatccagtgatcccggccgcaccgtctcgtccccagcgaagtcttgcgagtgggttaacaacgagttcttcaggcatgaacaatgccttccctattatcaaaggaactacacgaattcctgcggttggtcctggccctgcaaatccgccaggaggaaacctaccgatacccagcagcatgcctccgtgggccaagtgggtggccggggccgtcatacttgcgatacctatctacaggaggttcagaactttagaagatagagaagacggcagaggtggccatcgaggtggtcgacacggtggcggaggcggcggagaatgtcgccggcgaggtcgccggcgcgtttcccggcaacgacggtctcagggaagcggcctcgaagattaagacggtcgcggatgagatcgaggaagacgccgagaaagccgaggccctaatcgangaggttgacgagatcaagaaagaggttgattncattgtggatcctataatcgacaaggttgtcaagggacaagaatatagaga

SEQ ID NO: 56545 - protein, 174 aa, Zea mays
  misc_feature: Ceres CLONE 1497695
AGAPRGGGRSRTSGSPGLQEFARDHYLEHPNRKTSVCVVFLHRRHGNPVIPAAPSRPQRSLASGLTTSSSGMNNAFPIIKGTTRIPAVGPGPANPPGGNLPIPSSMPPWAKWVAGAVILAIPIYRRFRTLEDREDGRGGHRGGRHGGGGGGECRRRGRRRVSRQRRSQGSGLED

SEQ ID NO: 56546 - DNA, 596 bp, Zea mays
  misc_feature: Ceres CLONE 1497696
  misc_feature: Encodes the peptide sequence at SEQ ID NO. 56547
  misc_feature (218)..(218): n is a, c, t, g, unknown, or other
  misc_feature (303)..(303): n is a, c, t, g, unknown, or other
  misc_feature (304)..(304): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
ggagctccccgcggtggcggccgctctagaactagtggatcccccgggctgcaggaattcgcacgagaccattacctagaacatcctaatcgaaaaatcttcgcagtggtgacacccccatcccggggcacgaaaccctaactgaacccatggcgctctccgccgctcgccggctctccaccaccgcgtcctcctcctcccgtcgcgacgcgccgccnaagctttcttcgctgttccagaacccgaagcctcgaccgctgcctgtccgcggcgtcaaggagcccgcgcggggggccagcccanngcgagcaaccctggannngagagcgggggccctgctgctgcggctccccagggggagtacttcccggcccccgaccttttgtgggcccgccccctgtttaacccaacccttaaaaaccccccccaaaggggttcggggataaccacccaccccctcccccaaaagggttgtcggggaaagtttttaaaaaaccttcccctcgttgggggggccccccttttagccagaaaaaggttttttccctccaaaaaataaaaaacccttttctccaccctccggaaaaaaaaaaatg

SEQ ID NO: 56547 - protein, 98 aa, Zea mays
  misc_feature: Ceres CLONE 1497696
  misc_feature (52)..(52): Xaa is any aa, unknown, or other
  misc_feature (57)..(57): Xaa is any aa, unknown, or other
  misc_feature (58)..(58): Xaa is any aa, unknown, or other
MALSAARRLSTTASSSSRRDAPPKLSSLFQNPKPRPLPVRGVKEPARGASPXRATLXXRAGALLLRLPRGSTSRPPTFCGPAPCLTQPLKTPPKGVRG

SEQ ID NO: 56548 - DNA, 1170 bp, Zea mays
  misc_feature: Ceres CLONE 1497697
  misc_feature: Encodes the peptide sequence at SEQ ID NO. 56549
aaaacaaggcccccaggggtcacgcatgtacgcccaaatctcgccggcgcccggtcccagacgaagacaagcccccgccactcctctcggcacagtgcagacacaccgccgtcgccacctgccatgtctgcgcgtcgccggggtccatgcgtccatgttcgtccagctccagcggcagggtggtggtggtggtggagtggactgtggactggtatcctggcggggatcgggacggagcccgcccatggcaccggcggcccccgcgcggggtcgatccatctctaggccggcaggcatgcagttggatcccccgcctccatggccatccctcgctgccgcatggcacccgtgtgcgcccgcgtgctgtcagctggagctggtgcatgcatcccatcggccgcggctgcgcgcctcagctagtgttcatgcgacgcgaccgatggggggcgcgctggagatcgctgatgtgctgcagtgatctgaagatgctttttattcggatcggatgtacagtacagtagctgctctcgctgtgatcggttggagctgtccgagtgggacatggacagcgacggggagcgcactgttgcgggcatggcatggctatatggccgagatggacgtcccgacgggacgccgatcggtcatcgatcgttgcagcctgcaggcgcaagaagattgacccagagcccaggcacgaggcatctcgcgctgaccggcggcaggacggaatgggagtcgggtggccggaggaggatcggtccgccgaccgccggtctatggacagctatcgaggcctcgcctcaccgcctggcatttcgcttgagcttgacagcctaaaagcgacggcgctagtacgaatggtttttaacaagcgaaaagcctcaggttttgtctctatgataatctgttctttctttgcggcgcattcaatgagtcgggctctcgcaagttgcaactgtggttgatttgcagctgcagtagcagtagtacagccttccgcgttaatgcgtctgaattggttcaggttactgtgcctgcggcagctgctgcatgccacagcaaatgtaattagcagcagcagtgcaggcatcatggttcatggcggtgtacccgctaccgctggattgttttgaccgacccgtactaacaacaaaaaaaaaaaaaaaa

SEQ ID NO: 56549 - protein, 150 aa, Zea mays
  misc_feature: Ceres CLONE 1497697
MYAQISPAPGPRRRQAPATPLGTVQTHRRRHLPCLRVAGVHASMFVQLQRQGGGGGGVDCGLVSWRGSGRSPPMAPAAPARGRSISRPAGMQLDPPPPWPSLAAAWHPCAPACCQLELVHASHRPRLRASASVHATRPMGGALEIADVLQ

SEQ ID NO: 56550 - DNA, 650 bp, Zea mays
  misc_feature: Ceres CLONE 1497701
  misc_feature: Encodes the peptide sequence at SEQ ID NO. 56551
  misc_feature (650)..(650): n is a, c, t, g, unknown, or other
ggagctccccgcggtggcggccgctctagaactagtggatcccccgggctgcaggaattcgcacgagaccattacctagaacatcctaatcgaaaaaatttggatgtctgcttccaaccctgtctagctccttcggtccagcttcgactggctggcaggtaggcacacgcgaagcgataaggtcggctaagccgcgatgtcgccgcggccgccgtccctcgtggtgctcccgctcctcctccccctcctcctcgcgcctgtatcccacgctacggctaatgcggccggtgccagcgcccctcccccagtgccgacgccgtggccggagcagttccacgcggtggtcttcaccaatctcaccgagagcggcggccggctgcagctgatcgacctgtactacgactggcccaggggccgcaacctcaacctcatccgggaccagctctccagcgacccgctctacgacgtcgagtggaccaacggcacctcctacttcttcgactccgggtcctgccgcaccatgcgtttccccgtggggatcctgccgcctgactggctcgccgccggcgccgtctatctcggccgcgagcacgtcgacggcttcgactgccacctgtggaccaaggtcgacttcgtctggtactacgagn

SEQ ID NO: 56551 - protein, 151 aa, Zea mays
  misc_feature: Ceres CLONE 1497701
MSPRPPSLVVLPLLLPLLLAPVSHATANAAGASAPPPVPTPWPEQFHAVVFTNLTESGGRLQLIDLYYDWPRGRNLNLIRDQLSSDPLYDVEWTNGTSYFFDSGSCRTMRFPVGILPPDWLAAGAVYLGREHVDGFDCHLWTKVDFVWYYE

SEQ ID NO: 56552 - DNA, 680 bp, Zea mays
  misc_feature: Ceres CLONE 1497709
  misc_feature (396)..(396): n is a, c, t, g, unknown, or other
  misc_feature (407)..(407): n is a, c, t, g, unknown, or other
  misc_feature (454)..(454): n is a, c, t, g, unknown, or other
aaagctggagctccccgcggtggcggccgctctagaactagtggatcccccgggctgcaggaattcgcacgagaccattacctagaacatcctaatcgaaaacaagaactcgctcgcgcgcacggacagggccggaacccagggatcgagactgaacagcagtccgagacgccatgaacgtggaggagtaggtcgggaggctcaaggaggagatccataggctcggccagcagcagcccgatggctcttacaaggtcaagtttggcgtcctcttcaacgacgaccggtgtgcaaatatctttgaagcactagttggcaccttgagggccgccaagaagaggaagatcttgacctacgaaggcgagctgcttctgcaaggtgtccatgaacacgtgnagataaccctngtgcccccacctgcagttgctgccgcttgaagcgaagagcaccaccnaagtctcgattccatacactcgtatgcttgtattctgccgtgcctatattagattctctcgacccatttggtgtcccttgaaaacggctatcgggggattatggaaaattgtggtgcctcagaaatggccttgcttggcaaaaaaaaaaaaaaactttattcgaaccctctaaccctcgaggggggggcccgggacccaaattccccctatatggggggtctttaa

SEQ ID NO: 56553 - DNA, 668 bp, Zea mays
  misc_feature: Ceres CLONE 1497715
  misc_feature: Encodes the peptide sequence at SEQ ID NO. 56554
  misc_feature (372)..(372): n is a, c, t, g, unknown, or other
  misc_feature (446)..(446): n is a, c, t, g, unknown, or other
aaagctggagctccccgcggtggcggccgctctagaactagtggatcccccgggctgcaggaattcgcacgagaccattacctagaacatcctaatcgaaaagtttcgcgggctctcgagtctggagggccgaaccgccgccccgcgattcccagcccaccattgtattatggggtgcggtaggtttccgattccttctgcgcttttcacggtgcccacccagcgtgcaacctaggcgagaaccgcctccccctccgctccttccagctcgctctgtaatctgcatcagcctcgcccgccgccgtcgccgccatggggaggggaaagttcaaggggaagcccacaggccgcccgcacttctcccacaccgangagatcgctgctggtactttcagtcggccacgcaccttttagaagaaggagggaagagagatggaggaagagtngaaagagaagagtctgaagaagaatctgaagaagattctgattgaaaggactaaccttagggccctgagggtattatccaattggaaatcaaactttgggaaagccaaaaattaaagccaaggaaagttaattttgcaaaaaaaacttgaccttcaaaggcgtgaaaaaaagaactttgaaaaaccaaaaccttggaaagttttttaaacttttccataccc

SEQ ID NO: 56554 - protein, 33 aa, Zea mays
  misc_feature: Ceres CLONE 1497715
  misc_feature (20)..(20): Xaa is any aa, unknown, or other
MGRGKFKGKPTGRPHFSHTXEIAAGTFSRPRTF

SEQ ID NO: 56555 - DNA, 670 bp, Zea mays
  misc_feature: Ceres CLONE 1497717
aagctggagctccccgcggtggcggccgctctagaactagtggatcccccgggctgcaggaattcgcacgagaccattacctagaacatcctaatcgaaaaaaccaaagtggaggagctccttctccctcccccaacatcggatgtgcacgatacttcacaccgagcgtcgccccctcctatagaactccccaccctcaccccggcacgccctcctccatctgagtagcagcaagtgctgatcagagtcacttcttcaccgtgggtgggcgagagatagtgctgaagcaggcgacaaccgaatgccccaagaaggttgcggggctgaaggatttggtgaacctactgacccacctgcaagagtttgacagaggtcggttgtcacacccggatttagaacgaacatccttcttatggagtttaacacttgctgcggtttctcccgactcaagcttcatcaccacgagtccgtggatatctagaagaggtagagcaatgggtcttctccttaattgctttgcatgcttgttcctttcttttgatcctagcgcttgatgctcattcaagaatttgctttcttatgagctgaaggcgtcagcacctgaagatatattatctaaatgtgcacgtgtgacataaggatgttcacatgacttataacttgatattgc

SEQ ID NO: 56556 - DNA, 642 bp, Zea mays
  misc_feature: Ceres CLONE 1497801
  misc_feature: Pfam Name: Pre-SET Pfam Description: Pre-SET motif
  misc_feature: Pfam Name: SET Pfam Description: SET domain
  misc_feature: SWISSPROT Homolog: EC 2.1.1.43 Histone-lysine N-methyltransferase
ggagctccccgcggtggcggccgctctagaactagtggatcccccgggctgcaggaattcgcacgagaccattacctagaacatcctaatcgaaaatactaatcaggtcaaatacttgaggcctctcagttctatgaaaaagttgcagggctgtggatgccagagcgtttgcttgcctggcgacgccagttgtgcttgtggacaacataatggaggcgatttacccttcagttcatcaggattgttgtcatgccgcaaaccaatagtctacgaatgtggtgaatcttgcaactgttctacaaattgcaggaacagagtgacccaaaaagggtccaggctacatttcgaggtcttcaggaacacaaatcgaggctggggtccttcgctgctgggaacctattcgtgctggttcatttatatgtgagtatgccggtgaagctattgatgagctcaaattttacttggatgataggggaagatgaatacatttttcaaactggattgccctggccagaagaactttaaaatggagattttggaccctgaaactgattggggtgaagttagccccttttggtttcgccccgatgaaatttgaaacccactggcctggccaagaaaaagtggcaaaaaaacttggga

SEQ ID NO: 56557 - DNA, 644 bp, Zea mays
  misc_feature: Ceres CLONE 1497824
  misc_feature: Encodes the peptide sequence at SEQ ID NO. 56558
ctccccgcggtggcggccgctctagaactagtggatcccccgggctgcaggaattcgcacgagaccattacctagaacatcctaatcgaaaataaagacaaggtctaattactcggctctcttgctcggctacgccagtggccagaggcccagagcttcgtcaaagaggcgccgaaaatagggggaggcgactcggccgaggtccagttccgaactccggtcctccgatttgcacgtccggatctgccagtcatggcatcctcttcggacccgtggatgaaggaatacaatgaagcatccctacttgctgatgacttctgttccatgattgctgatctagggtcccttccacaatcaggtccaaaaattatgcggcatacttctgccatccggagaaaaataactctctctgtgggcactagactggatagcttggagtctcttgcttgacagaattcctccaaagtctatgtatgtcctattgcaactacttctgagattctgtgatagttatgatgtgtagtgcttgcagggacgccctacttgatatctgcaagccagatgcttaccaatgaaccagatatctgttgaatcttggagaacttgtctgtactaacagacaaaattgatagcttatcgatacc

SEQ ID NO: 56558 - protein, 65 aa, Zea mays
  misc_feature: Ceres CLONE 1497824
MASSSDPWMKEYNEASLLADDFCSMIADLGSLPQSGPKIMRHTSAIRRKITLSVGTRLDSLESLA

SEQ ID NO: 56559 - DNA, 619 bp, Zea mays
  misc_feature: Ceres CLONE 1497901
  misc_feature: Encodes the peptide sequence at SEQ ID NO. 56560
gatcgctccttatggatcccccgggctgcaggttccccacgagaccattacctagaacatcctaatcgaaaaactgcgactgtgagcttcgttcgttcagttcatccgtgttcttgtttgcgaggtcgagagagagaggatgtcgtgctgcagaggcaactgtgggtgcggctccggctgctagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgagaacggctggtgcaagtgcggcggcaactgccagtgcgacccctgcaactgcggcaagtgagctacgtgctccaccctgcaggccggccggaggaagctagctaattattataagctaaataaagtatagcggcgtcgctgtgtgtgtttcgagtcagtcagtcagttagttgcgtgccatggctggcatgctctgagtctgagatgatgatgatgcctgatgggaggggtcctgtcctggagtacccccctgccccctcggggggcttctgggggcgagcagtggtgttgt

SEQ ID NO: 56560 - protein, 57 aa, Zea mays
  misc_feature: Ceres CLONE 1497901
  misc_feature (1)..(55): Pfam Name: Metallothio_2 Pfam Description: Metallothionein
MYPDMAEQVTTTTQALIMGVAPSKGHAEGGFEAAAGAENGWCKCGGNCQCDPCNCGK

SEQ ID NO: 56561 - DNA, 678 bp, Zea mays
  misc_feature: Ceres CLONE 1497937
atagctggagctccccgcggtggcggccgctctataactagtggatcccccgggctgcaggaattcgcacgagaccattacctagaacatcctaatcgaaaaagttacgaagttcggtttcatactctcacttctatgtctcttcctatctcggtaacaaaaggtttcgttctcaaatcttatctattaggcacatatcacaatacacctcgctccgacctaaattcactccttattccacatgataacattcatttcctgaatctgttacataaactcctctcgaaacaggaagaaatctccccgttccaacaagaaaaattggttctaaacagaatgatatcaagagcttcacactatcatcacagcccaaactttgtgtaaaaagaagagatttacctagctccccatcaaacatgtatatgtgacacaaaatgctaccgagaaatatccccagacgaaacacataccagcgcagcacaacctacccgctgagagactagtaaaaacaaactcatcgactacacctcataacctcttcacagaaaatcctgatttctgcaaatctaggtaaagaagaagccggttgcttactgatctttcgggcgttacgagaccaacttcaggtaacaagagaaagctgacagattcctcgaaaaaaaacacaaccccctatcg

SEQ ID NO: 56562 - DNA, 646 bp, Zea mays
  misc_feature: Ceres CLONE 1497943
  misc_feature: Encodes the peptide sequence at SEQ ID NO. 56563
tccccgcggtggcggccgctctataactagtggatcccccgggctgcaggaattcgcacgagaccattacctagaacatcctaatcgaaaaactgactccgctgctcctcccaaatatatgtgggccgcgactgacgatctgctctgctccatggcgacgcaccgccactagggtcaactcctcctcctcttggcttccgacctcacccgactcactgctatcccgacggtttgacgccggtgatgcccgctgctggggggggggaacccgatgcttgacgcgtgctactcgactgtcctgcaccctggaacgcggtctctccgtcaggcctctctgcaggggacttgacctccaaccccgacacctacgacctcttcctcgaccacaccatcacgtctgagctcgccctgggtaccggttctgcggcgacaagcggcaccccccaagggtccccctggccgagagctacctccattccagagcctcgcttgaaccaggacacggtggatgggcgtcctaaaaccaggtggccatgatcgcattgggatccttccgcttaatggagggggcacaaacggacgggtgtccccaaggtggccggcaaagggctactccggggaggggtcggcaattgagtatcataaa

SEQ ID NO: 56563 - protein, 46 aa, Zea mays
  misc_feature: Ceres CLONE 1497943
MGVLKPGGHDRIGILPLNGGGTNGRVSPRWPAKGYSGEGSAIEYHK

SEQ ID NO: 56564 - DNA, 675 bp, Zea mays
  misc_feature: Ceres CLONE 1497945
  misc_feature: Encodes the peptide sequence at SEQ ID NO. 56565
aaagctggagctccccgcggtggcggccgctctagaactagtggatcccccgggctgcaggaattcgcacgagaccattacctagaacatcctaatagaaaagtcatcgattcagagctcacgagtcacgatccaaatcccttttccactccgccggacgtcgagagaggcggtgggtgcgggacgcgaaggcgaagccctagccccctccctgccgcggacgccgatggacccacctcgcgccgtcgcctttcttctcatactcctgcccgtgctcgccccggtggcctccggtgtacctttcgtcgtcctacacgggattggcgacgagtgcgggaacgatgggctgtcatccttcaccaagatgcttggggagtggtcaggctccaagggttactgcctgtgcattacgcgaacggtatttcggatccgacgcgctacactctccgcttgactcccttccataggggagaaaaagccaaggccccgtggcagacgagaaggggggctcgctggcaccctcacacgtaccccgaaggccttccccttagacggcgaacgccccaccgcaaaccaatggggagggaacttgacttctcaggaatcataggggcgtacacccggagccgaaggcctcccacaggtttccccacaaaaccccaggacccccgcccc

SEQ ID NO: 56565 - protein, 75 aa, Zea mays
  misc_feature: Ceres CLONE 1497945
MDPPRAVAFLLILLPVLAPVASGVPFVVLHGIGDECGNDGLSSFTKMLGEWSGSKGYCLCITRTVFRIRRATLSA

SEQ ID NO: 56566 - DNA, 533 bp, Zea mays
  misc_feature: Ceres CLONE 1497947
  misc_feature (366)..(366): n is a, c, t, g, unknown, or other
  misc_feature (367)..(367): n is a, c, t, g, unknown, or other
  misc_feature (491)..(491): n is a, c, t, g, unknown, or other
catagctggagctccccgcggtggcggccgctctagaactagtggatcccccgggctgcaggaattcgcacgagaccattacctagaacatcctaatcgaaaaaggatttggcggacgggcgattgcacgcccgtgacttcgaccccgacgtcccttcccaactcgtccaccgccgccgcccgccgtcgcaaaactcgccagcggccagccatggggggacacgaaaggaaccaggttttttccccggcacccttccccaaaaagctttaagatggatttttccccggggcctccaaaacccccccgggtgggggttgtacaaggggggaggaaaaacaggggccccaaaaatgtttggtgggggnncctttttttttaagagggggtccttcctttcaaaaaaaaaaatttttttttctctttgggggggagagaaaaaaaaaaccccccccccccacaaggggggggtaggttgtttcccccccccccncccctgtgtgggggggggggggggcccccccaaaaaaaataa

SEQ ID NO: 56567 - DNA, 669 bp, Zea mays
  misc_feature: Ceres CLONE 1497948
  misc_feature: Encodes the peptide sequence at SEQ ID NO. 56568
  misc_feature (424)..(424): n is a, c, t, g, unknown, or other
catagctggagctccccgcggtggcggccgctctagaactagtggatcccccgggctgcaggaattcgcacgagaccattacctagaacatcctaatcgaaaaattaatggccgctccctcgctatcccctttgtcgtctcgtctcgcccccttccggcttaaccctcaagatttctccctccctcctcctccttcccgcttgggcgggcgcgggcgcggcaccttccggtttccggggcctcgggcctcggcctcctatatatatacacgcgcgcggccgtctcctctctatactccctagcatgctcggctcgctccccggattgatcgagctcgctcgttgcagagatggacccggtgcctgccccctcctcttctcgccgggccgccgctgctcccggcccctgctgccgctttgacacnctgcggcgggcgtgcgccgggaacgccgccgccgccgcgcgggccgccggggtgggcgatcggcgcgctgctcacctgcatcttcgccgtcgtgggctcacctctcggaatcttcattggggccttccatggggatgtctacggaaaagcggcattgttccgcgggggctggggttggaacagttttctggaacagtctttctccataggagggccggtgaaaggcccggcaccaaggatttggg

SEQ ID NO: 56568 - protein, 106 aa, Zea mays
  misc_feature: Ceres CLONE 1497948
MDPVPAPSSSRRAAAAPGPCCRFDTLRRACAGNAAAAARAAGVGDRRAAHLHLRRRGLTSRNLHWGLPWGCLRKSGIVPRGLGLEQFSGTVFLHRRAGERPGTKDL

SEQ ID NO: 56569 - DNA, 656 bp, Zea mays
  misc_feature: Ceres CLONE 1497951
  misc_feature: Encodes the peptide sequence at SEQ ID NO. 56570
aaaagctggagctccccgcggtggcggccgctctagaactagtggatcccccgggctgcaggaattcgcacgagaccattacctagaacatcctaatcgaaaatcggttacagccgccgtcctacgccaggtcccaggtcttcgtcgggcccgtctccggcaacgagcaccaacaagatttttgtgtgtaaagatttgcgagcaccattcactttttcatcagtgtgaaattaaaacacttcaagcatgagctctcaccgtgtgaagtggaatgaggacaatttgtatgaaattgagtcaaacaaaccggtgaggcagaagataacagagccaaagacaccatatcacccaatgatagatgatgatggatcattgtcgccaacacgtcctttcgacaaatgtcttgatgagactgtccaggctgaagctatcttaacagccttaaatggtgtggcttcttcaagcattagcatttcaaaggatgatggttggggatcgtcagatgatgatacagatgccatagatcaagatgctgaccctggagctgacaccaacaggttgaattttcaaggatcatcgccgtgcccccctacaatgagtaccctaagggttaaaggacctgaagaaggactgggatcccttacctgcctgaggaa

SEQ ID NO: 56570 - protein, 136 aa, Zea mays
  misc_feature: Ceres CLONE 1497951
MSSHRVKWNEDNLYEIESNKPVRQKITEPKTPYHPMIDDDGSLSPTRPFDKCLDETVQAEAILTALNGVASSSISISKDDGWGSSDDDTDAIDQDADPGADTNRLNFQGSSPCPPTMSTLRVKGPEEGLGSLTCLR

SEQ ID NO: 56571 - DNA, 678 bp, Zea mays
  misc_feature: Ceres CLONE 1497957
  misc_feature: Encodes the peptide sequence at SEQ ID NO. 56572
aagctggagctccccgcggtggcggccgctctagaactagtggatcccccgggctgcaggaattcgcacgagaccattacctagaacatcctaatcgaaaaatcgctccacccccacccccttctctctcgtagcaacgtttggggcgccgtcgctgccgctctactcgggtgcccaggtcttgttcgggcccttcgccggcgagccaggggacactttctttggtatgagaggatcaatgtccaattattatgatgattacgacgacattgatgagattgaggatgactatgatatggatgatcctgctgatgacatggtagacgagcagcgaggggttagggattctgatgcggaggataatgattatggacaaccaaatgacaagatcccagatacttcatcagcagatgcaagaaatggaagggacattcaaggaattacctgggagcagctaaacataacccgtaaaaattattagacagtccaaattagaacagtacaaaaaattatgaaaatggtcctaaacccctgggggaaaagcctttgaaaggttcgcggtccaacaaaaaaaaggtgggatggttcttttgagtttcggacggaaaacactcggatggatttaaggccaacctattccttgcatttttccagcctttcaaatattgtgggggcggg

SEQ ID NO: 56572 - protein, 80 aa, Zea mays
  misc_feature: Ceres CLONE 1497957
MSNYYDDYDDIDEIEDDYDMDDPADDMVDEQRGVRDSDAEDNDYGQPNDKIPDTSSADARNGRDIQGITWEQLNITRKNY

SEQ ID NO: 56573 - DNA, 647 bp, Zea mays
  misc_feature: Ceres CLONE 1497964
  misc_feature: Encodes the peptide sequence at SEQ ID NO. 56574
aaagctggagctccccgcggtggcggccgctctagaactagtggatcccccgggctgcaggaattcgcacgagaccattacctagaacatcctaatcgaaaacactccaccttggccgctgttctcctcaccgcgcgtgcgctctctctctctctctctcggcgccgactcggctaccgccgccgccctacggaagcttcccaggtcttcgtcaggcttttctccggcaacgagcaccctgcacagatcgtgaacctgcacacctcaacgatagatggcggggttcagaagccttgcacccaagaccaggaacctggtggtggccgggggactgtctgccttcgtgctcggggtctactactacaccatgagagcggtgggaggcacggacgagctccaggtggcgatcgacaagtttgaggagacgaagaagcaggatgccgctagaaactctagctccgcgcaggaggatcataattcataaacacgcggacacgccctggatctgctggcagctgacagggtagtgggaccacgacggtcacgtcgctccagaggccatgaccatgcgttcctgcttgtactggggaaataaaaaaatgaggggttaagggaacccttttaccggggaaaaacttgggcagctt

SEQ ID NO: 56574 - protein, 69 aa, Zea mays
  misc_feature: Ceres CLONE 1497964
MAGFRSLAPKTRNLVVAGGLSAFVLGVYYYTMRAVGGTDELQVAIDKFEETKKQDAARNSSSAQEDHNS

SEQ ID NO: 56575 - DNA, 841 bp, Zea mays
  misc_feature: Ceres CLONE 1497972
  misc_feature (22)..(22): n is a, c, t, g, unknown, or other
  misc_feature (841)..(841): n is a, c, t, g, unknown, or other
ggtgggggtgggttgggtgttnttatgcaaaataactatcggcggggggcgcgggggcggcttgctggagctccaccgcggtggcggccgctctagaactagtggatcccccgggctgcaggaattcgcacgagaccattacctagaacatcctaatcgaaaactttttctatgtcgagttacgtccctccctacccagagatctaggccgccgcctctcctactgcatctccctcgatctcgtcgcctcgttcgcttagcctcctcgccgccccgccccgagccgagcagagcgcagccctatccggagctgggatggcggacgcaaagcacctgcaacagcagccacgtgagggcggtagcggccgccaccggcgatggggaagacggtcaagccacttcgttgacggcgaggccttgtgggaatgcttaaaaacctgccccataccggcgcatgggacatgggtccaagggacggggagcctcaccacccccccccgcccacaacggactctccatcctgaggtggtgcagccgagatgagacttgggtgcatcgacggggtaccccgggccgggcggcggggggattacatttgtatacgggaatttggggcgtttgctgggcctcgcgggggaacccatgcccacgcccagcactggctctggccccgccgcggaggtttggcccccctgttttcggggcccgggattgatttatgcgaatggcgggcgggatggtcccctcgggcgggtggagcgtcgtggaaatgtgctaccctaaggcggatggcccgagcgaagggccttcttcgcgacgcccgcacggtagcgcttgcctn

SEQ ID NO: 56576 - DNA, 655 bp, Zea mays
  misc_feature: Ceres CLONE 1497974
  misc_feature: Encodes the peptide sequence at SEQ ID NO. 56577
aaagctggagctccccgcggtggcggccgctctagaactagtggatcccccgggctgcaggaattcgcacgagaccattacctagaacatcctaatcgaaaacaagtcctgtcaacagcgtgctcgagattataagcacaaggaaatacaaggaaataagagtacagagatgccaactggtaggctgagcggcaacatcacccaggactgggagccggtggttctgcgccgtacgaagccgaaggcggcggacctcaagtcgtcgaaggcggtgaaccaggcgctgcggtcgggcgcggccgtggagacggtgcgcaagtcagcagcgggcatgaacaagcactccgctgcggtggcgcccgcgcgtaagctggacgagacgacggagcccgctgcggtggaccgggtggctgtggacccccccgcggccattcagaaggcgcgcgtggccaagggatggagccaggcggagctggcgaagcgcatcaacgagcgcgcgcaggtggggcacgagtacgagagcggcagggcggccccggcccaagccgggctttgccaagatggagcgcgcccccgaaggccagccccgtgggaagggcggcggcgcccccacggggggccggcggggtaagggaacccgaatctcccaagtgaa

SEQ ID NO: 56577 - protein, 153 aa, Zea mays
  misc_feature: Ceres CLONE 1497974
  misc_feature (12)..(80): Pfam Name: MBF1 Pfam Description: Multiprotein bridging factor 1
MPTGRLSGNITQDWEPVVLRRTKPKAADLKSSKAVNQALRSGAAVETVRKSAAGMNKHSAAVAPARKLDETTEPAAVDRVAVDPPAAIQKARVAKGWSQAELAKRINERAQVGHEYESGRAAPAQAGLCQDGARPRRPAPWEGRRRPHGGPAG

SEQ ID NO: 56578 - DNA, 675 bp, Zea mays
  misc_feature: Ceres CLONE 1497976
  misc_feature: Encodes the peptide sequence at SEQ ID NO. 56579
  misc_feature (675)..(675): n is a, c, t, g, unknown, or other
ccaaactggtgctccccgcggtggcggccgctctagaactagtggatcccccgggctgcaggaattcgcacgagaccattacctagaacatcctaatcgaaaaattccccgccgcctcgcgcccccgctcgcttcacttctctaggtgcgcaccgatcagaaggtgcctgcctcctcctcgtcggcgaaaagatggcggtgccgctgctgacgaagaagatcgtgaagaagcgggtcaagcagttcaagaggccccacctcgaccgctacaagtgccttaagccaagctggcgcaggccaaagggtattgattcccgtgtcacgaggaagttcaagggatgcactttgatgcccaacattggttatggttctgacaaggagaccaagcactacctccccagcaagttcaagaaggttgtggtcggcaacgtctctgacctggagttgctcgtgatgcagagcacgacctagtgcgctgaaattgatcacaacgggtccccccaggaagcgcacggagatcctgggagcgtggctacaacaggtcgacaatgaggggggccaaacaggctgggctaggggtcgccacgccgggaggaacaaaccgtgccagcctgcttgggttaaacggggggatccggaatggggggggttccctttcgggcggggggaacctcn

SEQ ID NO: 56579 - protein, 92 aa, Zea mays
  misc_feature: Ceres CLONE 1497976
  misc_feature (14)..(93): Pfam Name: Ribosomal_L32e Pfam Description: Ribosomal protein L32
MAVPLLTKKIVKKRVKQFKRPHLDRYKCLKPSWRRPKGIDSRVTRKFKGCTLMPNIGYGSDKETKHYLPSKFKKVVVGNVSDLELLVMQSTT

SEQ ID NO: 56580 - DNA, 714 bp, Zea mays
  misc_feature: Ceres CLONE 1497983
  misc_feature: Encodes the peptide sequence at SEQ ID NO. 56581
ctagctggagctccccgcggtggcggccgctctagaactagtggatcccccgggctgcaggaattcgcacgagaccattacctagaacatcctaatcgaaaaccattcattcacacaccacacctcccgaactacaagtttcgcttctcgtcgcgatgactgggcgagaccgccgccgccgcctgagttctgtagaaatggctgatggtgaggacatccagcctcttgtctgcgacaatggcactggaatggtcaaggctggttttgctggcgacgatgcaccaagggctgttttccctagtattgttggacgtcctcgccacactggtgttatgggagggatgggacagaaagatgcgtatgttatcaacaaaacacattccaagagaggtattctcacggctcaaatttccggggggccccccccctttgggagcaactggggatgacatggtagaaaatcttggcattcccacttttcttcaaaacgaggctttcgtggtggcccccaaagggagccaccctgggttggctcaactgtaagcttcctcttgaaccccaaaggggccatctggggtagaagatggtccccctattattgcttccgaagacttttcaaacggctgccaagcctttgtgaaccttgacaaatttccaagcaaagaggctgtgcccctcggtggtggcgttgggggcgcgacctctcggctactg

SEQ ID NO: 56581 - protein, 83 aa, Zea mays
  misc_feature: Ceres CLONE 1497983
  misc_feature: SWISSPROT Homolog: EC 2.7.10.2 Non-specific protein-tyrosine kinase
MADGEDIQPLVCDNGTGMVKAGFAGDDAPRAVFPSIVGRPRHTGVMGGMGQKDAYVINKTHSKRGILTAQISGGPPPFGSNWG

SEQ ID NO: 56582 - DNA, 656 bp, Zea mays
  misc_feature: Ceres CLONE 1497984
  misc_feature: Encodes the peptide sequence at SEQ ID NO. 56583
ctggagctccccgcggtggcggccgctctagaactagtggatcccccgggctgcaggaattcgcacgagaccattacctagaacatcctaatcgaaaaagcccattcgccgtccgccccgcctcttcctgccgccgagcgccacgaggcccacgcccgcgatggcgactatcacgacgccgctccgctccgctctgttctctccggccgcctcgtccgcgggccgccaccgcgggggccggcgccgcgcgccctcctccgtgcgctgcgacgcctccccgccctcgcacgccgcggccgcctcgctcgacccggacttcgacaagaaggcgttccgccacaacctcacgcgcagcgacaactacaaccgcaaggggttcgggcacaagaaggaaacgctcgagctcatgagccaggagtacaccagtaagtaaagtcgtactgctatgggttacaggcaagcaggcacggaggagcctggtgttttgtgtttccccccctccctcttccagaacattgatggggggggccgattcgaattgggtttcgcaggcaacttcttccagaaccgcccaggaaaacggccaccagtacacctgggggccccgtccccgggaagttcccggaggcctaccggtttctgcctggggcgtccta

SEQ ID NO: 56583 - protein, 90 aa, Zea mays
  misc_feature: Ceres CLONE 1497984
  misc_feature: SWISSPROT Homolog: EC 1.17.1.2 4-hydroxy-3-methylbut-2-enyl diphosphate reductase
MATITTPLRSALFSPAASSAGRHRGGRRRAPSSVRCDASPPSHAAAASLDPDFDKKAFRHNLTRSDNYNRKGFGHKKETLELMSQEYTSK

SEQ ID NO: 56584 - DNA, 874 bp, Zea mays
  misc_feature: Ceres CLONE 1497986
  misc_feature: Encodes the peptide sequence at SEQ ID NO. 56585
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (428)..(428): n is a, c, t, g, unknown, or other
  misc_feature (443)..(443): n is a, c, t, g, unknown, or other
  misc_feature (502)..(502): n is a, c, t, g, unknown, or other
  misc_feature (503)..(503): n is a, c, t, g, unknown, or other
gtttgaactatgtggggacnnnnnaacaaaactccttttnnnnnnnttgnnnnnnngcaaactgggagctcccgcggtggcggccgctctatactagtggatcccccgggctgcaggaattcgcacgagaccattacctagaacatcctaatcgagaaattccccctcgatcggcctccctcccccaagatcctccactcgatcccaaacaaaccaacaaatccatccatcgcagatggacgcgttcttctcgggctcctccgcgtcggcgccctacggctacggcgccggcggatggagctacaactcggtcaagaacttcggccaggacacccctgccggccagacccccctggggctgggggtacctcacccggtgcagcggggcgtggcctcggtggggaggtggggagaataaccatgaacanaaaacccggaaacancacgcgcaggacgagcgaacagagggcgtagggtgctatgggggaaaaaatccataatnnacccccccccccccacccccggtgtgtcgcttgggtttgtgtaacatgtctctccgaccctgcaataaaaggcagagcgcggagccctgccccgaaatagccgctcgtgcgggcgcggatctccccaggaaacagaggtgtggctcgtgggaaacttggtggagggcgagggcggtcgacgcgtggcgcccgaggtggatctaagggctgggtgcgctctcttgcgtgcgggcacggagggaatggccatgtaggcgaggcgtcccccagcggtcggtgttcgtgagcgcgcgcaggtggcacgagcagctccgtttcgaggcgtactcgcgggtgcgggtggctatcgtgcttacggtgcctcgtactgt

SEQ ID NO: 56585 - protein, 60 aa, Zea mays
  misc_feature: Ceres CLONE 1497986
MDAFFSGSSASAPYGYGAGGWSYNSVKNFGQDTPAGQTPLGLGVPHPVQRGVASVGRWGE

SEQ ID NO: 56586 - DNA, 669 bp, Zea mays
  misc_feature: Ceres CLONE 1497988
  misc_feature: Encodes the peptide sequence at SEQ ID NO. 56587
cataactggagctcaccgcggtggcggccgctctagaactagtggatcccccgggctgcaggaattcgcacgagaccattacctagaacatcctaatcgaaaaacgagcccttctcgtcctcagatctagcgcctccttcaccctgctgctggccggcgagctcctcagcgtgcttgtgatgataatgccacaacatcttctacaagcaagatcaggaagaagacaaaaaaacgttatagtgaagaggaggggttgattgctgcattcaaaagtgtcggggataccttatccaatgctactgagaaggttgccacaggggacaccagatgatcttttttgatagctcgataaacctttcaggttttgaacataccaacatatctctgtatatcaattatctggtggcgcaccctcacattgctagagccttcaacaatttgccattcgaccacaaggtaatctgggctcgcaatctcgtcagtgaaaagtctctaggagtgtgagggaagtgggtagtaaggcttggaagggttcttttgcttggaaccacattggacaatgaactggaaatctatctggaaccaggagtgtggaggcccattagttttataaggccttggacgggtccttattgctggaactaccccaaaaaaagagaaggtgggtct

SEQ ID NO: 56587 - protein, 58 aa, Zea mays
  misc_feature: Ceres CLONE 1497988
MIFFDSSINLSGFEHTNISLYINYLVAHPHIARAFNNLPFDHKVIWARNLVSEKSLGV

SEQ ID NO: 56588 - DNA, 701 bp, Zea mays
  misc_feature: Ceres CLONE 1497989
  misc_feature: Encodes the peptide sequence at SEQ ID NO. 56589
atagctggagctccccgcggtggcggccgctctagaactagtggatcccccgggctgcaggaattcgcacgagaccattacctagaacatcctaatcgaaaaaaagcggcgatggcagcggagaagccggctccggtgcgcgtgctgtactgcggcgtctgcggcctcccggccgagtactgcgagttcggccccgacttccagcgctgcaagccctggctgcgggcgcacgcgcccggcgtctaccccgacgacctcgtcgccggtccctcctcgtccggcggtgcgggtggcgacagggacgtcgactaggtcggggagcgcctccagggcgtcgggatctccgacggctccagcaccgccccaggggatgcttcctcctctaagcccgaagaggtcaaacgcctgcctggtggtaagctcccgaaaaacgaaaagcaagaggttgtcatcggagaagattgtccgcaacaagcgcaaatgtgttactgtgggtgaagggactggaattgtttgggtgtaaaggctgagtgatggcttcaaagaagcctgggggaagaagttttggcaaccgggagctttctggttggttaacggggcccgcaccgagaagggaaccagtattcgacggtgccaagggggaacatattccctttgaatttttggcgggaagttcaattaacgggaaccccttggggccg

SEQ ID NO: 56589 - protein, 66 aa, Zea mays
  misc_feature: Ceres CLONE 1497989
MAAEKPAPVRVLYCGVCGLPAEYCEFGPDFQRCKPWLRAHAPGVYPDDLVAGPSSSGGAGGDRDVD

SEQ ID NO: 56590 - DNA, 685 bp, Zea mays
  misc_feature: Ceres CLONE 1498020
  misc_feature: Encodes the peptide sequence at SEQ ID NO. 56591
aaagctggagctccccgcggtggcggccgctctagaactagtggatcccccgggctgcaggaattcgcacgagaccattacctagaacatcctaatcgaaaaaagtgcagatcacactagcctacacacaccgagcgccgtctaaactgacagcaggtcagcagcctagcgaagccaagacatccgccgatctcagatggccgggagaagggtgcgcggcaagagtgccgtggccgtggcggccgtcgcgctgctggcgctgctcttcgcggcgagcgaggccgacgggacgtgcaacgtcgaccggggcacggtgctgaggcagtgcgcgtcctgctcgagcggcgcgccgagccaggggcgctgcgacgcgctgaggaacgccgacttcggctgcctctgcagcaactactggaacaagctcaagaacacgccatacgccagctgcgccaaggccatcccttccgcgtgcaacctcccaaacgccaagtgccagtagatggagacatggagtgcgtgacccggacagcgaacgggcagcttggaccaaacagaataaatccgcttcattaccctgtttcttcctcctctgagtgtgttagttctttgctttgagtcgttatccgatatgatcggctgccctgctagccggcgggacgttctatatatgtctttgcaactaaaa

SEQ ID NO: 56591 - protein, 100 aa, Zea mays
  misc_feature: Ceres CLONE 1498020
MAGRRVRGKSAVAVAAVALLALLFAASEADGTCNVDRGTVLRQCASCSSGAPSQGRCDALRNADFGCLCSNYWNKLKNTPYASCAKAIPSACNLPNAKCQ

SEQ ID NO: 56592 - DNA, 867 bp, Zea mays
  misc_feature: Ceres CLONE 1498041-R
aattgggtaccgggccccccctcgaggtcgacggtatcgataagcttttttttttttttttttcccagtccacccgaataattaagccaaaactgtaaccaaaatacagctaaattacattcgaagttcctcgcacataaaaaaaatgggaacaaattgaaggccactcacatttggacggagcgggggaaggaacagtaaaattttgcaagtacaagtctatgtgctgtgggaagctagcttgcctgtcatcctcatgtctatctcttcttctagaacacaaaacacaacctagcctatgcccccttgagtttgcgtgacggaggccgccggaatatgttaatgaggtcgtcgacaccccgtgtactgattactaggaaacagaagagaacgatcaggtaggaacccagcaccagaaggaacagcagatcaaaggtaacacttgcaacctggtacacatttagagtcgctttagttgtatcatagaaagtgaacatgccttcaagcgcatcactttgaacatgcacatcagacgtgtgctcggacagttcctttttcagcgctgctatgaagggatcattcttctgtagaaaaggtgcgactcgtggtgtccgtgacaaaaaatccaaccaggatcggacgtagcgaggattgatggctaagctgctattctctgcaaaaaaatcgatattcctccgtctcaaacccatagatgggtctcccaaggactcttcaaaactaattctaacagtttcggattaattgacctcaccatcctgtagaattctcttaatggtcaggaaaaacccaccacgggcttttcccaaaaaattctgggaagggggtaaaacatttttctttaaaaaa

SEQ ID NO: 56593 - DNA, 700 bp, Zea mays
  misc_feature: Ceres CLONE 1498042
  misc_feature: Encodes the peptide sequence at SEQ ID NO. 56594
atagctggagctccccgcggtggcggccgctctagaactagtggatcccccgggctgcaggaattcgcacgagaccattacctagaacatcctaatcgaaaactgcctgccctaccgaatctttcgccgtcccatcagcccagcaattcttcgctgttcgaggacccctcggtttcgaccgaagcccagcaagccgaccacacaccgctgccgttggttccgtcccaagagatgggcaagtcctggtcgctcatcagccacctccacaccgtcgccgggccaagcatcaccctgctgtaccctctgtaagttccttcatcaccctaataatagcagggaccagttttaccagtgcagcagtgaccgaccacggtccacggcatacgtgagctgagagcatcgtgctgggacatgcgtgccgttggtggtgctgcaggtacgcgtcggtgtgcgcgatggagagcccgtccaaggcggacgacgagcagtggctgtcatactggatcatacactccttcgtcaccctcctggagatgctcgccgagccgctcctccactgggtacccgtgtggtacccggccaaggtgctgttcgcggcgtggctggcgctgccgcagttcaagggcgcctccttcgtctacgagaagctcgtcagggaacagctccggaactaccgcgccagatacccgcgcaagggcgc

SEQ ID NO: 56594 - protein, 81 aa, Zea mays
  misc_feature: Ceres CLONE 1498042
  misc_feature (1)..(70): Pfam Name: TB2_DP1_HVA22 Pfam Description: TB2/DP1, HVA22 family
MESPSKADDEQWLSYWIIHSFVTLLEMLAEPLLHWVPVWYPAKVLFAAWLALPQFKGASFVYEKLVREQLRNYRARYPRKG

SEQ ID NO: 56595 - DNA, 689 bp, Zea mays
  misc_feature: Ceres CLONE 1498066
  misc_feature: Encodes the peptide sequence at SEQ ID NO. 56596
  misc_feature (689)..(689): n is a, c, t, g, unknown, or other
caaagctggagctccccgcggtggcggccgctctagaactagtggatcccccgggctgcaggaattcgcacgagaccattacctagaacatcctaatcgaaaactagaagccaccctgccgcctcaccgcctctctcactctgagaccgcagatccgttgtccggtgagtggaagccgcacgaacccatggcctccggcgagcttgcctgcacctacgccgctctcatcctcagcgacgatggcatcgccatcaccgccgagaagatcgccacgatcgtgaaggcagccaacatcaaggtcgagtcctactggccggcgctcttcgccaagctcctggagaagcgcaacgtcgaggacctcatcctctccgttggatctggtggcggagctgctccagttgctgctgccgcccctgctggtggtgctgcggccgcggctgccccggctgtcgaggagaagaaggaagaggccaaggaggagtctgatgacgacatgggcttcagcctgttcgactgaggagacccctcgcccccagccattagcaaatttcacttgtgctgtccaagactatcttgtcttatgttatgtctctaggcttttgttacaactacccaagttttgagtttttgagacgtggctatggcaatgtgacgatgaactcaaaccatcttatgagggtcaaacctgn

SEQ ID NO: 56596 - protein, 109 aa, Zea mays; identical to SEQ ID NO: 48282
  misc_feature: Ceres CLONE 1498066
  misc_feature (21)..(108): Pfam Name: Ribosomal_60s Pfam Description: 60s Acidic ribosomal protein

SEQ ID NO: 56597 - DNA, 441 bp, Zea mays
  misc_feature: Ceres CLONE 1498069
  misc_feature: Encodes the peptide sequence at SEQ ID NO. 56598
aaactggagctccccgcggtggcggccgctctagaatagtggatcccccgggctgcaggaattcgcacgagaccttacctagaacatcctaatcgaaaactccgacggcgccgacaaaaccagaccatcaaacaagtgccagcgccctctcgcagtcgccgcaatggagagcacttccatcatgatcaagcctgaacgcgtccaagaggggcccttcattggtgaaaatcatcaacccgttttgagaaaaaaggctttttacctcaagggcttttaaaacctttttgaaactggaaaagggctttttttttaaaaaaaattttacccaattttccccctccaaagcccttttttttaggggggcccgtgggaaaaaattatttttttttttcccccttggggggggccccaacttttctttggggagaaaaaaaaaaaaaa

SEQ ID NO: 56598 - protein, 37 aa, Zea mays
  misc_feature: Ceres CLONE 1498069
MESTSIMIKPERVQEGPFIGENHQPVLRKKAFYLKGF

SEQ ID NO: 56599 - DNA, 710 bp, Zea mays
  misc_feature: Ceres CLONE 1498078
  misc_feature: Encodes the peptide sequence at SEQ ID NO. 56600
  misc_feature (440)..(440): n is a, c, t, g, unknown, or other
  misc_feature (516)..(516): n is a, c, t, g, unknown, or other
aaagctggagctccccgcggtggcggccgctctagaactagtggatcccccgggctgcaggaattcgcacgagaccattacctagaacatcctaatcgaaaaactcacgattggagtttcacctcggcagcccagccagccagtggttcctcggctcggaggaacaggcgaacagcaagagcttctgaagatgaaggcgatccccgtggctctcctgctcctcgtcctggttgctgccgcctcctcgttcaagcatctcgccgaggcagcagacggcggcgcggtgccggacggcgtgtgcgacggcaagtgccgcagccggtgctcgctgaagaaggccgggcggtgcatgggcctgtgcatgatgtgctgcggcaagtgccagggctgcgtgccgtcggggccgtacgcccagcaggacgagtgcccctgctacaggnacatgaagtcccccaagaacccagcgcccaagtgccccttaggccctaccgctcttagggaggggagatgacccangatttcgtttcggatcctgccaagcttctagcctggaaccgctagtttacccgcccaaacctccgaatgtcccaaccgggccctcccgggcgttgggggccggggtttccccccggaagggcctttacccaaaaaaataacccatggccctggtttctgggggccaaaaaaaaaaaaaaaaaacttttccgctc

SEQ ID NO: 56600 - protein, 106 aa, Zea mays
  misc_feature: Ceres CLONE 1498078
  misc_feature (1)..(96): Pfam Name: GASA Pfam Description: Gibberellin regulated protein
  misc_feature (84)..(84): Xaa is any aa, unknown, or other
MKAIPVALLLLVLVAAASSFKHLAEAADGGAVPDGVCDGKCRSRCSLKKAGRCMGLCMMCCGKCQGCVPSGPYAQQDECPCYRXMKSPKNPAPKCPLGPTALREGR

SEQ ID NO: 56601 - DNA, 692 bp, Zea mays
  misc_feature: Ceres CLONE 1498081
  misc_feature: Translation starting site: 468
atagctggagctccccgcggtggcggccgctctagaactagtggatcccccgggctgcaggaattcgcacgagaccattacctagaacatcctaatcgaaaactttgttatcacaaaacatttctttgaaggaattacgtttgttttcttctgatttttcacacataacttatgggctagtttatctaatggtagaataatttattgttccatcaattctattcaaatttacaccccaatcttattttgatagaaccaaagacaccagagggcacttggaagtgtgagcagtgcaataacataaactatcctttccgaacgaaatgcaatcgtccccaatgtggagcacaaaagccatcacagactaacaatgcaaatgaatcagctcaagatcaagacaatcagtgagtcctagaacagtaatgacggtcaagaaagtccagcgtcgtcgtcaaggttcaatctgaatgtggggtacatctgtgtcagtagtcgccgttacaagtttcttccccttgagaacttacttgactcggggccttggagttggcaatggagtcttgccttccttaatcactgcagataatggtcaacaacatcaatttgttatgaggtttgtcaagaacatccatcttgcctttcctggctgaacttggttacttgtctttgttactggtactctcgataaatta

SEQ ID NO: 56602 - DNA, 762 bp, Zea mays
  misc_feature: Ceres CLONE 1498087
  misc_feature: Encodes the peptide sequence at SEQ ID NO. 56603
  misc_feature (1)..(1): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (29)..(29): n is a, c, t, g, unknown, or other
  misc_feature (32)..(32): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
nttttttcgtcgtgccggnnngggnnnanatntaatttcnnnnnnnccaagctggagctccccgcggtggcggccgctctagaactagtggatcccccgggctgcaggaattcgcacgagaccattacctagaacatcctaatcgaaaagaaaaccctagcagctccgtagtccctctcctctggaggtattcgcagtcgaccgtgtcctcggagcacgatgaaggttgttgctgcctacctgcttgctgtcctcgctgggaatgccagcccctccgctgaggatttgactggcattctggagtcagttggctgtgaagttgacaatgaaaggatggaactgctgctgtcccaactgagcggtaaggacatcaccgagctcattgccgcgggcagagagaagtttgcttcagtcccatgtggcggcggcggagtggctgttgcggcaggtgcacctgctgttggcccacctgctcctgcagctgaggcaaagaaagaagagaaggtggaagagaaggaagaaagcgatgatgatatgggcttcagcctcttcgactaggttgcacagtcatcacagtattgtttcgggcagtgaaatcaaacggaaaccagagtcatgtttagatttgggcccttattttatgttggaaagccactgcaaagaccggccaaagtggccccggtatttgggaaattgcagccggtagaattgctagtgaatgggttggggatttaaactcgctgggcacccacaagtcctttg

SEQ ID NO: 56603 - protein, 112 aa, Zea mays
  misc_feature: Ceres CLONE 1498087
  misc_feature (17)..(111): Pfam Name: Ribosomal_60s Pfam Description: 60s Acidic ribosomal protein
MKVVAAYLLAVLAGNASPSAEDLTGILESVGCEVDNERMELLLSQLSGKDITELIAAGREKFASVPCGGGGVAVAAGAPAVGPPAPAAEAKKEEKVEEKEESDDDMGFSLFD

SEQ ID NO: 56604 - DNA, 696 bp, Zea mays
  misc_feature: Ceres CLONE 1498101
  misc_feature: Encodes the peptide sequence at SEQ ID NO. 56605
  misc_feature (696)..(696): n is a, c, t, g, unknown, or other
aaagctggagctccccgcggtggcggccgctctagaactagtggatcccccgggctgcaggaattcgcacgagaccattaccctaaacattcctattcaaaaagcgccggccccccgtgggaaactagaactgactccctcgatcccagcggcagcggcggaagcgaacggtgaccgtgacctcccctgaggctgcatatactcagatcgggtttcacatctccggttttggattggttggttgcccgcggcgatgggaggacagctgtggtggtatccatagcggatcctcggttgcatccttgtgcgatggcttcgacctccgttactgagttaaccgcgagacaagaaatgcgacaaagacatcgcggatacagcagctccacttacttctcagggacactcccaacaaccgactggcaaaatcagcacactagtgcctgcttagccggttgtaattgcagcaagagatggagctgcatccagtggggtgatagaaaacaagaatggcgtggacaattctgctaatggttctttgaagcgcgacgacagtgaatgtgctgataagagctcgctgcgggggagcctccaggatagctcgatgtcgcctaaatgcagtgacacgtcgagcagcctgtcccagccagtgggaggactagatcagcggtcacctgttgacatgcatcaagtggcagn

SEQ ID NO: 56605 - protein, 31 aa, Zea mays
  misc_feature: Ceres CLONE 1498101
MSPKCSDTSSSLSQPVGGLDQRSPVDMHQVA

SEQ ID NO: 56606 - DNA, 691 bp, Zea mays
  misc_feature: Ceres CLONE 1498104
  misc_feature: Encodes the peptide sequence at SEQ ID NO. 56607
  misc_feature (691)..(691): n is a, c, t, g, unknown, or other
aaagctggagctccccgcggtggcggccgctctagaactagtggatcccccgggctgcaggaattcgcacgagaccattacctagaacatcctaatcgaaaaatccaactcacacacaggctcaccccaccaacagcaagcgaaaatctcccgatcccctctggtctccgcggcgaagatgtcggggcgcggcaagggcgggaagggcctgggcaagggcggagcgaagcgccaccggaaggtgctccgcgataacatccaggggatcacgaagccggcgatccggcggctggcgcgcaggggcggcgtgaagcgcatctccgggctcatctacgaggagacccgcggcgtcctcaagatcttcctggagaacgtgatccgcgacgccgttacctacaccgagcacgcgcgccgcaagaccgtcaccgccatggacgtcgtctacgcgctcaagcgccagggccgcaccctctatggcttcggcggctaggccggccgcgcctcgctgtcgtcgctgcggttctattgttttttgcaatccgcaagttgtggctgggtggcgaaaatgctggttactgtagcactagttcaagcatgttgtgtgtgtctgaagaaatgccaattgtgacttgctgtttgttcaaacatgctccttttcatcacatatcaacccgtgttacaaatgcagttn

SEQ ID NO: 56607 - protein, 103 aa, Zea mays; identical to SEQ ID NO: 6459
  misc_feature: Ceres CLONE 1498104
  misc_feature (25)..(94): Pfam Name: Histone Pfam Description: Core histone H2A/H2B/H3/H4

SEQ ID NO: 56608 - DNA, 692 bp, Zea mays
  misc_feature: Ceres CLONE 1498107
  misc_feature: Encodes the peptide sequence at SEQ ID NO. 56609
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (137)..(137): n is a, c, t, g, unknown, or other
  misc_feature (138)..(138): n is a, c, t, g, unknown, or other
  misc_feature (155)..(155): n is a, c, t, g, unknown, or other
  misc_feature (326)..(326): n is a, c, t, g, unknown, or other
  misc_feature (327)..(327): n is a, c, t, g, unknown, or other
  misc_feature (659)..(659): n is a, c, t, g, unknown, or other
caaaagctggagctccaccgcggtggcggccgctctagaactagtggatcccccgggctgcaggaattcgcacgagaccattacctagaacatcctaatcgaaaagtacaacatccgatccgaaacctagcannncnnccccccggtacagacgnggcgcgaactcaaaccctagaaacggtagccatggtattcgggaggcggaggagggagcggcgcgcacaaggcggactcgggctccgcgccctcgccggcgcctaaccccacggcgatgctttcggcgctcatgacaagcgcgccaagctccaagaggagctccgctccanntcgagcgccagggtttatgaatatggagaccacctaccctacagggagactaatcaattttgaaagtgtgcctgaaggggttccaaaaccttttttgtccccccccaaaaaaaccccctctaacccttaaggcccttcccggaaaattttccggggtgaacaaaagggtttttcccccccgggccaccccgttaaattttcccccgggggttgagagaaaaatttttgggttggcgccaaaataaatgggaaaaaaaaaattttgggaccccctgccctcttcaaagggggggggagaaaccccccctcttccgataaggggggaaaggggnaaaaacccccaaaaaaaagggggaggggccccc

SEQ ID NO: 56609 - protein, 61 aa, Zea mays
  misc_feature: Ceres CLONE 1498107
  misc_feature (19)..(19): Xaa is any aa, unknown, or other
MLSALMTSAPSSKRSSAPXRAPGFMNMETTYPTGRLINFESVPEGVPKPFLSPPKKTPSNP

SEQ ID NO: 56610 - DNA, 704 bp, Zea mays
  misc_feature: Ceres CLONE 1498111
  misc_feature: Encodes the peptide sequence at SEQ ID NO. 56611
  misc_feature (285)..(285): n is a, c, t, g, unknown, or other
  misc_feature (378)..(378): n is a, c, t, g, unknown, or other
  misc_feature (446)..(446): n is a, c, t, g, unknown, or other
  misc_feature (449)..(449): n is a, c, t, g, unknown, or other
  misc_feature (450)..(450): n is a, c, t, g, unknown, or other
  misc_feature (461)..(461): n is a, c, t, g, unknown, or other
caaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcngggcgcccgatgggtgagcaggtgaagggcatgctccacgacaaggggccgacggcgtcgcaggcgctgacggtggtgacgctgttcccgctngggcggctgctgctggtgctgtcagggctggcgctgaccgcctccgtggtggggctggccgtgccacnccnngtgtcctgatnctcaagcccgtggtcgtccccgcgcgctgttcatcgggacggccgtcatgggttcctccactccgggcccctggggctcggggggcttttccctccttaaagtgcctgccaaaaggggggggaagggtttccagcccccccgaaattttggaaaaagcgcccccccagaatggggaagcccggggcaaaggggcccaaaaaccggaaggggggcccgcccttccggggggggcccaaaggccg

SEQ ID NO: 56611 - protein, 54 aa, Zea mays
  misc_feature: Ceres CLONE 1498111
  misc_feature (51)..(51): Xaa is any aa, unknown, or other
  misc_feature (52)..(52): Xaa is any aa, unknown, or other
MGEQVKGMLHDKGPTASQALTVVTLFPLGRLLLVLSGLALTASVVGLAVPXXVS

SEQ ID NO: 56612 - DNA, 732 bp, Zea mays
  misc_feature: Ceres CLONE 1498136
  misc_feature: Encodes the peptide sequence at SEQ ID NO. 56613
  misc_feature (341)..(341): n is a, c, t, g, unknown, or other
  misc_feature (348)..(348): n is a, c, t, g, unknown, or other
aaagctggagctccccgcggtggcggccgctctagaactagtggatcccccgggctgcaggaattcgcacgagaccattacctagaacatcctaatcgaaaaaacgagacagcaagagccaagaggtggtgagagagaggaccgaggagggaaacagagaagatgacgacgaagcgcgacaccgagtcggacggcgaaggctccaaccccgtcggtggtggcgcgactccgccgcccctagccgccgcccctgtcgtatgcctcctccgctccgccggggacttcggtggcagcgccttcgttggatccatcttcggatatgggacaggcttgatcaccangaagggnttttaagggctcattcagcaatgcagggtcctcttgcaagacttttgcattttcctcttgccttccaaattttggttttgggcttgttgccaagcttactggcaagggataacattgcaagggcgggaaaccgggggtggtgacagggccccctttggggtttccggggggccccaagggtttgtccaaaggtgtggcccccttcccaattttttttgtttctgggggggggattaaaaaaagggggggggggtgcccccccttgggggcgcccccccccgcgccccaaaaaaaaaggggtgtttccccccccccccccccccccctcgtggtgggaggggggtttttctcccccggggggggggatagaaaaacacacacccc

SEQ ID NO: 56613 - protein, 63 aa, Zea mays
  misc_feature: Ceres CLONE 1498136
  misc_feature (60)..(60): Xaa is any aa, unknown, or other
MTTKRDTESDGEGSNPVGGGATPPPLAAAPVVCLLRSAGDFGGSAFVGSIFGYGTGLITXKGF

SEQ ID NO: 56614 - DNA, 697 bp, Zea mays
  misc_feature: Ceres CLONE 1498165
  misc_feature: Encodes the peptide sequence at SEQ ID NO. 56615
aaagctggagctccccgcggtggcggccgctctagtactagtggatcccccgggctgcaggaattcgcacgagaccattacctagaacatcctaatcgaaaacagagtctcatctgaagtgcgcgagagaaacgcgtatacccagagtggcggttgaggaagaggaggagaagaagaagatgggttcctccgcatacgcctcgtggtccaagcggtggatccgtcccgaggtgtacccgctgttcatgccgatggccgtggccctgggcatctgctcgtaccatcttgtgggcaacatgacgggcaaccccgaggtgcgggtgaccaaagacaagagggcggccggcatcctggacaaccacgacgagggcgagaggtacggcgtgcacagcctcaggaaattcgtccgcgggaagaagcccgagatcatggcctccatcaactccttcttcgccgaccctcccaagggaaattaagctagattccgtcatggacggatggatggatgaaaaattcctgatcgtccatcgtatgtttacaactcagtagcgggcggcagcgcgccttgattcgtagccgtcgtcagtacatttatttggtttctaaaattctaatgtctccatataaatggaacatcatgcagttgtcgtgcatgcttgcatggctgcgaactaattcagcatgccttgtgattttc

SEQ ID NO: 56615 - protein, 98 aa, Zea mays
  misc_feature: Ceres CLONE 1498165
  misc_feature (10)..(96): Pfam Name: B12D Pfam Description: B12D protein
MGSSAYASWSKRWIRPEVYPLFMPMAVALGICSYHLVGNMTGNPEVRVTKDKRAAGILDNHDEGERYGVHSLRKFVRGKKPEIMASINSFFADPPKGN

SEQ ID NO: 56616 - DNA, 713 bp, Zea mays
  misc_feature: Ceres CLONE 1498171
  misc_feature: Encodes the peptide sequence at SEQ ID NO. 56617
  misc_feature (462)..(462): n is a, c, t, g, unknown, or other
  misc_feature (463)..(463): n is a, c, t, g, unknown, or other
  misc_feature (478)..(478): n is a, c, t, g, unknown, or other
aaagctggagctccccgcggtggcggccgctctagaactagtggatcccccgggctgcaggaattcgcacgagaccattacctagaacatcctaatcgaaaatcgcgccagagccacgcacgctagtgtcagtggcacgcaggcagccgcgcgcaccgaggggagaccagagctagcggcgaggccaagggcaagggcaagggcgcggacggcaatggcgagagctggaggcggcggtccgttcttcccggtccgcggcgcggcgctggtggtcgtgctgctaggcatcgtcgcgggcgcggcgagggcgcagctgcggctgaactactacggcagctcgtgccccagcgcggagtccacggtgcgctccgtcatctcgcagcgcctccagcagagctttcgccgtggggcccgggacgctccgcctcttcttccaggaatgggtcgtcctccctggtgggnnggggccacctccggntggaacctggggcggctgggacggaaaaaatttcaaaggggcatcgggaaaaaattcctcccgggccccggtttaacggggaaaagttaaaccccttttttgggaaaaaggcccccccaaaaaggaattttatcccctttcagggggcccaccaagggggggacaccttggaaatattttgggggggattaaaactttaaaacgcggggtgggggaaaaccccccaaaaacccgt

SEQ ID NO: 56617 - protein, 117 aa, Zea mays
  misc_feature: Ceres CLONE 1498171
  misc_feature: SWISSPROT Homolog: EC 1.11.1.7 Peroxidase
  misc_feature (83)..(83): Xaa is any aa, unknown, or other
MARAGGGGPFFPVRGAALVVVLLGIVAGAARAQLRLNYYGSSCPSAESTVRSVISQRLQQSFRRGARDAPPLLPGMGRPPWWXGATSGWNLGRLGRKKFQRGIGKKFLPGPGLTGKS

SEQ ID NO: 56618 - DNA, 594 bp, Zea mays
  misc_feature: Ceres CLONE 1498173
  misc_feature: Encodes the peptide sequence at SEQ ID NO. 56619
  misc_feature (316)..(316): n is a, c, t, g, unknown, or other
aaagctggagctccccgcggtggcggccgctctagaactagtggatcccccgggctgcaggaattcgcacgagaccattacctagaacatcctaatcgaaaaaaccctaactcattctttcacttctccagccgtcacagacaaccggccgccaggaagcatggccgaccgtgccctgctaatcacctcctccctttctgtctttcaatttgttcctgtcgctcactttcgttcggccgccaggaagcaccagcggctggctctggctcgactgcgccctgcacagagccacacagccgcccactctctgtttggnttctgttttttattcgtatctacttgccgcactattactcggtcgccaggaagaactagacatttgcactgtgcaattgaaactcgatttagtcctcatttactcggatcccttactgggtggttaaatatatgagacggatatcttgtaatgggatccaagtttggaaggaaaaaaatgtaaatccgggcccccccaaaattcccggaatttctccggggagattttagggcccccttgccccttttacccggtttaaaaaaaaatttgggttttaa

SEQ ID NO: 56619 - protein, 96 aa, Zea mays
  misc_feature: Ceres CLONE 1498173
MADRALLITSSLSVFQFVPVAHFRSAARKHQRLALARLRPAQSHTAAHSLFGFCFLFVSTCRTITRSPGRTRHLHCAIETRFSPHLLGSLTGWLNI

SEQ ID NO: 56620 - DNA, 618 bp, Zea mays
  misc_feature: Ceres CLONE 1498202
  misc_feature: Encodes the peptide sequence at SEQ ID NO. 56621
  misc_feature (353)..(353): n is a, c, t, g, unknown, or other
  misc_feature (385)..(385): n is a, c, t, g, unknown, or other
  misc_feature (424)..(424): n is a, c, t, g, unknown, or other
ctggagctccccgcggtggcggccgctctagaactagtggatcccccgggctgcaggaattcgcacgagaccattacctagaacatcctaatcgaaaagtgttcgtgtcatcccgcccgcaggccgcagtccatggccaccgccagcctcgcgctctcgctgcgcctcgcgccgtcctcgcgcccgctgagcctccgccgccggggggccgccggcgtcacctgccgcgccaccaccgccacgttccaccagctcgacgccgtcgcggtgagggaggaggagtccaggttccggacggcggcggcggagggccgcaacctgctgccgctcacgaggtgcatcttctccgatcnactcacgcccgtgctagcgtaccgctgtctcngtaaggaggacgaacgcgatgcgcccagcttttctctcnagtctgtcgagcaggggtccgaagggcaccatggtggggaggtacagcgtggtccggggcccaaccttctatggaaggtcgtggccaaaggctaacattgtgacgggcatggaacattaaaatgaaccccaggagggggccccttccgggccgaatcccctgggggtcccccgggaaatcttggaccaagggga

SEQ ID NO: 56621 - protein, 128 aa, Zea mays
  misc_feature: Ceres CLONE 1498202
  misc_feature: SWISSPROT Homolog: EC 4.1.3.27 Anthranilate synthase
  misc_feature (74)..(74): Xaa is any aa, unknown, or other
  misc_feature (85)..(85): Xaa is any aa, unknown, or other
  misc_feature (98)..(98): Xaa is any aa, unknown, or other
MATASLALSLRLAPSSRPLSLRRRGAAGVTCRATTATFHQLDAVAVREEESRFRTAAAEGRNLLPLTRCIFSDXLTPVLAYRCLXKEDERDAPSFSLXSVEQGSEGHHGGEVQRGPGPNLLWKVVAKG

SEQ ID NO: 56622 - DNA, 694 bp, Zea mays
  misc_feature: Ceres CLONE 1498210
  misc_feature: Translation starting site: 485
  misc_feature: SWISSPROT Homolog: EC 3.2.1.23 Beta-galactosidase
aaagctggagctccccgcggtggcggccgctctagaactagtggatcccccgggctgcaggaattcgcacgagaccattacctagaacatcctaatcgaaaaatcaggtccgtctccaacttactagtagtcagccgccgcaatcagggacaggtagctcgagctcgcgctccacctgctccgacgcgatgcgggccaagtggaagaagaagaggatgcggaggctcaagaggaagcgccggaaaatgaggcagagatctaagtaggcgcatgttgggaccgaggatggcgagcttctcctgcaccatggctgaggcgcgttgggatgatgatctcccttgttgagacgtgctttgctgtagacgtaggcgatgtaaaccgtcctttttgattaattctagcatgttctgagactgggtttatattgtaatttgaggataattatatgatgctctaagttaaatcagattcctggcactcgaatatgtttgatgccaaaaaaaaaaaaaaaaaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaag

SEQ ID NO: 56623 - DNA, 557 bp, Zea mays
  misc_feature: Ceres CLONE 1498216
  misc_feature: Encodes the peptide sequence at SEQ ID NO. 56624
  misc_feature (319)..(319): n is a, c, t, g, unknown, or other
  misc_feature (320)..(320): n is a, c, t, g, unknown, or other
  misc_feature (350)..(350): n is a, c, t, g, unknown, or other
ctggagctccaccgcggtggcggccgctctagaactagtggatcccccgggctgcaggaattcgctcgagaccattacctagaacatcctaatcgaaaaacacacacacacaaacagaaaactgagtcagagaggtgcagatcaatgcggcggtggtggtgcgccgccggcggtctcgcccgctgcgtcctctcgtcctccacctccgccatagcatcccatgcccgcccgctgccggcacccctgatgcccaaatctccctcctttaccgtccctttctgcatgtcctgtcgcaagcaccactcctctccagggattnnctccactgggcaatgcttcttcttccgccntcgtggggcttatcacaaatgcggtctaccccagaagaaagggtcggcgctccgctcccccccctaaacccaaagcaaaattccaaaagagagccccccccccctgaagtcccaattccaacctttaaaacggcccgccccccgggggagggccccaaacccccatgggcccccccgggttaaaggggccccaccgaaattttgaag

SEQ ID NO: 56624 - protein, 90 aa, Zea mays
  misc_feature: Ceres CLONE 1498216
  misc_feature (59)..(59): Xaa is any aa, unknown, or other
  misc_feature (69)..(69): Xaa is any aa, unknown, or other
MRRWWCAAGGLARCVLSSSTSAIASHARPLPAPLMPKSPSFTVPFCMSCRKHHSSPGIXSTGQCFFFRXRGAYHKCGLPQKKGSALRSPP

SEQ ID NO: 56625 - DNA, 605 bp, Zea mays
  misc_feature: Ceres CLONE 1498230
  misc_feature: Encodes the peptide sequence at SEQ ID NO. 56626
  misc_feature (435)..(435): n is a, c, t, g, unknown, or other
  misc_feature (482)..(482): n is a, c, t, g, unknown, or other
  misc_feature (483)..(483): n is a, c, t, g, unknown, or other
ctggagctccccgcggtggcggccgctctagaactagtggatcccccgggctgcaggaattcgcacgagaccattacctagaacatcctaatcgaaaaaagaaaaaaaaaacacgcacccgcgtccgcgtgctctctgccccctgcccccctcccatctgcgccgccctcctcatccaccgcccgtcccgccgccgccagcccaaggccaggcatccgccagcctctcgcaccacgcgtatcgcgtgcccgcccgaccggctcgtggcgatggcgtaccgggcggacgacgactacgactacctattcaaggtggtgctcatcggggactccggcgtcggcaagtccaacctgctctcgcgcttcacgcgcaacgagttcagcctcgagtccaagtccaccatcggcgtcgagttcgccacccgcagcatccacngtcgaacgacaaggtcgtcaaaggcccagaatctgggaacaccgccnngtcaggaaaaggtaaccgtggctaatcaccaagcccgttacaaaccccgggaaaaaataaggggggggcttttttttttttttaaaaaaatttccggggggaggttacccttaaaaaaaaga

SEQ ID NO: 56626 - protein, 112 aa, Zea mays
  misc_feature: Ceres CLONE 1498230
  misc_feature (14)..(104): Pfam Name: Ras Pfam Description: Ras family
  misc_feature (56)..(56): Xaa is any aa, unknown, or other
  misc_feature (72)..(72): Xaa is any aa, unknown, or other
MAYRADDDYDYLFKVVLIGDSGVGKSNLLSRFTRNEFSLESKSTIGVEFATRSIHXRTTRSSKAQNLGTPPXQEKVTVANHQARYKPREKIRGGLFFFFKKISGGRLPLKKR

SEQ ID NO: 56627 - DNA, 645 bp, Zea mays
  misc_feature: Ceres CLONE 1498231
  misc_feature: Encodes the peptide sequence at SEQ ID NO. 56628
ggagctccccgcggtggcggccgctctagaactagtggatcccccgggctgcaggaattcgcacgagaccattacctagaacatcctaatcgaaaaacggcctctcggcggggcccggcaacagaccgggcagcagcacggcagccatggcgtcgagttcgaccctggatttggcgatgggccccggcgccctcctcccccgcagcgcggtcccgtacgcctccttcgctccaggaaggggaaggagcgcgagcggaacgaggagcaggaatctggcgctctccgcttcctcctccaacggtgcagcagtgccatccctgacaacagattcggagaagaagggcccagtgataatggaaattccactggaccaaatccggaggccactgatgcgaacgcgggccaatgatccagtcaaggtgcaagaactcatggacagtatccgtgtcatcggcctccaagtacctattgatgtgttggaggtcgatggggtctattatggcttctctggatgccaccgctacgaggctcaccagcgccttggtctcccaaccatccgctgcaaagttcgccgtgggacaaaggaaacactgaggcgagagcaccttccttcagcttggattccatttttgaattacttgatgc

SEQ ID NO: 56628 - protein, 166 aa, Zea mays
  misc_feature: Ceres CLONE 1498231
  misc_feature (70)..(154): Pfam Name: ParBc Pfam Description: ParB-like nuclease domain
  misc_feature: SWISSPROT Homolog: EC 1.8.98.2 Sulfiredoxin
MASSSTLDLAMGPGALLPRSAVPYASFAPGRGRSASGTRSRNLALSASSSNGAAVPSLTTDSEKKGPVIMEIPLDQIRRPLMRTRANDPVKVQELMDSIRVIGLQVPIDVLEVDGVYYGFSGCHRYEAHQRLGLPTIRCKVRRGTKETLRREHLPSAWIPFLNYLM

SEQ ID NO: 56629 - DNA, 674 bp, Zea mays
  misc_feature: Ceres CLONE 1498243
  misc_feature: Encodes the peptide sequence at SEQ ID NO. 56630
  misc_feature (554)..(554): n is a, c, t, g, unknown, or other
aaagctggagctccccgcggtggcggccgctctagaactagtggatcccccgggctgcaggaattcgcacgagaccattacctagaacatcctaatcgaaaactgtcgctcgctctccctgtctcccgcacgccgacccgcagccgccgccgttcgccatgggtttcctcgacgcgctctaccgtgtggtgatgcgccgcaacgccgtctacgttaccttcgtcgtcgccggcgctttcgcgggcgagcgggcggtggactacggcgttcacaagatctgggagatgaacaacctcgggaaaaggtacgaagacatatcggttttggggcagaggccagctgaggaatgataaattttggtcaccagtttgcttcggtttgaccgtttcattttggcacagtaataaacgatgtaaacttacgctgctcctatgacctccttctcattcgtttactctgaaaatgcttttgtggggatttcgtggtgcatgattgaaacctgttagggcttgttcggttagctctcaatccacatccatgtggattgagtgggnattggatagttttgaatcccaaacaagtcaaacttcttctcaattttttccaatctcatccaatccatatgtattaggaataaccgaacaagcccttatatagaacatgcaaatactaaa

SEQ ID NO: 56630 - protein, 63 aa, Zea mays; identical to SEQ ID NO: 7503
  misc_feature: Ceres CLONE 1498243
  misc_feature (4)..(58): Pfam Name: UCR_UQCRX_QCR9 Pfam Description: Ubiquinol-cytochrome C reductase, UQCRX/QCR9 like

SEQ ID NO: 56631 - DNA, 685 bp, Zea mays
  misc_feature: Ceres CLONE 1498246
  misc_feature: Encodes the peptide sequence at SEQ ID NO. 56632
aaagctggagctccccgcggtggcggccgctctagaactagtggatcccccgggctgcaggaattcgcacgagaccattacctagaacatcctaatcgaaaaaaaaccctatacgctatacccacttgccgcactggccatcctccggccccaccggccagtgatacgcactcctcccctcaaagccctagccagacgccgccgccgcacccgatctggctgcctcggtcgatttctaattctcctcgcgagcccaaaccctaaacctaaacctttcacccgccgccgccgccaccaccagcactgccactccgccaccaccgtcccgaagccccctcccagcgccatcgacttcatctcggattgaagcaatgtcgtcggacgatgaggtcagggaggagaaggagctcgacctctcctccaacgacgttgtcaccaagtacaaggctgccgccgaaatcctcaacaacgctctgaagattgttgtgtctcagtgcaagccaaaagtcaagattgttgacctttgcgagaagggcgactctttcataagagagcaaactgggaatgtttacaagaacgcaaagaggaagattgaaaggggtattgctttcccaacctgtgtatccgtcaatgacacagtttgccacttctcaccgcttgcaaccgatgatgccgttctggaaga

SEQ ID NO: 56632 - protein, 104 aa, Zea mays
  misc_feature: Ceres CLONE 1498246
  misc_feature: SWISSPROT Homolog: EC 3.4.11.18 Methionyl aminopeptidase
MSSDDEVREEKELDLSSNDVVTKYKAAAEILNNALKIVVSQCKPKVKIVDLCEKGDSFIREQTGNVYKNAKRKIERGIAFPTCVSVNDTVCHFSPLATDDAVLE

SEQ ID NO: 56633 - DNA, 643 bp, Zea mays
  misc_feature: Ceres CLONE 1498250
  misc_feature: Encodes the peptide sequence at SEQ ID NO. 56634
  misc_feature (447)..(447): n is a, c, t, g, unknown, or other
caaagctggagctccccgcggtggcggccgctctagaactagtggatcccccgggctgcaggaattcgcacgagaccattatctagaacatcctaatcgaaaaacagttcatccctctcgacgcgccgccgccgtctcgccgctgcccacccagattgacggctccaattggcgcccatggcggaagaaaccaacataaaaaaggaggaagaggagttcagcaccggtcctctctcggtgctcatgatgagcgtcaagaataatacccaggttcttatcaactgccggaacaacaagaagttgcttggtcgcgtgcgagccttcgatcggcactgcaacatggttcttgagaacgttcgtgagatgtggaccgaggtaccgaagaccggtaaaggcaagaagaatgctctcccggtgaacaaggacaggttcataagcaagatgttnctcccgcgggggatgcggtccatcatcggtcctcaaggaaccccgaaaaggaataccccgtgcaaccctaaaaaaaattttgttttttacaacaaaaacctttggccaatttgggggggaaaaaggggggttctccccaaaaaacccctaaaaaaaggggggggggtgtgttttcccccccgccaaaaatattatt

SEQ ID NO: 56634 - protein, 155 aa, Zea mays
  misc_feature: Ceres CLONE 1498250
  misc_feature (22)..(101): Pfam Name: LSM Pfam Description: LSM domain
  misc_feature (90)..(90): Xaa is any aa, unknown, or other
MAEETNIKKEEEEFSTGPLSVLMMSVKNNTQVLINCRNNKKLLGRVRAFDRHCNMVLENVREMWTEVPKTGKGKKNALPVNKDRFISKMXLPRGMRSIIGPQGTPKRNTPCNPKKNFVFYNKNLWPIWGGKRGVLPKKPLKKGGGVCFPPRQKYY

SEQ ID NO: 56635 - DNA, 734 bp, Zea mays
  misc_feature: Ceres CLONE 1498260
  misc_feature: Encodes the peptide sequence at SEQ ID NO. 56636
  misc_feature (734)..(734): n is a, c, t, g, unknown, or other
atagctggagctcaccgcggtggcggccgctctagactagtggatcccccgggctgcaggaattcgcacgagaccattacctagaacatcctaatcgaaaaactgcgactgtgagcttcgttcgttcagttcatccgtgttcttgtttgcgaggtccagagatagaggatgtcttgctgcggaggcaactgtgggtgcggctccagctgcaagtgcggcaacggctgcagagggtgcatcaagatgtccccggacatggatgagcaggtgaccaccaccacctaggctctcatcatgggtgtcgcaccatccaagggtgaccccgagggccggttcgaggcggactccggagctgagaacggctggtgcaagtggggcggcacctgacagagcgacccctgccactgctgcaagagagctacgtgctccaccctgcatggcggcccgaggaagctccctgattattataagctcaatcaagtataccctacgtccctggcctgttgttcttagttagatcagtcaccttcctttcctggcccagactggcctggctcctgggtctcaaacccattgataatgccctgattggcagaccctccttgtcccttgtaatcgcatcccccggccccccttcgggggtttcctaggcgtgcagagtaggtgttgcttgcggaacgtcatttgtggcggcgacgcaccgcccgccgcgctgggactggccccactggccn

SEQ ID NO: 56636 - protein, 38 aa, Zea mays
  misc_feature: Ceres CLONE 1498260
  misc_feature (1)..(39): Pfam Name: Metallothio_2 Pfam Description: Metallothionein
MSCCGGNCGCGSSCKCGNGCRGCIKMSPDMDEQVTTTT

SEQ ID NO: 56637 - DNA, 698 bp, Zea mays
  misc_feature: Ceres CLONE 1498268
  misc_feature (387)..(387): n is a, c, t, g, unknown, or other
aagctggagctcaccgcggtggcggccgctctagaactagtggatcccccgggctgcaggaattcgcacgagaccattacctagaacatcctaatcgaaaacttgcgctctgcgactctcttcttgtctctggtggcgacgagctgacgattgggcggccgccgccgccgacctacgccaggtgcccgagtctccacctttggaccttcaccggcgacgaacacccaccagttgacttggacagccagaactttggaaatggcaagatcaccaaaaggtaggaacctccaagctcgtcaacgtaggtcagcttcttcagatgtgcccttgagctcctgtgagacgaaaggaacaagcaaaggaaatgatgtgtcagtgacatctganaagaatgaatggaaaggagcaacttgcccagtttgcttggagcatccacatgatgctgttctcctcctgtgtacctctcaccacaagggctgccggccatatatgtgtggtaccaactaccgtcattccaactgccttgaacattttaaaggagcttatgcaaaagaaataatggctctgggtgttcagctgagtctgcatctggccttccctttcctcaaacacactgccatcaagcaaccagccctgtgtaatggaacttggcctgccctctgtgcctggaagaggttaaaggatggactgtggtttag

SEQ ID NO: 56638 - DNA, 658 bp, Zea mays
  misc_feature: Ceres CLONE 1498298
  misc_feature: Encodes the peptide sequence at SEQ ID NO. 56639
  misc_feature (414)..(414): n is a, c, t, g, unknown, or other
  misc_feature (423)..(423): n is a, c, t, g, unknown, or other
  misc_feature (425)..(425): n is a, c, t, g, unknown, or other
  misc_feature (426)..(426): n is a, c, t, g, unknown, or other
  misc_feature (430)..(430): n is a, c, t, g, unknown, or other
  misc_feature (431)..(431): n is a, c, t, g, unknown, or other
  misc_feature (447)..(447): n is a, c, t, g, unknown, or other
atagctggagctccccgcggtggcggccgctctagaactagtggatcccccgggctgcaggaattcgcacgagaccattacctagaacatcctaatcgaaaaacaattcccctcccctgtcgtcgtctcccctcacccgaagccccgattcgaaaccggcggcgttcgatttggggatttcggcgtctcgctccccggaatttcttggatctgagtctgtccgccgtcttcgatttgcggctgcagtgagcctgctagttttccggctctgatttggtcggggtcttcgatttcggggatggcgtcgtctccggtgtcctactggtgctacagctgcagccgcttcgtgagggtatctccgtccaccgtcgtctgccggagtgcgatggcggctccctggagcagtttacgcanccgccgccncnncgcnngcggcgggaacggccnggcccgggaacaataaaaccggtcatcgtggctccgcgggcggatcgcttttccgggttcgagctttacttacaacaaccgcccgggcaaagggctgccggccccttccccggttaaatttccaaaccccttccccatgggggccggttttcacccgctggttcaaaaattttttggggggtgggggggggggggttccccgtttccccgg

SEQ ID NO: 56639 - protein, 54 aa, Zea mays
  misc_feature: Ceres CLONE 1498298
  misc_feature (39)..(39): Xaa is any aa, unknown, or other
  misc_feature (42)..(42): Xaa is any aa, unknown, or other
  misc_feature (43)..(43): Xaa is any aa, unknown, or other
  misc_feature (45)..(45): Xaa is any aa, unknown, or other
  misc_feature (50)..(50): Xaa is any aa, unknown, or other
MASSPVSYWCYSCSRFVRVSPSTVVCRSAMAAPWSSLRXRRXXAXGGNGXAREQ

SEQ ID NO: 56640 - DNA, 644 bp, Zea mays
  misc_feature: Ceres CLONE 1498306
  misc_feature: Encodes the peptide sequence at SEQ ID NO. 56641
atagctggagctccccgcggtggcggccgctctagaactagtggatcccccgggctgcaggaattcgcacgagaccattacctagaacatcctaatcgaaaaacccgtggtcccgtggaagagaagagagcatcgccggacccggggacggcgcgccgagaaggaacaaaagaagacggcggcggggcggagatggggagccctctgggcgggtggccgtcatacaacccgcacaacttcagccagttggtccctgccgaccccctcccgcgcagcccctcgaatgtcacaccagcccacttatggtgcgacccacaggaacagatccggcaccccattcaagggataaccacgggaggccagaacatcctgctgaggcacttgtaccaaaaatccgaggaaaacctgaggcaaagaaagctgcggcggaaaaccttccctccgggggacccccccccagaaagcccccccgggggaccttggggggaaacactccgggggccctcccaaagcccaaaaaactttaaaaaccccccccccgggggggggccccccccccccgggttttttatttttttggggggtataagaaaccctgttttttttttcctcccaagggtaaaaagggggaatccggggggggg

SEQ ID NO: 56641 - protein, 150 aa, Zea mays
  misc_feature: Ceres CLONE 1498306
MGSPLGGWPSYNPHNFSQLVPADPLPRSPSNVTPAHLWCDPQEQIRHPIQGITTGGQNILLRHLYQKSEENLRQRKLRRKTFPPGDPPPESPPGGPWGETLRGPSQSPKNFKNPPPGGGPPPPGFFIFLGGIRNPVFFFLPRVKRGNPGG

SEQ ID NO: 56642 - DNA, 592 bp, Zea mays
  misc_feature: Ceres CLONE 1498310
  misc_feature (303)..(303): n is a, c, t, g, unknown, or other
  misc_feature (359)..(359): n is a, c, t, g, unknown, or other
atagctggagctccccgcggtggcggccgctctagaactagtggatcccccgggctgcaggaattcgcacgagaccattacctagaacatcctaatcgaaaaaccaagtaccaacaggaaaaaaggcccagaggcggtgccgtgaccgattcgagacgcaagagaaggatcgagacgaggcggcggttttccgggggcagcatcggcgcggccacgaaagatgtcttactcaagaggctcaagttgaaaggtatggatctcgctcgccttactcgagaagcacaaggtaccgaagtcgctctnagagtgtcgactctagtgatgctgaaaccctggggaacacctgatgtgactggttngtcagctcgtgtaacgatcgagatctggagaaccccttctccactgaggtgaggtaattgatgccaactttgtatttatcctttggaaagggaatcccggggtttggggtttttttacatggctgcctttaaaaatgccaaaccgcgcctccaaattctgggacccttcttttgtttcaagggccggggccaaaatgtgtgaaaaatttttttttcaccaccacgggggtaat

SEQ ID NO: 56643 - DNA, 699 bp, Zea mays
  misc_feature: Ceres CLONE 1498316
  misc_feature: Encodes the peptide sequence at SEQ ID NO. 56644
  misc_feature (655)..(655): n is a, c, t, g, unknown, or other
  misc_feature (658)..(658): n is a, c, t, g, unknown, or other
aagctggagctccccgcggtggcggccgctctagaactagtggatcccccgggctgcaggaattcgcacgagaccattacctagaacatcctaatcgaaaaatcgagaaatcattagacctcaagaaaacaggtcagcaatggaagccacggcgacgccacgaacccaagaagtgatgaagcccgagcccggcacggtcaaggtgaccgtggacgaggtgacgctccgcaagttcgagctgtccgacgtggacgccatgatggcgtgggcgtcggacccgcaggtggccgccttgtgccggtgggagccctacgagtcaacggagccgctgctggccttcatccgcgacgtggtgctcccgcaccagtggttccgcgccatctgcctcggcagcgaaccccgccccgtcggcgccgtgtccgtgtccccgacgggggacccgtgccgcgccgagctcggctacgtgctggcgcgcgcgcattggggccggggcgtggccacggccgccgtgaagcgcacggtgaccgcggtgttcggcgaggtcccggggctggagcgcgtcgaggcgctcgtggacgtggccaacctggcgtctcagcgggtgctggagaaagccgggttcacgagggaggccgtgctccgcaagtatgcgctnacnagggcgtcgtcaggaaccaggtcatgtgcagcttcatcgac

SEQ ID NO: 56644 - protein, 186 aa, Zea mays
  misc_feature: Ceres CLONE 1498316
  misc_feature (81)..(162): Pfam Name: Acetyltransf_1 Pfam Description: Acetyltransferase (GNAT) family
MEATATPRTQEVMKPEPGTVKVTVDEVTLRKFELSDVDAMMAWASDPQVAALCRWEPYESTEPLLAFIRDVVLPHQWFRAICLGSEPRPVGAVSVSPTGDPCRAELGYVLARAHWGRGVATAAVKRTVTAVFGEVPGLERVEALVDVANLASQRVLEKAGFTREAVLRKYALTRASSGTRSCAASS

SEQ ID NO: 56645 - DNA, 688 bp, Zea mays
  misc_feature: Ceres CLONE 1498346
  misc_feature: Encodes the peptide sequence at SEQ ID NO. 56646
  misc_feature (688)..(688): n is a, c, t, g, unknown, or other
aaagctggagctccccgcggtggcggccgctctagaactagtggatcccccgggctgcaggaattcgcacgagaccattacctagaacatcctaatcaaaaaaaacaacactcgacgtacacacggccatctatcttggtcgcgaaaagaagatggcgactaagctggcggcgctcatcgtcttggcggcgttcctcggcgggcccccggcgtgcgagggcgacatcatttgcttcaacggctggctgaggctacccatccaggacccgcgcctctgtcctccgggctccaggtccaggatcaacggccgtacgcgagcgctggtgccggtgcctcgtccctcggggttagggctcggcctcggctactacaacaacaggagctccaggacgtcctactgcccgagagcggaagggatcgtgagggatgccgtaagcaaggccgtcgccgcgcaacctggcatcggtgcgggcctcatccgactcttcttccacgactgcttcgttcggggctgcgatgcttcggtcctcctcaccacgaccaactccaacaacagcgacacggaaagggaaggcaacccaacaagaacagcctgcgagggttagaggtgatcgacgccgccaagcgaagatcgaggccgcctgccccggcagagtctcatgcgccgacatcgtcgccttcgccgccn

SEQ ID NO: 56646 - protein, 150 aa, Zea mays
  misc_feature: Ceres CLONE 1498346
  misc_feature: SWISSPROT Homolog: EC 1.11.1.7 Peroxidase
MATKLAALIVLAAFLGGPPACEGDIICFNGWLRLPIQDPRLCPPGSRSRINGRTRALVPVPRPSGLGLGLGYYNNRSSRTSYCPRAEGIVRDAVSKAVAAQPGIGAGLIRLFFHDCFVRGCDASVLLTTTNSNNSDTEREGNPTRTACEG

SEQ ID NO: 56647 - DNA, 843 bp, Zea mays
  misc_feature: Ceres CLONE 1498347
ctagctggagctcaccgcggtggcggccgctctagaactagtggatcccccgggctgcaggaattcgcacgagaccattacctagaacatcctaatcgaaaattcccttctgtcgctgctcccacctctagaccgacaggcgaagccgccgacgctgcagtgtctatagccaccgcatgagactgacatggggggttttggcaacacccacaagaccaatgcgatacctctgccgtttacagggcgaagttcacgcacaacgcccggctcgccacgacacactatcggggcccggataaggcctgcattaaccgagaagaacaccaggcatattaccacccggcgctacggattttgtgtgtggcccaattccccaaccccgtacgttttgggccgaagagtgcatcccccgccaacccccaatcctgctcaaaaaagattcaataaccacccccccacccctcctgctggggggggcccgcctgctcccttggcccctcgcaacctccgctccccgggccccggcgttcgccctccctctcccttcgcctccgggcgcgtcccctccgattgaggggctccgcgggggctaggcacatccaagacccgcagtgaccatttatcaacgtttgcattattcgcgaggtccaccctgtcccccccccaaaagaggcagatgcgaccacccacgtattcttatatcaccgctcgcctctgcggctgcaaggctctctcgtccctgattgtctgtgcgtgttattaaccctctcgatccccccgcccacacacgccgcccatccacgcgcccccggcgcaacccccccccgcgccggccctcccgcg

SEQ ID NO: 56648 - DNA, 666 bp, Zea mays
  misc_feature: Ceres CLONE 1498520
  misc_feature: Encodes the peptide sequence at SEQ ID NO. 56649
  misc_feature (360)..(360): n is a, c, t, g, unknown, or other
  misc_feature (459)..(459): n is a, c, t, g, unknown, or other
  misc_feature (472)..(472): n is a, c, t, g, unknown, or other
caaagctggagctccccgcggtggcggccgctctagaactagtggatcccccgggctgcaggaattcgcacgagaccattacctagaacatcctaatcgaaaaactcacgattggagtttcacctcggcagcccagccagccagtggttcctcggctcggaggaacaggcgaacagcaagagcttctgaagatgaaggcgatccccgtggctctcctgctcctcgtcctggttgctgccgcctcctcgttcaagcatctcgccgaggcagcagacggcggcgcggtgccggacggcgtgtgcgacggcaagtgccgcagccggtgctcgctgaaagagggccgggcggtgcatggggccntgtgcattggatgtggctgcggcaagttgccagggctgccgtgccgtcggggccgtacgccagcagacgagtgccctgctacgggacatgaatcccccnagaacagcgcccnagtgcccctagaccctacggtctagggagggaggatgaccaggatttcgctccggattctgcaagcttcaagctttggacggcagtttaacccccccaaactccgaaattcccccacggttcccttccgggcttgggggggcggggtttcccccccggaaaggggtttacccctaaaaaaaatacccccagggc

SEQ ID NO: 56649 - protein, 101 aa, Zea mays
  misc_feature: Ceres CLONE 1498520
  misc_feature (57)..(57): Xaa is any aa, unknown, or other
  misc_feature (90)..(90): Xaa is any aa, unknown, or other
  misc_feature (94)..(94): Xaa is any aa, unknown, or other
MKAIPVALLLLVLVAAASSFKHLAEAADGGAVPDGVCDGKCRSRCSLKEGRAVHGAXCIGCGCGKLPGLPCRRGRTPADECPATGHESPXNSAXVPLDPTV

SEQ ID NO: 56650 - DNA, 718 bp, Zea mays
  misc_feature: Ceres CLONE 1498522
  misc_feature (48)..(48): n is a, c, t, g, unknown, or other
  misc_feature (238)..(238): n is a, c, t, g, unknown, or other
  misc_feature (255)..(255): n is a, c, t, g, unknown, or other
  misc_feature (311)..(311): n is a, c, t, g, unknown, or other
  misc_feature (313)..(313): n is a, c, t, g, unknown, or other
  misc_feature (314)..(314): n is a, c, t, g, unknown, or other
  misc_feature (350)..(350): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (420)..(420): n is a, c, t, g, unknown, or other
  misc_feature (428)..(428): n is a, c, t, g, unknown, or other
  misc_feature (450)..(450): n is a, c, t, g, unknown, or other
  misc_feature (478)..(478): n is a, c, t, g, unknown, or other
ctatgctgtagctcaccgcggtggcggccgctctagaactagtggatnccccgggctgcaggaattcgcacgagaccattacctagaacatcctaatcgaaaaacacacacaggcagacgccgttccgcgggggaaaggtgcggacgcctgaatcctctccaactccggcaccgcattcgcacgcccgcgaagccccgaatcggagaggacagaggagtcatggacgcggcggcggcngcggctgccgctgcaanccccacgagcaagaggatcgcgctggtgacgtgatggaacaaggggggcgggctcnannactgcctttttctgtcgtccaggggcgtcagtgtcnccctgacttctttttttcccccccccctggggggaaagaaagggggcgcttnnnnnnncccccccnnncnacccccantttaaataaaaacaaatctacnttctccgggggggggggcgtcgggcccnatcactctaatttcctcaaggtgtgagcctcgcggccggtgggagatcaccgatcaccaaaggcggagccttcccgccgtgctgccggacagcccgtgttggtgagcggaggaggatcgtccaaggcctcatgggttctgtccgtaaccatccttctggcgccggcccaggcctaccatcggcgcgcgaccccggcccccggcgctgtgacccggttgaggaggaagcccctacgggggg

SEQ ID NO: 56651 - DNA, 672 bp, Zea mays
  misc_feature: Ceres CLONE 1498534
  misc_feature: Encodes the peptide sequence at SEQ ID NO. 56652
aagctggagctccccgcggtggcggccgctctagaactagtggatcccccgggctgcaggaattcgcacgagaccattacctagaacatcctaatcgaaaacatttggactcggcactcggcagggatggggatggggacggaatggccgccgacgcctgcgcagcagaggaaagcggtggtgagcgccgggtcggcgctgaagctggtactgttcgtgattctcgcgggcctcgcactgcggctgctggtggggcccccagcctacctcctgccgcccaccgccgcgccagaggggggcgctcgtcttttcgccgtgccggagagggaaagaaccgccggcggcggcggcggcgggataccttccgtcgaaagttgtgatcttttccatggcgagtgggttcccaattcatcaggaccagcttatactaatgcaagctgccgcttcattgagtctcctcagaactgtatgacaaatggaagacctgacacagattatctcaattggagatggaagccatatggttgtgaggtatcaccatttgacggcaagaagtttttggatggcatgaaaggcaagcattgggcactcattggtgattccatccttcgcaaccacgtccagtcattgctttgtcttctttccaaggtcgaagatgctactgaggtttac

SEQ ID NO: 56652 - protein, 182 aa, Zea mays
  misc_feature: Ceres CLONE 1498534
MGMGTEWPPTPAQQRKAVVSAGSALKLVLFVILAGLALRLLVGPPAYLLPPTAAPEGGARLFAVPERERTAGGGGGGIPSVESCDLFHGEWVPNSSGPAYTNASCRFIESPQNCMTNGRPDTDYLNWRWKPYGCEVSPFDGKKFLDGMKGKHWALIGDSILRNHVQSLLCLLSKVEDATEVY

SEQ ID NO: 56653 - DNA, 623 bp, Zea mays
  misc_feature: Ceres CLONE 1498547
  misc_feature: Encodes the peptide sequence at SEQ ID NO. 56654
  misc_feature (529)..(529): n is a, c, t, g, unknown, or other
  misc_feature (544)..(544): n is a, c, t, g, unknown, or other
aagctggagctccccgcggtggcggccgctctagaactagtggatcccccgggctgcaggaattcgcacgagaccattacctagaacatcctaatcgaaaacaagcgtcccgcgagaaactggtgttccggaccaccacgcggatgggctcgggcgacccggcggccgaccccctttcttccttcctccgccaccccggcgcgttctccttctcccgtcgcgtcgccatggcgcgcgacgccaccgccacatccgtgccagcgctccgcccctggctcgttgacctcctcccgctcctcgtcgtcctcctcatcgccgcccacgtcctcgccctcggttactggatctacaggctcgccacggacgggtccaggcagcccgcgcggagcaagaagcactaaggggacggcgcccgcggccggatgcttgaaacagtttgttattcagtcctgcatcctttggcttgtgatctcccagccttcaacgtcagatgatggcgtggaaagtcccctgaaagactaggacaggnaaccgatcctatccnatggttttgtcagatgtgggtgtcaaaagtgacgatagctgaatagctgaatggtgaaaggaggccttttgaacataaa

SEQ ID NO: 56654 - protein, 57 aa, Zea mays
  misc_feature: Ceres CLONE 1498547
MARDATATSVPALRPWLVDLLPLLVVLLIAAHVLALGYWIYRLATDGSRQPARSKKH

SEQ ID NO: 56655 - DNA, 692 bp, Zea mays
  misc_feature: Ceres CLONE 1498549
  misc_feature: Encodes the peptide sequence at SEQ ID NO. 56656
  misc_feature (692)..(692): n is a, c, t, g, unknown, or other
aaagctggagctccccgcggtggcggccgctctagaactagtggatcccccgggctgcaggaattcgcacgagaccattacctagaacatcctaatcgaaaaatataagcgccagcagccacggcaggtggagctcatcgcatccatccaccacgcaccccaccaacccatacccataccagaggctctctgattttacttctccgcggtagatcggctgagcgagcgagcgaggcacacggagctagctaaacagagcacacgggtagaaaagcaagatgtcggacggcacggcgacctgcatcgacatcatcctcgccatcatcctgccgccgctcggggtcttcttcaagttcggctgcggggttgagttctggatctgccttatcctcaccttcctcggctacctccccggcatcatctacgccgtctgggccatcaccaagtagccggccggagcagatgaaccacggtcccctgccagtgccaggcagctagctgtgactccgtcgcgtgcgttagcatgcaatgcaagcgcagggtggtctcgtggggggacgtggtgtgcgcgtgtcttgagatgtgattccttccttctttgtttagttgctgctgctcctgctggtgtagtactggtgtatccagtccttttaatttcttgattagtttgctcggctgaagaaatcaggacn

SEQ ID NO: 56656 - protein, 56 aa, Zea mays
  misc_feature: Ceres CLONE 1498549
  misc_feature (6)..(56): Pfam Name: UPF0057 Pfam Description: Uncharacterized protein family UPF0057
MSDGTATCIDIILAIILPPLGVFFKFGCGVEFWICLILTFLGYLPGIIYAVWAITK

SEQ ID NO: 56657 - DNA, 824 bp, Zea mays
  misc_feature: Ceres CLONE 1498576
  misc_feature (35)..(35): n is a, c, t, g, unknown, or other
  misc_feature (38)..(38): n is a, c, t, g, unknown, or other
aaaatttaaaccactccacatgaggaagagacacnccncccaccaactataccaagctggaactccccgcggtggcggccgctctataatagtggatcccccgggctgcaggaattcgcacgagaccattacctagaacatcctaattgaaaatccattcctctctgctctgttctgctccaccaccctgatgacgacgaggccagacggcagcgcctccacgcccgcggacaagcagctcgtggcggcctccaacggcaacggcaacggcaacccgctggccgtccgcaaggcgccctccaaggaccggcacagcaaggtggacgggcgaggccggcgcatccgcatgcccatcatctgcgccgctcgcgtgttccagctcacgagggagctcgggcacaagtccaacggacagacaatcgaggggttgttaaggaaggccaaacccctccatcatcgccgccaccggaacccggcaccacgccgggcactccttctccaacctcgtcccccgtcaatcgctccggttccctccttcgtcctcccaaaagccggggggtccaacccgcaacggccggcccccggggcccaaggggattcctggggtcccctgccccgggcgccgggccccaaactttccgaaaaagcctcttgggaaactttcccccgccccccccccccagaaaaaaagaatgggccccgcccccgggtcttgaaaaacaaacaaacacccaccggagcaattgggacccggtggagaaaggcactccccctcccccccacaggtggtccggaaataataataaccctccccccccggtgcg

SEQ ID NO: 56658 - DNA, 749 bp, Zea mays
  misc_feature: Ceres CLONE 1498587
  misc_feature: Encodes the peptide sequence at SEQ ID NO. 56659
  misc_feature (14)..(14): n is a, c, t, g, unknown, or other
  misc_feature (15)..(15): n is a, c, t, g, unknown, or other
  misc_feature (20)..(20): n is a, c, t, g, unknown, or other
  misc_feature (21)..(21): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
ggtgggcccccccnnccccnncgctggccgttnnnncctcacaagggagagctggagctccccgcggtggcggccgctctagaactagtggatcccccgggctgcaggaattcgcacgagaccattacctagaacatcctaatcgaaaaatggacgcaacacctgataatcatttctgggatcatttctcaggtcgcgcagcaaagtagcaaactcctgcgaccctacccaccgcacctaccattctggagaggagaggaacagagccaagaaacaagcccggaagatggcaggcggcggggtggtgaagcacatcctgctggcaagcttcaaggaggaggtgacgcaggatcgcctggacgagctcatccgcggatacgccgcgctcgtcggcgtggtcccctccatgaaggccttccactggggaactgatgtgagcatagaaaacatgcatcaagggttcacgcacctcttcgagtccacgttttgaaagcacggaaggaatcaaggagtacattgagcacccctgcacacgtcgaattcgcaagtgtgttcttgcctgtgctggagaagggccctcataatcgactacaaaccgacgtcggccatttaggggaagaacatgctctgtacttgttccctggaaggatcaagtttggttctactctttattttggcaaaaaaaacccggtctgctttgtccccttgtaaaaaaatgagctttggagttttcctggaagtggaatttg

SEQ ID NO: 56659 - protein, 67 aa, Zea mays
  misc_feature: Ceres CLONE 1498587
MAGGGVVKHILLASFKEEVTQDRLDELIRGYAALVGVVPSMKAFHWGTDVSIENMHQGFTHLFESTF

SEQ ID NO: 56660 - DNA, 873 bp, Zea mays
  misc_feature: Ceres CLONE 1498590
  misc_feature: Encodes the peptide sequence at SEQ ID NO. 56661
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (456)..(456): n is a, c, t, g, unknown, or other
aaaaggtgaacgaccaaaaatctgcgagtcaacccnnnnnnntnnnnnnnnccctagctggagctccccgcggtggcggccgctctagaactagtggatcccccgggctgcaggaattcgcacgagaccattacctagaacatcctaatcgaaaaagacgcgcacccaaaaccccacaaacaccattgggccttcgccttcgcccatcctttcctactccaatctccacagaccacagtccacaccctccgggcgccggcctccacatctccattcttgtcccggaaccatgtcgatgcttctctcgcgaaggttctcctgcgccctcgcccgcgcccgcgccccgtcgctcgtacggggcgggccccttcctccctgcgccgcccgcaccacccctccgggtccaaggtccccgccccgccgcctcatgtcggccctccctccggcggggggggnaaaactcctcggaaacggccccccgcccggcggcggccttcttctttaattccgggggggttgaaaaagggaccaatctgttctcggggggcctgggaaggcgggggccttggggccacccgggtttaaaatctcccaaaacccgtgggggggcccccctcccccggaaccccaaaagagaaccctcccaaacaagggggggcccaccaagggggggtccgcaaaaaaaaacccccctcccccaaaaaaaaacttctacacggaaaaaaggggaagagggactccctttttttttttctcccccccaaaaacaaaaggggggaaaagagaagccccccgtaagaatttaaaaaagaaaaaaataattttttttctttgtagaaggaggaggagattttcccccacaaaatggcaggg

SEQ ID NO: 56661 - protein, 71 aa, Zea mays
  misc_feature: Ceres CLONE 1498590
  misc_feature (56)..(56): Xaa is any aa, unknown, or other
MSMLLSRRFSCALARARAPSLVRGGPLPPCAARTTPPGPRSPPRRLMSALPPAGGXKLLGNGPPPGGGLLL

SEQ ID NO: 56662 - DNA, 761 bp, Zea mays
  misc_feature: Ceres CLONE 1498591
  misc_feature: Encodes the peptide sequence at SEQ ID NO. 56663
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
attgaataattaaaaaaaaaagcgcgcaaaaacnnnnncgcccccnnnccaaagctggagctccccgcggtggcggccgctctagaatagtggatcccccgggctgcaggaattcgcacgagaccattacctagaacatcctaatcgaaaaacaccagttcaccgtcgtcttcctcaactcttcctctcctctctcttctgcaccatctggtgtgcgtgcgcgttactcgccgcgtggatcgaagaaagaggcgcacgggagcgagctacgcgaagcaaggccatggcgaagggcgggctggccaagcttcggtgcatgatcaagaggtggcactcgtccagccgcatcgcccgcgcgccgccgtctcccggccccggcgaggatgaccgctgcgccgcgcgcggcgcgtcgttccacggcgcggacgaggtgcccgagggcctgcacccggtgtacgtcggcaagccgcgccgccggtacctcgtcgccgaggagctggtgggccacccgctgttccagaccctcgtcgaccgcatcggcggcggcaccggggcagcggcggcgggtaccgtcgtcggctgcgaggtcgtgctgttcgagcacctgctgtgaatgctgaagaacgcggaccccgccgccggagtccctcgacgagctcgtccgagtacctatgcgtgctggagaacagagtcattagagccctcgcccccgagcccgccaagtctcgggccggtgaacgcagcggcgggcccggaacggg

SEQ ID NO: 56663 - protein, 109 aa, Zea mays
  misc_feature: Ceres CLONE 1498591
  misc_feature (12)..(110): Pfam Name: Auxin_inducible Pfam Description: Auxin responsive protein
MAKGGLAKLRCMIKRWHSSSRIARAPPSPGPGEDDRCAARGASFHGADEVPEGLHPVYVGKPRRRYLVAEELVGHPLFQTLVDRIGGGTGAAAAGTVVGCEVVLFEHLL

SEQ ID NO: 56664 - DNA, 800 bp, Zea mays
  misc_feature: Ceres CLONE 1498598
  misc_feature: Encodes the peptide sequence at SEQ ID NO. 56665
  misc_feature (21)..(21): n is a, c, t, g, unknown, or other
  misc_feature (36)..(36): n is a, c, t, g, unknown, or other
gtgggggggctcgtgcgctcnacacccccccctttntttatataacccaccaaaaactggagctccaccgcggtggcggccgctctataactagtggatcccccgggctgcaggaattcgcacgagaccattacctagaacatcctaatcgaaaacggacccaatgctgaaaagattcataggggtagaattacagaagaaaatccaaagccaaggggtcattgcagaagccgcagtccaagacagaggtatcgagaggattatcgggatagagactatagaaggcgaagccagagcagaagtagggagcgatatgaacaggccgggtacagagatggtgatcatcgtcgccataggactcacagtatcagtcctgattatgacaggaaaacgtaacagacacagtggctctcctgtacttaaacgccccagtcatagcagaagccgttcgcctcgtagggcacctcatgaccccactacctatcaagcccagagatgcccccgcctgcatgtttctggaaagcccttgacccttgaacttgtggcttgaatatcaacacagtttcctcccgggaacagcttggaggcatctaaaccggttcccactcatttgggaatttttctaactaaaaaaggcccttttgttttatcccccgggatggagtcaaaacccgaccttttgggcaaaaaaaacaaaagggcccggcttggggtaaccgaaaaccctcctgggggggacaaagtgatgggaaaaatttgggggggcacaaaacttttcaaatttctccggacacggggcg

SEQ ID NO: 56665 - protein, 128 aa, Zea mays
  misc_feature: Ceres CLONE 1498598
MLKRFIGVELQKKIQSQGVIAEAAVQDRGIERIIGIETIEGEARAEVGSDMNRPGTEMVIIVAIGLTVSVLIMTGKRNRHSGSPVLKRPSHSRSRSPRRAPHDPTTYQAQRCPRLHVSGKPLTLELVA

SEQ ID NO: 56666 - DNA, 784 bp, Zea mays
  misc_feature: Ceres CLONE 1498607
  misc_feature: Encodes the peptide sequence at SEQ ID NO. 56667
  misc_feature (27)..(27): n is a, c, t, g, unknown, or other
  misc_feature (28)..(28): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (46)..(46): n is a, c, t, g, unknown, or other
ttttcggtccttcgaaaccccccgctnngtgggtgggnnnngaccnttttttttaaagctggagctccccgcggtggcggccgctctagaactagtggatcccccgggctgcaggaattcgcacgagaccattacctagaacatcctaatcgaaaaatttttctctcctcactcaacgcggcgatgccccctagatcggatcacgccgccggcagcggcgccgcggcggcggccacgcaggcccacttcgactccatcgatccactcttccatgtgctccgcgtgctacccttctccttcctcctgccgccgcgcacccgcctgaggctgccgtcgaacctggcgcttccctctcccatgaccgtcttctccctcattctgctcacctactttgcggtcgtctccggactcgtgtacgacgtcatcgttgagacccctggcatcagcagcgcccaggaccccggcactggcgccgtccgcccccgtcggcttctgtccagggcgcgtcaccgggcagtacatcctccaagggactctcctcccgggttcatgggtcccccttgggcggcattggcatcattcctcctccgaccgcgccgtcgaccggcacgaggccccgggagccctcccccgtcctcgtttgggaaacggcccgggggccagtcggccgggggtccaaccggcgggttttgtggcccagtgcgccatgggttcttttccccccctggaataaaagggaaaaccctcgggggaatcacccccggcgggtaaagagagataaaaa

SEQ ID NO: 56667 - protein, 195 aa, Zea mays
  misc_feature: Ceres CLONE 1498607
MPPRSDHAAGSGAAAAATQAHFDSIDPLFHVLRVLPFSFLLPPRTRLRLPSNLALPSPMTVFSLILLTYFAVVSGLVYDVIVETPGISSAQDPGTGAVRPRRLLSRARHRAVHPPRDSPPGFMGPPWAALASFLLRPRRRPARGPGSPPPSSFGKRPGGQSAGGPTGGFCGPVRHGFFSPPGIKGKTLGGITPGG

SEQ ID NO: 56668 - DNA, 695 bp, Zea mays
  misc_feature: Ceres CLONE 1498620
  misc_feature: Encodes the peptide sequence at SEQ ID NO. 56669
aaagctggagctccccgcggtggcggccgctctagaactagtggatcccccgggctgcaggaattcgcacgagaccattacctagaacatcctaatcgaaaaacactcgatcgcagtttgcagaaagctagaagacacaagaacatggcgtccaagcgactcctcgtgctagtagctctcctgctcgccgccgttttccttgccgtctcaggagcagctaacgacgaccaagcccaaccgaggaaggacgacggcggcgagaacaaagccgacgtgcaggactaccgtggcggcggcggcggctggcgcggtgggggtggctaccccggccgtggctacccgggcgggggcggctaccctggcggcggccgcggcggttactgcaggtgggggtgctgcaaccgcgggtactatggcggctgccggtgctgctcgcgcgccgacgaggtcccggagcccatgtaccgcccggaacccaccgaggtccacaactgaagccgagccacacatcgatctacaaagatgcatggacgacgactcttatcttagctaattaataagcactacatccatgcaggtccacaatagggccctagccctactatactatacgcgtcagcagaaagggcccgggttttgatttcaataataaatgcacctataatgtggtgtgtgttacaaaaaaaaaaaaaaaa

SEQ ID NO: 56669 - protein, 116 aa, Zea mays; identical to SEQ ID NO: 40624
  misc_feature: Ceres CLONE 1498620
  misc_feature (1)..(93): Pfam Name: GRP Pfam Description: Glycine rich protein family

SEQ ID NO: 56670 - DNA, 680 bp, Zea mays
  misc_feature: Ceres CLONE 1498622
  misc_feature: Encodes the peptide sequence at SEQ ID NO. 56671
ctggagctccccgcggtggcggccgctctagaactagtggatcccccgggctgcaggaattcgcacgagaccattacctagaacatcctaatcgaaaaatcggtagcatcgacacgagcgggacgagcatgctggacgagctcaacaagtccttggacaggaggggaatgcaggtaaagagcagaagcgatggcacatccatccacctgattcagtgctttaattatctgctctcaactccagcagagtgttctgaaaccagtgctgtctttcttttgttcgcagatcgtgctggcgaacccgggcagcgagatcatgaagaagctggacagctccaaggtgctggagcagatcggccacgagtgggtgttcccgacggtgggcgaggcggtggcgtcgtgcgactacgtgctgcactcgcacaagccgggaatggtgaaggacagcgccgccgcccacgagagcatggtgtgacgagcaccgccacgccaaccgtatgtgtagtgtgctccggttccggtctgacgtaaccagtcgtcacgcggaccgagatgaattatgtatacacgtgtctcgagtattgtacacctgcaccgtcgcgtgaaaaacgattcagagaagaaaggatcccacccggttttttttggtgaagaaaaaaaaaaaaaaaagcttatcgatac

SEQ ID NO: 56671 - protein, 52 aa, Zea mays
  misc_feature: Ceres CLONE 1498622
MKKLDSSKVLEQIGHEWVFPTVGEAVASCDYVLHSHKPGMVKDSAAAHESMV

SEQ ID NO: 56672 - DNA, 769 bp, Zea mays
  misc_feature: Ceres CLONE 1498625
  misc_feature: Encodes the peptide sequence at SEQ ID NO. 56673
  misc_feature (21)..(21): n is a, c, t, g, unknown, or other
  misc_feature (769)..(769): n is a, c, t, g, unknown, or other
tttttcccacccacccccttntttgggaaaaatgctttgagatttttttccaaagctggagctccccgcggaggaggacgctctataactagtggatcccccgggctgcaggaattcgcacgagaccattacctagaacatcctaatcgaaaattcaatcccagtcccacacaaagtttctcctcgatcctcatctccctctctcgagtcaagagcagagcagctaccaaacaagctctcctttcgcttccgatccatggagctcgatgccgacaacctgagcgccaccgagctccgcctcggcctgcctgggaccagcagcagcagcagagacgactggcagaagaagccgtcgccctccgtcggggccaagcgcgttctggacgacggcaccaagagcgaggcctcggggaccagcacggccgccggagacctcgacttcgaccacgacaccggcgcgcctcccaaggcgcaagtggtcgggtggccgccggtgagggcgtacaggaagaacaccttccaggcggcggcggccaaaaaggtcgagcagaagcagcagcagggaggcctgtacgtgaaggtgagcatggacggcgcgccgtacctcaggaaggtggacctccggatgtacaaggggtacagggagctcatggaggctctgggagcgctccttcaccaaatccttctccagcggcggcgggaagaaggggggcgggcgaccaaccaacacgccattcgccctacgaaggacaaagaaggggcgacctan

SEQ ID NO: 56673 - protein, 170 aa, Zea mays
  misc_feature: Ceres CLONE 1498625
  misc_feature (7)..(157): Pfam Name: AUX_IAA Pfam Description: AUX/IAA family
MELDADNLSATELRLGLPGTSSSSRDDWQKKPSPSVGAKRVLDDGTKSEASGTSTAAGDLDFDHDTGAPPKAQVVGWPPVRAYRKNTFQAAAAKKVEQKQQQGGLYVKVSMDGAPYLRKVDLRMYKGYRELMEALGALLHQILLQRRREEGGRATNQHAIRPTKDKEGAT

SEQ ID NO: 56674 - DNA, 746 bp, Zea mays
  misc_feature: Ceres CLONE 1498627
  misc_feature: Encodes the peptide sequence at SEQ ID NO. 56675
  misc_feature (20)..(20): n is a, c, t, g, unknown, or other
  misc_feature (36)..(36): n is a, c, t, g, unknown, or other
gacaacaaaaaaaagtaagnagagaaattcaaatanacacaacccgacacaaacttggggctccccgcggtggcggccgctctatactagtggatcccccgggctgcaggaattcgcacgagaccattacctagaacatcctaatccaaaagtctcccaatctttcttgctgctccaattcgctctctttactcggccagcggaaggggagaggagggcgagatgacggtggagaaggtggacgcggggctttccgacttcgacgcccacttcgatcgcctcttcgcttccccggacgccgcctccgacggcaaggtgaagctgctgctcttcctggccgaccgcaagcctggctcctccctctcctggtgccccgactgcaacgtggcggagccggtgatctacgagcggctggaggcactggagggcaaggacgcggtgctcctgcgcgcctacgtcggggacaagcccacctggcgcgacccggcgcacccgtggagggtggaccccaggttcgggctcaagggcgtgccaacgctgatccgctgagaggatggcgtcgccgccgcccgcctcggggacgacgaagcgcacctcaaggacaaggttgacgccctcctctgcgctggcggcaactgaatactgacagatctggtaccccgttcgggttccatctgccgagagaggccataaaaacatgtaccgaacattcaattctcctacatggccggaccaaaagctagggg

SEQ ID NO: 56675 - protein, 108 aa, Zea mays
  misc_feature: Ceres CLONE 1498627
  misc_feature (9)..(109): Pfam Name: DUF953 Pfam Description: Eukaryotic protein of unknown function (DUF953)
MTVEKVDAGLSDFDAHFDRLFASPDAASDGKVKLLLFLADRKPGSSLSWCPDCNVAEPVIYERLEALEGKDAVLLRAYVGDKPTWRDPAHPWRVDPRFGLKGVPTLIR

SEQ ID NO: 56676 - DNA, 799 bp, Zea mays
  misc_feature: Ceres CLONE 1498632
  misc_feature: Encodes the peptide sequence at SEQ ID NO. 56677
aggaattaggtcacttcaatgtttataggggggggctacaaaaaaactgatagataaaagacacgcggtggcggccgctctagtactaatgcgatcccccgggctgcaggaattcgcacgagaccattacctagaacatcctaatcgaaaagagtttcgacacgcgtgcccaggaatcggtcggattccccaatcccgtcaccatggccgcgccgccttctccttcgtcccgctccccgtcgagcgaggttgccgtccacagattcagcggcaccttggatgtatcatcatcgccctctaggaccgagttgctgaacatggtgaagaagcactcacatttgattgggtggacgattattggtgccgaggatgatgcatcatatgtgggaatggatgataaattctggcatgaaatgcttgacctattctttgtgcgtggctggcaatcaaaaagaattgaataggatgaccctgccttctttgttaataacatgaaattgcatggctatggtttcaatgataacctggaagatccacctccctttttctgtacagagatggggctcccacgcttgcaaaaatcaatattaaacacagtggaagttggattggggagcgtacattcgcatttgaacatgaaatcgctcacaaggtcgtaaaactggactactggttggcaatattttgcgaattgaaaaaatacttactcaacccagaggtagcggaacaagaacaaccagtttggccgtcccagttcttatacacggcctaccacaaaaaagtggcgttatcctcgctc

SEQ ID NO: 56677 - protein, 86 aa, Zea mays
  misc_feature: Ceres CLONE 1498632
MAAPPSPSSRSPSSEVAVHRFSGTLDVSSSPSRTELLNMVKKHSHLIGWTIIGAEDDASYVGMDDKFWHEMLDLFFVRGWQSKRIE

SEQ ID NO: 56678 - DNA, 825 bp, Zea mays
  misc_feature: Ceres CLONE 1498635
  misc_feature: Encodes the peptide sequence at SEQ ID NO. 56679
  misc_feature (585)..(585): n is a, c, t, g, unknown, or other
ggggggtggatcactcaatatggatttttactatatggtgggtccccccccacacctggaactccccgcggtggaagccgctcttgtactagtggatcccccgggctgcaagaattcgctcgagaccattacctagaacatcctaatcaaaaatacaggcacgaaacctcgcgccgccaccaaatctccagcgagcgaagaggcggctccggctagtgcgcggcaacgacgaaggcgtcggggccagtggcgagaggaagagcatgctgaagttcctgtccaaggaggtggtggagtactgccctctggacccgcggaaggcggcggcagtggagctcctcgcgcagtgcaacagccgcaaggccaaggactccaacccggcttgctcggtcgagctccgccgcctcccctccccagctccgtccacggaactcaagtcacaaccgactctcccgcctccgagggtcctcgagacccccccttcacccggaactgaaagaggccatcgtcttttgctgagggtagctacggcgccacggcatcccgcaaccagatcgtccccccggggcccggctcatcccattnggaagaagatgttcccgttattgtcggtgaagaaaatggccccgtcagtcatacccccgacgaagaagccttgggcactgtccattcccctggccactcggggccaaaacaaaagcccgaaggattaatcccccacgggccgcagtaggaccaaagcagggaagtttttccccaactttaccttttaatcacaggccatataactgttggggacaatttcttgtgccccctctccccagc

SEQ ID NO: 56679 - protein, 149 aa, Zea mays
  misc_feature: Ceres CLONE 1498635
  misc_feature (108)..(108): Xaa is any aa, unknown, or other
MLKFLSKEVVEYCPLDPRKAAAVELLAQCNSRKAKDSNPACSVELRRLPSPAPSTELKSQPTLPPPRVLETPPSPGTERGHRLLLRVATAPRHPATRSSPRGPAHPIXKKMFPLLSVKKMAPSVIPPTKKPWALSIPLATRGQNKSPKD

SEQ ID NO: 56680 - DNA, 786 bp, Zea mays
  misc_feature: Ceres CLONE 1498637
  misc_feature: Encodes the peptide sequence at SEQ ID NO. 56681
  misc_feature (765)..(765): n is a, c, t, g, unknown, or other
tttttcccccccccatccgttaataaacaacaaagagggagagacatcaaaaaactggaactccccgcggtggcggccgctctataatagtggatcccccgggctgcaggaatgcgcacgagaccattacctaaaacatcctaatcgaaaaaatttgcttcccagatctgcccgccgcacccccaacccgtggcaatcaatccccttcctcgcttcgcaaatggctcattccaacggcgcggccgccactgccactgccggcggcggcgacatggacgacgagaccgccccggtgccgcgggccctcgcgccggcgcggaaggtggcgctgatcacgggcatcacggggcaggacgggagctacctcacggagctgctcctgtccaagggatacgaggtgcacggcctcatccgccgctcctccaagttcaacacgcagcggctggaccacatctaccaagaggcgtcaccccccgccgtcggccccgcgtcccccgatgcggctccactacgccgacctgtcagaatcctcttccctccgccgcgcgctcgacgccctctcccccgacgaggtctacaacctcgccgcgcagtcacaacgtcgccgtctcctttcaagatccccgaactacacctcccaacgtcaccagccacgaggaggcggctccagcctcctcaaaggcccgtcccgccctgttcgacgccaagccccatgcggcttcctaaccaatgacaagtttctcttcagaaaaaatgtttcaaganctctcaacacccaacgcatcc

SEQ ID NO: 56681 - protein, 170 aa, Zea mays
  misc_feature: Ceres CLONE 1498637
  misc_feature: SWISSPROT Homolog: EC 4.2.1.47 GDP-mannose 4,6-dehydratase
MAHSNGAAATATAGGGDMDDETAPVPRALAPARKVALITGITGQDGSYLTELLLSKGYEVHGLIRRSSKFNTQRLDHIYQEASPPAVGPASPDAAPLRRPVRILFPPPRARRPLPRRGLQPRRAVTTSPSPFKIPELHLPTSPATRRRLQPPQRPVPPCSTPSPMRLPNQ

SEQ ID NO: 56682 - DNA, 733 bp, Zea mays
  misc_feature: Ceres CLONE 1498639
  misc_feature: Encodes the peptide sequence at SEQ ID NO. 56683
ggagctccccgcggtggcggccgctctagaactagtggatcccccgggctgcaggaattcgcacgagaccattacctagaacatcctaatcgaaaaactttcctctaccttgcagactgcacactgcctcaagatggtttcctgttcctcatctccacggccacccatccctctcctgctcctcttcctcctccacttctcctctgtcctcgccgtatcagctccttcagcctcacaacaggctggtaccgacggcggcggcggcaaatggtgtcaggagaacggccgggcaatgggaacgcccggcgggttgaagaaaacgttcttggaacggcggcatcaaacactgtcaacgggcgggcggttggttggggcggtttccagggggggcccgggggggaacctggctgacggagggcccccacaggaaagcgccccccccgggcccctgggttgttttcccccctccaaatgggaaaatttccccaaaacggtcaatttctgggggtttgggttccttttacccccggggaaaaagagataaaatgggccccctattttgccacccctcttaaaatataaacccttttggccccccaaaatataacccaaaggggttgaggaaaaaaaacgcctgcgcgaaaacacccgagggtttatataaatatgtatccccccttttttttaaagaagagggtctcccaacaaaaattcgagaaaaaatatctccaag

SEQ ID NO: 56683 - protein, 136 aa, Zea mays
  misc_feature: Ceres CLONE 1498639
MVSCSSSPRPPIPLLLLFLLHFSSVLAVSAPSASQQAGTDGGGGKWCQENGRAMGTPGGLKKTFLERRHQTLSTGGRLVGAVSRGGPGGNLADGGPPQESAPPGPLGCFPPSKWENFPKTVNFWGFGFLLPPGKKR

SEQ ID NO: 56684 - DNA, 781 bp, Zea mays
  misc_feature: Ceres CLONE 1498645
  misc_feature (195)..(195): n is a, c, t, g, unknown, or other
  misc_feature (197)..(197): n is a, c, t, g, unknown, or other
  misc_feature (215)..(215): n is a, c, t, g, unknown, or other
  misc_feature (217)..(217): n is a, c, t, g, unknown, or other
  misc_feature (307)..(307): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (609)..(609): n is a, c, t, g, unknown, or other
  misc_feature (610)..(610): n is a, c, t, g, unknown, or other
  misc_feature (688)..(688): n is a, c, t, g, unknown, or other
  misc_feature (702)..(702): n is a, c, t, g, unknown, or other
  misc_feature (781)..(781): n is a, c, t, g, unknown, or other
cgggggggcgcggcgggacacgcgtggaacgtatagtgtgtttaaaatagctgtgtttgttggtaattatagaggtggaggtcgatctaaactaatgtattccccggtctgcaagattcgcacgataacattacctacaacatcctaatcaaaaaacgaaacgctagacctatcctcttcttcaaaaggctagancnatttagaataagagatgnanctattaaaaaacgacaccccgatcccattcctccccaagcccttcaactatccactcacgcgtccccggagaagcggcgagatgtacggnatcctgacctccccctgccctcgagccccgcttctccgcgctctcccgagcccatccgcccaagcattccccagaaaactaaacttccacgttaagcccctcccccgagggtttctgtctgtaccttccgcacgcctccatggaaggcttgaatggaatgatatatgtgttttgacaagccttaatggtgattnnnnntttcgaattttgaaagccgtctctagtgagataatataaaaaaaaaaaccccccccccccccaaaaaaaatgtaatatttatttgcgnnnntaataatatgggnnctttaaaccggagaagttatatcctctatgggagtgagtgtatttctgttattctcaaaaaatctactgtgatagacnagagactttttgtngattcgtgtgaaatatattaataaaaaaacttctccccgaaataggagccgtgggttctttttccccccccttatatan

SEQ ID NO: 56685 - DNA, 845 bp, Zea mays
  misc_feature: Ceres CLONE 1498764
  misc_feature: Encodes the peptide sequence at SEQ ID NO. 56686
  misc_feature (20)..(20): n is a, c, t, g, unknown, or other
ttaatattcacccgaataanttcttgaaaatacctaacaacccccacgttctccatcgttactcaccccggtggcggccgctctagactagtggatcccccgggctgcaggaattcgcacgagaccattacctagaacatcctaatcgaaaagctactcttcatcataaaccctaataaatccatctccgcctctggttcgtcctccatctcctcccaaatcgcggcaccaagcacccgaccgctttccgcatggcttcccacatcgacttccgctgcttggatgagggcctccgatgtgagcgccgcaagcgcaagcgtctcgaggatgccgaggcggtggtcgcggattccatggacctccatgccgacgcgcaccggccgtctaaagctccgcgccctgtcttccctctccaacccctagaagtcggcccccttcggccagcccacctacaacatcgttcattgcatgcccccccccccagacgagcggtgtcaaacgagcgccccgcccagggcaagacgtccggccgaggcgggacgtccatggatccccgaccccctcagcgagtagcggtgtcccggggaataaacccgcctgaattgatgcgttaataaggccccagcacgggtggtaacctcaattgtagtcagactccggacagaaactaaagtggggccccaaacgcggaaatgtcctccttccgcgattggtgcgccaacttttaatttcttcgcagaacctttttctcttgcggtccccccaaacctgggatgaagggagttcaccataccccctacgtaacatttccgccaaagaaaggccccaagttccccccgacctcg

SEQ ID NO: 56686 - protein, 120 aa, Zea mays
  misc_feature: Ceres CLONE 1498764
MASHIDFRCLDEGLRCERRKRKRLEDAEAVVADSMDLHADAHRPSKAPRPVFPLQPLEVGPLRPAHLQHRSLHAPPPRRAVSNERPAQGKTSGRGGTSMDPRPPQRVAVSRGINPPELMR

SEQ ID NO: 56687 - DNA, 651 bp, Zea mays
  misc_feature: Ceres CLONE 1498773
  misc_feature: Encodes the peptide sequence at SEQ ID NO. 56688
  misc_feature (340)..(340): n is a, c, t, g, unknown, or other
tccccgcggtggcggccgctctagaactagtggatcccccgggctgcaggaattcgcacgagaccattacctagaacatcctaatcgaaaaacctccatccagctcgagccagcccgccgccttcgcgcatctctctacacttctactgcttcatactctcgtagagagatcccgcgcggcccaataaaaacccgactcgctagctacactacacactcgcagatggccggcctcaggatgaagttcgtcgccgtcgccgccatggccgccgcgctcgtggcgtccgccgcagccgccgaggcccccgcccctggccccctgcctccgaacgccgcgggncgcccgtgccccttcggcggggggcttcccttcgccgccggccgcctttggggtaacttcttctggtaaaatcccgccctggaacccggggtttggggccttaaatttggggattcgcccggggccgaaagggaaaccccgggtcctggcgcgggttcttggggaaaatttttttccggggggggggggtttttttttttttaggaaactccccccaaaaaaaaaaaagggtgcgcgccggggggggaacaaatcgcctcccacacccccccttgtgttttggggggggggaaaaataatgtggtcctccc

SEQ ID NO: 56688 - protein, 61 aa, Zea mays
  misc_feature: Ceres CLONE 1498773
MAGLRMKFVAVAAMAAALVASAAAAEAPAPGPLPPNAAGRPCPFGGGLPFAAGRLWGNFFW

SEQ ID NO: 56689 - DNA, 717 bp, Zea mays
  misc_feature: Ceres CLONE 1498778
  misc_feature: Encodes the peptide sequence at SEQ ID NO. 56690
ggagctccccgcggtggcggccgctctagaactagtggatcccccgggctgcaggaattcgcacgagaccattacctagaacatcctaatcgaaaaaaaaaatatttgtttggtgagccacgctcccgtccggatccgcgggggaggacggcgatttcgtccccagcctcacgaggtcgggaaggggttcccgcacccacatttgtgaacctcgccgccgcccgtcccctgccttcacgaacccgtcgccgcccgtcccctactcttcctcgtgcacccaccgtcgctcgtcccctcgtcttccttgcgctctcgccgtcgccgcctcctcaccctcacgcacttgaggccagctgcggaacgaggtcggacggcggagacgaggtcgaggtctgtgacctcctcaacttgcgcaagactgccgagactgcagggacaagctctttgctgcctcgtcagctgcttctcggatactaacaaatgggttctataattgagttgataaggaaacatttgaagcagggtgatacacaagggattttcatcaacaagtggccgccagaagaactgaaacatcaagatggcgtttgcttttaggtcatgccattcaggagtacactgagactgttttattatgagactatgttttattatgatgcactgagactatgtttgtgtacactgagactatgttttattatgatgcactgagactgg

SEQ ID NO: 56690 - protein, 38 aa, Zea mays
  misc_feature: Ceres CLONE 1498778
MGSIIELIRKHLKQGDTQGIFINKWPPEELKHQDGVCF

SEQ ID NO: 56691 - DNA, 741 bp, Zea mays
  misc_feature: Ceres CLONE 1498781
  misc_feature: Encodes the peptide sequence at SEQ ID NO. 56692
  misc_feature (477)..(477): n is a, c, t, g, unknown, or other
  misc_feature (478)..(478): n is a, c, t, g, unknown, or other
  misc_feature (491)..(491): n is a, c, t, g, unknown, or other
  misc_feature (504)..(504): n is a, c, t, g, unknown, or other
  misc_feature (507)..(507): n is a, c, t, g, unknown, or other
  misc_feature (523)..(523): n is a, c, t, g, unknown, or other
  misc_feature (538)..(538): n is a, c, t, g, unknown, or other
  misc_feature (539)..(539): n is a, c, t, g, unknown, or other
tggagctccccgcggtggcggccgctctagaactagtggatcccccgggctgcaggaattcgcacgagaccattacctagaacatcctaatcgaaaagtccaaacgcagccgaagaggaaaggagaaaggcggcgaggatggggcggaagcggaaggagttgctgtcgtcggctccatggaggacgggggagtcggcggaggacgaggacgcggcaaggatgagccgagaggggaaggtcagcgtcaccagcaaccccggggagacgcccaccatgagcgtgccccggagcaagcgccaggacctcgacctcaccgtcgacgacttcgaggaggacgagatcgaccccgagctgcgctactccttcccagcgaacagcaggtttctgaagagagtttttagcgtggacacactttgtcagcctcttcctccctgtatggcatacagtgtatcccgcaatataaacttcttctttccnngatctcacacagnttttgggatgaanaanggaattgcaaatgccnagaagttcccttggnnactgggaacgaggaccgctcccggcccaaggccctgatactggccaaacccagttttctggtaccgggttcaaaatctttttggcttaaaccgggaaacgggtttacccccccaaaagacgggctgggaattttttggggaattggggcccctacccttaaaaacccccttttgggcccccccccttaattatccccttaag

SEQ ID NO: 56692 - protein, 145 aa, Zea mays
  misc_feature: Ceres CLONE 1498781
  misc_feature (114)..(114): Xaa is any aa, unknown, or other
  misc_feature (118)..(118): Xaa is any aa, unknown, or other
  misc_feature (122)..(122): Xaa is any aa, unknown, or other
  misc_feature (123)..(123): Xaa is any aa, unknown, or other
  misc_feature (129)..(129): Xaa is any aa, unknown, or other
  misc_feature (134)..(134): Xaa is any aa, unknown, or other
MGRKRKELLSSAPWRTGESAEDEDAARMSREGKVSVTSNPGETPTMSVPRSKRQDLDLTVDDFEEDEIDPELRYSFPANSRFLKRVFSVDTLCQPLPPCMAYSVSRNINFFFPXSHTXFGMXXGIANAXKFPWXLGTRTAPGPRP

SEQ ID NO: 56693 - DNA, 735 bp, Zea mays
  misc_feature: Ceres CLONE 1498795
  misc_feature: Encodes the peptide sequence at SEQ ID NO. 56694
  misc_feature (397)..(397): n is a, c, t, g, unknown, or other
gaagctggagctccccgcggtggcggccgctctagaactagtggatcccccgggctgcaggaattcgcacgagaccattacctagaacatcctaatcgaaaagtgtgggtcggctaccttgattggatcttgacttgctcagcttctcctagcccagctcctgctagctaggcctaggctgctacatactgccatcatccatggaggcgcctcctgatcaggcggcagcggcggcgcggcaggaccaggagcggcgggactacagactcatcgcaaaagccgtggacgaagcgtaccgggcggtggagtgcgacggcggcgggtaccccttcggcgcggtcgtcgtccgcgtcggcggcggcggcggccacggcgacgacgacgaggtggtcagcancagccacaactcggtccggaaggacgccgatccgtcggcgcacgccgaagtgaccgccatcagaacagcgtgcaaaaacctggggaaaaccagcctctccggctgccagatctacacgtcctgccaagccgggcccatgtgccgggggctcattcccctgggcaagataaaaaaagggggtgtacggaccccaagtcggaaggcgccgctgccgccgggctccaaggggggtcctcccagaggtctttcaaaaaatactacccaaaaccccgggggggaaaatgaagcaagcccaacggcgaagctgtcaaccccggattccgcaaagaaggtgttcg

SEQ ID NO: 56694 - protein, 178 aa, Zea mays
  misc_feature: Ceres CLONE 1498795
  misc_feature (17)..(129): Pfam Name: dCMP_cyt_deam_1 Pfam Description: Cytidine and deoxycytidylate deaminase zinc-binding region
  misc_feature: SWISSPROT Homolog: EC 3.5.4.3 Guanine deaminase
  misc_feature (66)..(66): Xaa is any aa, unknown, or other
MEAPPDQAAAAARQDQERRDYRLIAKAVDEAYRAVECDGGGYPFGAVVVRVGGGGGHGDDDEVVSXSHNSVRKDADPSAHAEVTAIRTACKNLGKTSLSGCQIYTSCQAGPMCRGLIPLGKIKKGGVRTPSRKAPLPPGSKGGPPRGLSKNTTQNPGGENEASPTAKLSTPDSAKKVF

SEQ ID NO: 56695 - DNA, 707 bp, Zea mays
  misc_feature: Ceres CLONE 1498797
  misc_feature: Encodes the peptide sequence at SEQ ID NO. 56696
aagctggagctccccgcggtggcggccgctctagaactagtggatcccccgggctgcaggaattcgcacgagaccattacctagaacatcctaatcgaaaaaaaaaactttcccgacgcaaaagtcgacgacgcgtgcgccttgctcgctcgctcgccgtctgccgtcgttctaggtttagagccaggtcaccagcgctaggagggcgcgaagtcgagtagacggccgggcctctcccgttctccacggacggctagcgctactggaggcgacgcctggacggcgaccccgcacactcacagccacaccctccacctgtgtgactattcaagggcttaggccgagccgcccggccaatcgccgtccgccggaccgctgaggaatttttctttctcgtcaaaagttactgcattcattttacagtaatggctatggggttgattaatgctaatcctataatccatgagaaaaaagagaggcgtgccagacaggcactagagaccacagatgaaaatgcagcagagcctatagatcagctgaaaatatttgatcacattagagatataaaggatccagagcacccgtactcactggaacagctgaatgtggtgactgaagatccatttgaactcaatgatgaaagtatttatgtcagggttacattcccccccacagtggaagcactgcagtatggccacctattattg

SEQ ID NO: 56696 - protein, 94 aa, Zea mays
  misc_feature: Ceres CLONE 1498797
MAMGLINANPIIHEKKERRARQALETTDENAAEPIDQLKIFDHIRDIKDPEHPYSLEQLNVVTEDPFELNDESIYVRVTFPPTVEALQYGHLLL

SEQ ID NO: 56697 - DNA, 746 bp, Zea mays
  misc_feature: Ceres CLONE 1498799
  misc_feature: Encodes the peptide sequence at SEQ ID NO. 56698
  misc_feature (360)..(360): n is a, c, t, g, unknown, or other
  misc_feature (366)..(366): n is a, c, t, g, unknown, or other
  misc_feature (469)..(469): n is a, c, t, g, unknown, or other
tggagctccccgcggtggcggccgctctagaactagtggatcccccgggctgcaggaattcgcacgagaccattacctagaacatcctaatcgaaaaatcgacagtcgacgctgcagcaggaagccaaagaggagagaatccatcgagtcgaccaccgagcacggttagggcggcggggctcgccgtggccacagctcaggaatccaatcccccactcctcaccggcgcccgcggttttataaatagattccctcgtcactgtcgcggtcgcggcttgatcggattcaactcacctaccccaccccctcgattccttcccagctctggctacttccctacgcacccacgcccgctccggnctcggntcctcgagcaaagctgcatggctgcccgcgcgctgaaggagccaactcacgctctcctctctccatggtcgcctcgggtctggtgggacaagcagtccagcanctgcaaatactgcaggaacacgggggcacccccggtttcctccccaaggtttttaccttttttgggaaaaagccaaaggaatttttcccaatctcccctttctgtttacccccccttcggggattttaaaggggggacccttcggtctccctctcaagggaaccccccccgttgtggccccaaaaaggaagatttacttggcggccccccccccttttggggaaaaaaaaaaaaagggggggccctggttttgtgtggtaaaaaaaaaaattttaaa

SEQ ID NO: 56698 - protein, 55 aa, Zea mays
  misc_feature: Ceres CLONE 1498799
  misc_feature (13)..(13): Xaa is any aa, unknown, or other
MVASGLVGQAVQXLQILQEHGGTPGFLPKVFTFFGKKPKEFFPISPFCLPPLRGF

SEQ ID NO: 56699 - DNA, 745 bp, Zea mays
  misc_feature: Ceres CLONE 1498805
  misc_feature: Translation starting site: 145
  misc_feature (425)..(425): n is a, c, t, g, unknown, or other
  misc_feature (454)..(454): n is a, c, t, g, unknown, or other
  misc_feature (471)..(471): n is a, c, t, g, unknown, or other
  misc_feature (487)..(487): n is a, c, t, g, unknown, or other
  misc_feature (528)..(528): n is a, c, t, g, unknown, or other
  misc_feature (558)..(558): n is a, c, t, g, unknown, or other
  misc_feature (565)..(565): n is a, c, t, g, unknown, or other
  misc_feature (567)..(567): n is a, c, t, g, unknown, or other
  misc_feature (574)..(574): n is a, c, t, g, unknown, or other
ggagctccccgcggtggcggccgctctagaactagtggatcccccgggctgcaggaattcgcacgagaccattacctagaacatcctaatcgaaaaaacccagagacctcgagaacggctggaagaaccgagagcgctccggaaatgtcggcgggtgagctgtttggagctggacgagctgcggcggctggagagcctcgccaagcacccccgcgtccagatcctcctcgccaacgaaatccgcaacgttgaagcgaagttggcgaaggcaaccgaaccatcgcctgagccactggcggcggcttctgcgccagcgcccgcgcccgctgcgcgtcctgttttaagctacgtcactcttgggtcgttcagctgggagcaggacaacgagaagattaggatatatgtttcccttgagggagttgagncagagaaggtggagactacttttcagccnacatcagtggatataangtttcatgatgtcaangggcagaattaccggtgtgctataccaaagctgaacaaggnaatttgtcctgagaaatgtaagggtgtggntgaaccnanccagggntgttgttactccttttcagggttctaaagggcactgggtagacttgccctttcaggaaaaaagtttcagcccaacagggaccaggaaaaagaatcgaaggccgggaattttggaccttatggaaaaacttgtctaaggaagcccaccaggaatttgaacgcccaaaacccc

SEQ ID NO: 56700 - DNA, 740 bp, Zea mays
  misc_feature: Ceres CLONE 1498814
  misc_feature: Encodes the peptide sequence at SEQ ID NO. 56701
ggagctccccgcggtggcggccgctctagaactagtggatcccccgggctgcaggaattcgcacgagaccattacctagaacatcctaatcgaaaatgcacttcccactcgcttcacgccactacctaccttctcctatgcaatatcgatttcgacctgcatgcagcgtagcgtcccatcaacgcggattggcctaaccaccggccacccattccgtataatggatgcgcctccatacttgcgaaggcgtcgcaggtgacattaccttccggcgctgtcctcgacgttttggtcttggcggtctctgacaggctacacccgctggacgatcagtcgatccacaaggatgagccgctcctggatcacatcctggagccatttgacgatccagccggcttatttcccaggggaccatgcccccacgctataacattgtctcctcggacggatgtgtgatgtactaccactgtccataaagctgtctaagggccatcacctgctgaagatgacgaacacatcacgggctgctctatatgtcctcgcacgacttccgagacgtcatctgttctctgactgtacatctcacggattagctcgtccggactgctattactaaatcatatgaaagtgaattgagcagagtgtaatatgtgatagcaatagattgcaccctcaaccagtttgccctcgggtgctcgatgcatatgtgtgaacgatcatttctgatgtccaaaaacttg

SEQ ID NO: 56701 - protein, 56 aa, Zea mays
  misc_feature: Ceres CLONE 1498814
GAPRGGGRSRTSGSPGLQEFARDHYLEHPNRKCTSHSLHATTYLLLCNIDFDLHAA

SEQ ID NO: 56702 - DNA, 875 bp, Zea mays
  misc_feature: Ceres CLONE 1498820
  misc_feature: Encodes the peptide sequence at SEQ ID NO. 56703
ataaacatcaccaaaaaacccaacacctcccccccaaaaatacacccccaaacaccagaactccccgcggtggcggccgctctatactagtggatcccccgggctgcaggaattcgcacgagaccattacctagaacatcctaatcgaaaagcaaaaatctctgccgtgcctctcgtctctcttctcaggcgccacgcaaaacgttctccgttttccctctccggatccggcccgcgggagccaggagccaccgatgatccggaccgcaacggtgcgagcgcgtctcctcctatcgcgctcctacgtagcacaggcaaaggcagcttctcgctggcctctcgtccgctggaaggcttcgcatcttggatctgtacggcatatcatcgttctacctgcagctttctgagcattcttgtagtagatgtgtgcgactgcttgcccctaccaagtggctattggctaggggccccccccaaaaactttcagggaaaggctgcttaaattctagccaattgggggagtcctggggacccacagggaaacccatttttgggggaaatgaaacctttttcttaaaatataaagtttcaacgggcaatttttgatattgggggcccccaaagaaacaataacgggctctttgggtctccctatatcccccaataaagtacactttttaaaaaaatggggcccctttaaaatcaaatctcgcaacaaatccccctttctcgggaacccaattaaaaaactcgggaggtttctcatggggggaaaatggggaaaaattggaccttatatgtggtcaaaaaaaaaaaaaaaaaaaaaaggttctacttcgtattccttgtggatctctggaggggggtggggccac

SEQ ID NO: 56703 - protein, 50 aa, Zea mays
  misc_feature: Ceres CLONE 1498820
MIRTATVRARLLLSRSYVAQAKAASRWPLVRWKASHLGSVRHIIVLPAAF

SEQ ID NO: 56704 - DNA, 731 bp, Zea mays
  misc_feature: Ceres CLONE 1498829
  misc_feature: Encodes the peptide sequence at SEQ ID NO. 56705
  misc_feature (459)..(459): n is a, c, t, g, unknown, or other
  misc_feature (510)..(510): n is a, c, t, g, unknown, or other
aagctggagctccccgcggtggcggccgctctagaactagtggatcccccgggctgcaggaattcgcacgagaccattacctagaacatcctaatcgaaaaaatatttttgagaaagagccaaggatccatagagatgtgtttgttgctcccagtgcagcagtcattggggatgttgagattggtcatggatcgtcaatctggtacggatccatattgagaggtgatgtcaacagcattcatattggatctggttctaatatacaagacaattcccttgtacatgtttcaaaagctaacattagcgggaaggtcctcccaaccataattggaagcaacgtgacagtgggtcacagtgctgtattacatgcatgtaccattgaggatgaagctttttgtggtatgggtgccactctgcttgatggagtggtagttgaaaagcacagcatggttggtgcangatctctttgtagcagaatacaaggattccttctggaaagtctgggtccgnaatcctgccagttcctaagaagcttaaggaaaagaaaatggtttcttcgttcatcggaacccattattttacctagcccaggtcctggccccaaaaccccaaaaattttaaaaatttggctccaaaaaagttagaaaaaaatcccccaaaaaaaaaaaaccaacccctttttgggggggcggaaaaaccccccccttttttttttaaaaaatttcccccaa

SEQ ID NO: 56705 - protein, 213 aa, Zea mays
  misc_feature: Ceres CLONE 1498829
  misc_feature: SWISSPROT Homolog: EC 4.2.1.1 Carbonate dehydratase
  misc_feature (153)..(153): Xaa is any aa, unknown, or other
  misc_feature (170)..(170): Xaa is any aa, unknown, or other
AGAPRGGGRSRTSGSPGLQEFARDHYLEHPNRKNIFEKEPRIHRDVFVAPSAAVIGDVEIGHGSSIWYGSILRGDVNSIHIGSGSNIQDNSLVHVSKANISGKVLPTIIGSNVTVGHSAVLHACTIEDEAFCGMGATLLDGVVVEKHSMVGAXSLCSRIQGFLLESLGPXSCQFLRSLRKRKWFLRSSEPIILPSPGPGPKTPKILKIWLQKS

SEQ ID NO: 56706 - DNA, 861 bp, Zea mays
  misc_feature: Ceres CLONE 1498830
  misc_feature (36)..(36): n is a, c, t, g, unknown, or other
  misc_feature (421)..(421): n is a, c, t, g, unknown, or other
aagccctcacccaaaaccccctacacttcaacaaanccataacaccccaaaaactggaactccccgcggtggcggccgctctatactagtggatcccccgggctgcaggaattcgcacgagaccattacctagaacatcctaatcgaaaagccggttaccccttgctgcccgctcccctgcgcctcgcctttctcgccctctttccacctttctcacacgtgcccgccttctccgcccctctcctcgccagcggcggcgtcgaccggcagcggcgttcaactgcgccccacgagcaggtttcttggccccgtcgacttccagtgagttcaatatagctcagtaagcatctgatcaacttctaggtgccagacatatcctatgctgcctttattgagatgaaaggtggctgtctgcataggntccttgacccaaaagctatgcttttggcccggaggtttttccttggtccccccccccaattgttcttttaaacggaaaggagcccccgaaaccccatttctttccggcccaaaccccatgggcatatcaaaaattttccttcctcggggttttttaacaaccgcgcaggagcaggaacaatattttggaaaaataaagagacccccccccaatttgggaatccctccagggtccacctttcccagaaaacacgttctttcgcaaaaattatgcggcccccaccgtaataaaaaaaataattttcctcttgggcggccggcgggcaattaaatgacttatttgtggctctgcgagagcggcgcccctcccccccgcgtgtaggagcgagaatacaccacaccgcaaactctggaaaaaaaaaatccccccctcccgcggag

SEQ ID NO: 56707 - DNA, 722 bp, Zea mays
  misc_feature: Ceres CLONE 1498833
  misc_feature: Encodes the peptide sequence at SEQ ID NO. 56708
tcaccgcggtggcggccgctctataactagtggatcccccgggctgcaggaattcgcacgagaccattacctagaacatcctaatcgaaaactctctacctcgagctctactcgcataccactgcatgggtgttggggttcttgtatccctgctagtgatgaccctctcccacagccaccaagtctgctctgtccagagaatcaagtgccagtggtgaccatgctcacaattctttaccccaccatagccagaacattctagggagttgctggcctatatgaagcttgttccataatcatctcaggttctctggaggacatggttgctggagtgacttggccgtccatcttgccaccaggttggacagtcaagtgggaccctacctcggctgaggaggagcatgaggagtgatgggacaggcttccccatctctctgtttatttatcgttagttttattccgctgcattttgaacaatgatgactacttttgctaaaactctgatgatgatgtaataagtttaatactccttaatgtatggttttatgctttaaaaaaaaaaaaaaaaaagcttatcgataccgtcgacctcgagggggggcccggtacccaatttcgccctatagtgagtcgtattacgcccgctcactggccgtcgttttacaacgcccggactgggaaaaccctggccgttacccaatttaatcgccttgcaacacatt

SEQ ID NO: 56708 - protein, 30 aa, Zea mays
  misc_feature: Ceres CLONE 1498833
MVAGVTWPSILPPGWTVKWDPTSAEEEHEE

SEQ ID NO: 56709 - DNA, 689 bp, Zea mays
  misc_feature: Ceres CLONE 1498836
  misc_feature: Encodes the peptide sequence at SEQ ID NO. 56710
  misc_feature (465)..(465): n is a, c, t, g, unknown, or other
aaagctggagctccccgcggtggcggccgctctagaactagtggatcccccgggctgcaggaattcgcacgagaccattacctagaacatcctaatcgaaaacacgcagcgcgctcctcgatccccaacaggcaacagcccagccgctgtcgccctcgttccgtagtacggcgccgccagatcgtcagtcaccatgatcatctccaagaagaaccgccgcgagatctgcaaatacctcttccatgagggggtcttgtacgccaagaaggactacaacctggccaagcaccccaagcttgatgtgcccaacttggaggtgattaagctcatgcagagcttcaagtcgaaggagtatgtgagggaaaccttctcatggcagtactactactggtacctcaccaacgatggcattgagcacctccgcagcttcctcaacctgccatcagaggttgtgcctaatacccntcagaaagtcttccagcccccgtctcgccccttcggctctgaccccactggtgacgccccagggggccctctcgttatgaggtgacagcctaggttggtgaatggaatgttacagaggaggtccacgtgccgttcaagggacttggggggaaaagggggggcccctgcaaattccaacctttttaggggaacaaacttgttttggcccgggggggggggctttt

SEQ ID NO: 56710 - protein, 118 aa, Zea mays
  misc_feature: Ceres CLONE 1498836
  misc_feature (3)..(98): Pfam Name: S10_plectin Pfam Description: Plectin/S10 domain
  misc_feature (91)..(91): Xaa is any aa, unknown, or other
MIISKKNRREICKYLFHEGVLYAKKDYNLAKHPKLDVPNLEVIKLMQSFKSKEYVRETFSWQYYYWYLTNDGIEHLRSFLNLPSEVVPNTXQKVFQPPSRPFGSDPTGDAPGGPLVMR

SEQ ID NO: 56711 - DNA, 732 bp, Zea mays
  misc_feature: Ceres CLONE 1498837
  misc_feature: Encodes the peptide sequence at SEQ ID NO. 56712
  misc_feature (483)..(483): n is a, c, t, g, unknown, or other
  misc_feature (532)..(532): n is a, c, t, g, unknown, or other
tggagctccccgcggtggcggccgctctagaactagtggatcccccgggctgcaggaattcgcacgagaccattacctagaacatcctaatcgaaaagttttcctggcggcgacggctggtcgagcggcgccgcccttggctaggtcttcgctgggtccttccccggcgacgagcgtccatctggggtcgactgaactgagcaggcagtaggaagagacactatgttgttcttctcctacttcaaggagctggtggggaaggaggtgacagtggagctcaagaatgacttggcgatccgcgggacgctccactcggttgaccagtacctcaacatcaagctcgagaacacccgcgtagtcgaccaggacaagtatccccacatgctttcagtgcggaactgcttcatcaggggctcggtgggtgcggtacgtgctgctcccgcaggacggcgtggacatcgacatcctccacgacgccaccangaaggaagcgcgcgaagctgatcctgatgcgcacccgttcctcactggntggtggctggttcatccccgattggacaaaccttgcctgtacggggggggggaaaccaaagcccccattttaattcttgggggcttgcccgaacaaaaaattccccggggggaagggggcccggaacccccggaaatattatgtggccaaacaaagggaggggccttgcggggggggtgcaaaaaaaaaaaaaaaagaga

SEQ ID NO: 56712 - protein, 93 aa, Zea mays
  misc_feature: Ceres CLONE 1498837
  misc_feature (5)..(71): Pfam Name: LSM Pfam Description: LSM domain
  misc_feature (87)..(87): Xaa is any aa, unknown, or other
MLFFSYFKELVGKEVTVELKNDLAIRGTLHSVDQYLNIKLENTRVVDQDKYPHMLSVRNCFIRGSVGAVRAAPAGRRGHRHPPRRHXEGSARS

SEQ ID NO: 56713 - DNA, 907 bp, Zea mays
  misc_feature: Ceres CLONE 1498839
  misc_feature (516)..(516): n is a, c, t, g, unknown, or other
  misc_feature (907)..(907): n is a, c, t, g, unknown, or other
tgagagtgcccaaaagcccccaaccaacccctcacccttctaccccacaccccaaaactggcgctcatcgcggtggcggtcgctctaaactagtggatcccccgggctgcatgagttcgggcgagaccattacctagaacatcctaatcgaaaaacattccttcctttcatcgttgcatcttccctccgatccttccggtgggggcggccagatgcgaccaaattcctcccattccctctccctcccgcccaccccatctctacgtccgcgtaactcctctccgtcgcctaccaaaagcggattaacctaggcaagagtaagggggtggccgaggaaaagcgatttggcttccctaccatgttccggattcatttaaaagaaacacaatgactggcagtggactatttgaacccctggaagagggggaaacctttttatttcccccaaacaggttcaactttagcggtattaaaaggacggtttttccccccgagcccccccctgctcctataaanattttattttttttgggggggtgccccccccccccacatatggttaatcgttaaaaaaaaaaattacgagtccacctgtatcaaaaattccgagcggcgcgaaaacgaaatattctcaaccacaaaagagtaattcctcggtgggcttctcttcctaccggtgaaacctcggcgcgaacccaagtggatcaattgtggtgcccgacaaatccccccgcgccgccgccaatatgatgtagtagacggaccccccccgtcgctgggcggggtgaagcaagctgctatccaaaccgcacccaacttgcgatggtttaccccgattctcataaatagtgatattcccggaaccgggcccgggaggaatataaatttactctttcactccgagggn

SEQ ID NO: 56714 - DNA, 730 bp, Zea mays
  misc_feature: Ceres CLONE 1498841
  misc_feature: Encodes the peptide sequence at SEQ ID NO. 56715
tggagctccccgcggtggcggccgctctagaactagtggatcccccgggctgcaggaattcgcacgagaccattacctagaacatcctaatcgaaaaattatacgaaggaataccttgaggagactgtcgggtcatgtactagaagaatggtcctctatcaagaatatgtgaagggcatatcgtcaacagggatgcaatccaattgtggttttgaagggcaagttaatgcatgctggactcacaaaatgactactaaggaactagatacaatacggtttgccggttttctagtttcagttattcatggaaggtacgatatcattgcacaattgtgccatgcaaaacgtctagcagaaaggcttcttcctgttgcaagaatggtagtacctcatggtgcacatctagtaagccatgaaagaccagacgaggtgaacaatgcacttatggatttgataaaggccaccaaatctgcgataaaacctgaagagtggtcagcccagcccgagaacacgtcgggtaagcttaagaagactaaacacctcctatttctcttgaaggcaaattgttccggggcaaatctcttacgctgcatcctcatcagaaaccggggcgctcatttctgcgagacccatcaccgtcacggtgcgaacagatgcaggcgtagacgccaccgcagctgtctataacttgcttgggaagctgcaactgagcttcctttatctcataggg

SEQ ID NO: 56715 - protein, 179 aa, Zea mays
  misc_feature: Ceres CLONE 1498841
MVLYQEYVKGISSTGMQSNCGFEGQVNACWTHKMTTKELDTIRFAGFLVSVIHGRYDIIAQLCHAKRLAERLLPVARMVVPHGAHLVSHERPDEVNNALMDLIKATKSAIKPEEWSAQPENTSGKLKKTKHLLFLLKANCSGANLLRCILIRNRGAHFCETHHRHGANRCRRRRHRSCL

SEQ ID NO: 56716 - DNA, 792 bp, Zea mays
  misc_feature: Ceres CLONE 1498842
  misc_feature: Encodes the peptide sequence at SEQ ID NO. 56717
ggagctccccgcggtggcggccgctctagaactagtggatcccccgggctgcaggaattcgcacgagaccattacctagaacatcctaatcgaaaaataggctcaataacctcgccagcggatcccttccttgcgaggccggaactgagctgccgccggcgctatggcgagcggcggcctggcggctgcgtcggaagtcgccgtcgttttcctcatccgccctgtccttgccatcgccttcgtcttcaccctcatcctcctcagctggtacgtggcgtggaggacggtgctggtgcacgtgccgctggtgcaggagatcgccggcctgcgccccgaaaagcccctctaacccaagccagccaatcgcgggccgcttccccaagttctaccaaaaccaggccgaaggccgcacaccccacccccaaatcccaagggggcatccttcttaagaagaaatccccccccacccttggaatgaggaacctgcccgccaacttttattaggccggtcctatttaaaaagggcaggacctccccggggcggggcctttttttaggaaaaaaagggttccccccctggggggtggggggactccccggcccggcccgaacaatacctttgggttttaggaaaaagccgcaaaccccctgggttttttgcccgcaccccttggaaaggttaagggcgcctatggatggggccacataaaaaaacccacccggggtcccgccaaaaaaaaaaaaagacccctctccccttttttaaataaaacaaatacaaaaaaaatcttt

SEQ ID NO: 56717 - protein, 61 aa, Zea mays
  misc_feature: Ceres CLONE 1498842
MASGGLAAASEVAVVFLIRPVLAIAFVFTLILLSWYVAWRTVLVHVPLVQEIAGLRPEKPL

SEQ ID NO: 56718 - DNA, 730 bp, Zea mays
  misc_feature: Ceres CLONE 1499329
  misc_feature: Encodes the peptide sequence at SEQ ID NO. 56719
aagctggagctccccgcggtggcggccgctctagaactagtggatcccccgggctgcaggaattcgtctcacccctagaaaaaaaccccaccgcagcacagcgccggcaaccgccgccatcgatcgatcgcccggaaactgacctctaccgatgtctggagccggcgaggaggataagaagcccgcggagggcggcgcccacatcaaccttaaggtcaagggacaggatggcaatgaggtgttctttcgcataaagaggtccacccagctgaagaagctgatgaacgcctattgcgaccgccagtctgtggacatgaatgccattgcattcctgtttgatggccgcaggcttcgcggcgagcagacccctgatgagctggagatggaggacggcgactagatcgacgccatgcttcaccagaccggaggcagcgttcctagcaccacctaaaagcagcagctgcggagcctcgttttgctctccgccctgcgtagtactaaaacaaagggaaaaagtctttttaaggaacttgtgatgctctgggctccttgtgccatttctggagggacatcccttagcctttatttagtgggatggttttggaactttggttctgtccatccctcctttatcctatcccttaatacatgaccgccttgttttgtaacttcataaaaagaaaaaaaaaactaagacccttccaggtaccccaatttccccctcttaggt

SEQ ID NO: 56719 - protein, 82 aa, Zea mays
  misc_feature: Ceres CLONE 1499329
  misc_feature (21)..(83): Pfam Name: ubiquitin Pfam Description: Ubiquitin family
MSGAGEEDKKPAEGGAHINLKVKGQDGNEVFFRIKRSTQLKKLMNAYCDRQSVDMNAIAFLFDGRRLRGEQTPDELEMEDGD

SEQ ID NO: 56720 - DNA, 706 bp, Zea mays
  misc_feature: Ceres CLONE 1499332
  misc_feature: Encodes the peptide sequence at SEQ ID NO. 56721
aaagctggagctccccgcggtggcggccgctctagaactagtggatcccccgggctgcaggaattcgtctcacccctagaaaaatttgcctgccttcccattcccccgtctcctcttcccttccgccatggcccagcccgctttcctctcctctctccgctcccgcctctgctccgcgccgccgcccccgccgaaccatcgcctccagcctaggcgcggctaccacgtcgagctcggggctcgcgaaaaagcgcttttggaggaggatgttgctttgaagaggttcaaatcatacaaaaacagtgtgaaacaggtctccaagatcgggaatgctctcactttagctgttgtacttgcttgcagctacgagcttgctgtgttggcgactagcacaaaatgaaggaaaactcggtcatgtggggggcacggttattccgggaagtgatccatcagcatgaactggcactctctcccttcgggttttttagccccgtttgttgatcactcgtaccgtgtaaaaaaaaataaactaggttaacccttgattggcaaataatctcccctgttcttttgcgcctatttccaaccaaaggggcaaaaacctttcttccctggcggaatcccggaaaaaattagaccccccccgctttcttattcaccccttgggagattttccctccccccctctcttttaaccaaacacttg

SEQ ID NO: 56721 - protein, 90 aa, Zea mays
  misc_feature: Ceres CLONE 1499332
MAQPAFLSSLRSRLCSAPPPPPNHRLQPRRGYHVELGAREKALLEEDVALKRFKSYKNSVKQVSKIGNALTLAVVLACSYELAVLATSTK

SEQ ID NO: 56722 - DNA, 905 bp, Zea mays
  misc_feature: Ceres CLONE 1499335
  misc_feature: Encodes the peptide sequence at SEQ ID NO. 56723
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (427)..(427): n is a, c, t, g, unknown, or other
  misc_feature (763)..(763): n is a, c, t, g, unknown, or other
nnnnnnnnnnnnnnnnnnnncccccccnnnnnnnnnnnnnngggcaacgctggactccccgcggtggcggccgctctagaactagtggatcccccgggctgcaggaattcgtctcacccctagaaaaagaggacgatggcaatcgccgggcagtgctcctcctgctattatacgtcacccaccctgcagctccagctccaccgacggtacagccacctgccgcggcagccccaagccgcacgaagagcgcggcggccgaggttgccggtggccccagctgccggcagggggcgcctctgggcggcccgtgatcctcagtccttccagcttccttctcccccccatgcaggggcgtcgaacggctcttaacactccgcagggcgcgggccccgcctccgccgcgaggaccccttccctttttttcccntctctctgagagggggggggggggagaccccgcctcccgctgttgacccttctcttcggtgggggttctctctgtccccgtgaaacgtcttctgttcggggcaggtgcgacgcaggctgggcgtcaccgcctctgcccttcgctcgtgtgtctccccgccaggcgagaacagtagatcggcccgggtgtagtgcgcgccgcgccgctcctcccatccctgtgggtgcgcccagggccgcaccgacgggtggagacccgcgccccagccttcgggacaatagctcgccccccccccactttcgcccgcccctgcaagtggtgtggtctgccggctgnccccccccgcctgtccgtcgagcgaccgccgccgtagaggctaccaatcgggtcgctccgatgttgtccccccctcaccccgcgtgccgcgcggctccgcgtggctcccgcacgcccctcccttcgccgccccaccccctcc

SEQ ID NO: 56723 - protein, 77 aa, Zea mays
  misc_feature: Ceres CLONE 1499335
MAIAGQCSSCYYTSPTLQLQLHRRYSHLPRQPQAARRARRPRLPVAPAAGRGRLWAARDPQSFQLPSPPHAGASNGS

SEQ ID NO: 56724 - DNA, 850 bp, Zea mays
  misc_feature: Ceres CLONE 1499336
  misc_feature: Encodes the peptide sequence at SEQ ID NO. 56725
  misc_feature (10)..(10): n is a, c, t, g, unknown, or other
  misc_feature (11)..(11): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
tttttttttnnttttttttnnnnnnnnnntnnnnnnngggtcgnnnnngcaatgctggactccccgcggtggcggccgctctagaatagtggatcccccgggctgcaggaattcgtctcacccctagaaaaactcgcccctctctcccaccccgcagccgccctagcacccgcgacgagcaggatctgcccagttgctcttgcggtagttcccccaactgtcaccatgcagaacgaggagggtaagactgtggacctctatgtccccaggaagtgctcggccacaaacaggatcatcactgccgaggaccatgcctctgtccagatcaacattggccacttggatgcgaatggcctgtatgatggtcacttcacaacggttgctctctctgggtttgtccgtgctcaaggaggaggtagacagctcccgcgacaggctgtggcgaaaaaaaaacgctgatatcaagccgtcacatttgaccttctcgctttccgaggaaactgcacaccccccctgccgaggttcttgacctccacgccccgtgcagggcgagggggggaattatcccgctgggccccctttaaaaactggaagagtttcacttttcctccttgttcggtgtcccttccggaactctccattggagtgggcgcttcccttttaatctcccccccgccacaccacgaaaccgaacccatattaacctgtctacgccgcgtgggttgtaccctcctttctttacccttttttctgttcccgccccacactcctcctctcctcccccgcgggtgtcccgattctagcttcttcgtgggtcggcccaatatacgcgacagacaccctcaccccg

SEQ ID NO: 56725 - protein, 77 aa, Zea mays
  misc_feature: Ceres CLONE 1499336
  misc_feature (1)..(77): Pfam Name: Ribosomal_S21e Pfam Description: Ribosomal protein S21e
MQNEEGKTVDLYVPRKCSATNRIITAEDHASVQINIGHLDANGLYDGHFTTVALSGFVRAQGGGRQLPRQAVAKKKR

SEQ ID NO: 56726 - DNA, 907 bp, Zea mays
  misc_feature: Ceres CLONE 1499337
  misc_feature: Encodes the peptide sequence at SEQ ID NO. 56727
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (12)..(12): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
nnnnnggggggngggggaaaannnnnnncccnnnggcccnnnnngcgagctggagctccccgcggtggcggccgctctagattagtggatcccccgggctgcaggaattcgtctcacccctagaaaaaagcagcagcacagtcatccacactaacgaacgaactgaggtcgacgacgactgatccagcagcgacgatggcggctgtgctgcacagcacgaagacgccgcatgtggttgccgtgctggtggtggcggagctgctggcatcctccactctcgaggcgatcgcctggggcacggtggcctcctcgctggttcgcggcctccccatcccttgggggaggacccgggggccgtccccccttgcgctcggggcgcggggaagacctgcgcccgggaggccgggggccatgtgttgtttggtgtcggcccggcttgcttgggtgatgtctgaacccccgtcgacctgtggggggcccccccccaaagggggagcgcccatggtctggtgtttcgcccgggtagggtggctgtcatcatccgacgggaatcctccgttcgaccccctcgccccccgcccagggggggcgagtgatgatgctcgggtgcactacccgccatgccgcgcgcgggtggtctcgtgcgcgcgcttctcaatgggggttgagcgcccccctcctttgtgcgcgtgttataggtgcctcgtgttctaataatctttcgccccctctccccacacgtctggcacgtacctccggggccatgcccctcgggggccgttgggtcgggccccgcgcggtcctggagacgttggcgaggcgggtcacccggccgcccaccgctctctcgtcccaccaccccacccccctcattcccttatctgagccagccaccacggccaggcgg

SEQ ID NO: 56727 - protein, 172 aa, Zea mays
  misc_feature: Ceres CLONE 1499337
MAAVLHSTKTPHVVAVLVVAELLASSTLEAIAWGTVASSLVRGLPIPWGRTRGPSPLALGARGRPAPGRPGAMCCLVSARLAWVMSEPPSTCGGPPPKGGAPMVWCFARVGWLSSSDGNPPFDPLAPRPGGASDDARVHYPPCRARVVSCARFSMGVERPPPLCACYRCLVF

SEQ ID NO: 56728 - DNA, 728 bp, Zea mays
  misc_feature: Ceres CLONE 1499338
  misc_feature: Encodes the peptide sequence at SEQ ID NO. 56729
  misc_feature (728)..(728): n is a, c, t, g, unknown, or other
agagctggagctccccgcggtggcggccgctctagaactagtggatcccccgggctgcaggaattcgtctcacccctagaaaaaaaattctattgagttttccaacccagcaaacaaaacaggaatacacaataatgatgacatcatagacaatattaataactcttatgaactacagtttggtgtggcgaaggaaatggcaggcctactacagatgcaacaagaccaggttccatttagagtacgagcaaagcgtggatgtgccacacatcctaggagcatcgcggagcgagagcgaagaacgaggatcagcgataagctcaggaagttacaggcccttgtgcctaacatggacaagcaaactagcacagcggacatgctggatttagcagttgatcacatcagaggactccagaacgagctgcaggctctcaaggaagacaaggagaagtgcagctgccgcggcaatcgtccagcggggagataacgcacgtacgtaggctaaaaacaatgggttctcggcaacacattatagaacggcattgcagacattgttgtcagacagcagcatcagaaggtggctgctgtggcatattggcttcagcagaccggtcgatatatttcatattcgtttaaaacctagtattttagtttgttcgatggttttaattcgtaccatcttctactacttgtacaatattttgtctctatatattgcagctgtagcn

SEQ ID NO: 56729 - protein, 96 aa, Zea mays
  misc_feature: Ceres CLONE 1499338
  misc_feature (25)..(73): Pfam Name: HLH Pfam Description: Helix-loop-helix DNA-binding domain
  misc_feature: The sequence is a functional homolog of SEQ ID NO 170 in the 10/714,887 US patent application
  misc_feature: The sequence is a functional homolog of SEQ ID NO 170 in the 11/435,388 US patent application
  misc_feature: The sequence is a functional homolog of SEQ ID NO 168 in the 10/714,887 US patent application
  misc_feature: The sequence is a functional homolog of SEQ ID NO 168 in the 11/435,388 US patent application
  misc_feature: The sequence is a functional homolog of SEQ ID NO 196 in the 10/714,887 US patent application
  misc_feature: The sequence is a functional homolog of SEQ ID NO 196 in the 11/435,388 US patent application
  misc_feature: The sequence is a functional homolog of SEQ ID NO 42 in the 10/714,887 US patent application
  misc_feature: The sequence is a functional homolog of SEQ ID NO 42 in the 11/435,388 US patent application
  misc_feature: The sequence is a functional homolog of SEQ ID NO 1257 in the 10/412,699 US patent application
  misc_feature: The sequence is a functional homolog of SEQ ID NO 176 in the 10/714,887 US patent application
  misc_feature: The sequence is a functional homolog of SEQ ID NO 176 in the 11/435,388 US patent application
  misc_feature: The sequence is a functional homolog of SEQ ID NO 178 in the 10/714,887 US patent application
  misc_feature: The sequence is a functional homolog of SEQ ID NO 178 in the 11/435,388 US patent application
  misc_feature: The sequence is a functional homolog of SEQ ID NO 192 in the 10/714,887 US patent application
  misc_feature: The sequence is a functional homolog of SEQ ID NO 192 in the 11/435,388 US patent application
  misc_feature: The sequence is a functional homolog of SEQ ID NO 152 in the 10/225,068 US patent application
  misc_feature: The sequence is a functional homolog of SEQ ID NO 1568 in the 11/479,226 US patent application
  misc_feature: The sequence is a functional homolog of SEQ ID NO 232 in the 10/374,780 US patent application
  misc_feature: The sequence is a functional homolog of SEQ ID NO 28 in the 10/714,887 US patent application
  misc_feature: The sequence is a functional homolog of SEQ ID NO 28 in the 11/435,388 US patent application
  misc_feature: The sequence is a functional homolog of SEQ ID NO 614 in the 10/225,066 US patent application
  misc_feature: The sequence is a functional homolog of SEQ ID NO 742 in the 10/412,699 US patent application
  misc_feature: The sequence is a functional homolog of SEQ ID NO 174 in the 10/714,887 US patent application
  misc_feature: The sequence is a functional homolog of SEQ ID NO 174 in the 11/435,388 US patent application
  misc_feature: The sequence is a functional homolog of SEQ ID NO 1926 in the 10/412,699 US patent application
  misc_feature: The sequence is a functional homolog of SEQ ID NO 194 in the 10/225,068 US patent application
  misc_feature: The sequence is a functional homolog of SEQ ID NO 238 in the 10/225,066 US patent application
  misc_feature: The sequence is a functional homolog of SEQ ID NO 40 in the 10/714,887 US patent application
  misc_feature: The sequence is a functional homolog of SEQ ID NO 40 in the 11/435,388 US patent application
  misc_feature: The sequence is a functional homolog of SEQ ID NO 446 in the 10/374,780 US patent application
  misc_feature: The sequence is a functional homolog of SEQ ID NO 1258 in the 10/412,699 US patent application
  misc_feature: The sequence is a functional homolog of SEQ ID NO 172 in the 10/714,887 US patent application
  misc_feature: The sequence is a functional homolog of SEQ ID NO 172 in the 11/435,388 US patent application
  misc_feature: The sequence is a functional homolog of SEQ ID NO 26 in the 10/714,887 US patent application
  misc_feature: The sequence is a functional homolog of SEQ ID NO 26 in the 11/435,388 US patent application
  misc_feature: The sequence is a functional homolog of SEQ ID NO 392 in the 10/412,699 US patent application
  misc_feature: The sequence is a functional homolog of SEQ ID NO 913 in the 11/479,226 US patent application
  misc_feature: The sequence is a functional homolog of SEQ ID NO 190 in the 10/714,887 US patent application
  misc_feature: The sequence is a functional homolog of SEQ ID NO 190 in the 11/435,388 US patent application
  misc_feature: The sequence is a functional homolog of SEQ ID NO 194 in the 10/714,887 US patent application
  misc_feature: The sequence is a functional homolog of SEQ ID NO 194 in the 11/435,388 US patent application
  misc_feature: The sequence is a functional homolog of SEQ ID NO 188 in the 10/714,887 US patent application
  misc_feature: The sequence is a functional homolog of SEQ ID NO 188 in the 11/435,388 US patent application
  misc_feature: The sequence is a functional homolog of SEQ ID NO 16 in the 10/714,887 US patent application
  misc_feature: The sequence is a functional homolog of SEQ ID NO 16 in the 11/435,388 US patent application
  misc_feature: The sequence is a functional homolog of SEQ ID NO 662 in the 10/666,642 US patent application
  misc_feature: The sequence is a functional homolog of SEQ ID NO 186 in the 10/714,887 US patent application
  misc_feature: The sequence is a functional homolog of SEQ ID NO 186 in the 11/435,388 US patent application
  misc_feature: The sequence is a functional homolog of SEQ ID NO 184 in the 10/714,887 US patent application
  misc_feature: The sequence is a functional homolog of SEQ ID NO 184 in the 11/435,388 US patent application
  misc_feature: The sequence is a functional homolog of SEQ ID NO 198 in the 10/714,887 US patent application
  misc_feature: The sequence is a functional homolog of SEQ ID NO 198 in the 11/435,388 US patent application
  misc_feature: The sequence is a functional homolog of SEQ ID NO 180 in the 10/714,887 US patent application
  misc_feature: The sequence is a functional homolog of SEQ ID NO 180 in the 11/435,388 US patent application
  misc_feature: The sequence is a functional homolog of SEQ ID NO 182 in the 10/714,887 US patent application
  misc_feature: The sequence is a functional homolog of SEQ ID NO 182 in the 11/435,388 US patent application
MAGLLQMQQDQVPFRVRAKRGCATHPRSIAERERRTRISDKLRKLQALVPNMDKQTSTADMLDLAVDHIRGLQNELQALKEDKEKCSCRGNRPAGR

SEQ ID NO: 56730 - DNA, 674 bp, Zea mays
  misc_feature: Ceres CLONE 1499347
  misc_feature: Encodes the peptide sequence at SEQ ID NO. 56731
aaagctggagctccaccgcggtggcggccgctctagaactagtggatcccccgggctgcaggaattcgtctcacccctagaaaaaaaagttttcttctctccgttgccgccctacgtcaggtgcccaattctccattttcgggcccttctccagcgacgagcacccgccagaggattatggattggctggggcagaaacgcgcggagatgctgatgcaggtgctgctggtggcgtctgcggtggtggcgttcctggtgggctacgtgcgcgcggacttccagctcatgctgctcgtctacgccggcggcgtcgtgctcacggctctggtcaccgtccccaactggcctttctacaaccgtaacccgctcaagtggctcgacgctgccgaggccgagcgccacccgcggccccaggtcagcgccgcccccgcggcagggggtaagaagaggtccgggaagaacaagtagttggccgatgtgtgtgttcttggtcgacctgactcaacctgtttagatctattcgcagaaactatcaattttaaaagaaatattgggtttaaaaaaaacacacaagaagagagcgcgtccgggtaccaaccaggtgttttgtgatttttatactaattttttatgaggggaaaaaaaatattaacgggggccccgccggggccccc

SEQ ID NO: 56731 - protein, 96 aa, Zea mays
  misc_feature: Ceres CLONE 1499347
  misc_feature (1)..(80): Pfam Name: SPC12 Pfam Description: Microsomal signal peptidase 12 kDa subunit (SPC12)
MDWLGQKRAEMLMQVLLVASAVVAFLVGYVRADFQLMLLVYAGGVVLTALVTVPNWPFYNRNPLKWLDAAEAERHPRPQVSAAPAAGGKKRSGKNK

SEQ ID NO: 56732 - DNA, 731 bp, Zea mays
  misc_feature: Ceres CLONE 1499349
  misc_feature: Encodes the peptide sequence at SEQ ID NO. 56733
ctagctggagctccccgcggtggcggccgctctagaactagtggatcccccgggctgcaggaattcgtctcacccctagaaaaagtcgagtctaaccctagcgcgcgccgccacacctgccgttgctaccgccccgtacctcgcttgctttcccgtcgccgaaatgacgaagcgcaccaagaaggctggaattgttggcaaatatggaaccaggtatggcgctagcttgcgtaagcaaatcaaggagatggaggtatctcagcactccaagtacttctgcgagttttgtgggaagtttgctgtgaagaggaaagcagttggaatttggggatgcaaggactgtgggaaggtcaaggctggcggtgcttacaccatgaacactgctagcgcagccactgtcacgagcaccattcgtcgcttgacagagcagactgaagcatgatttaacttgctacatcagggttctcctagatgctgttgtcgggaatgttgagctcctctagttggatcaccagactggcttaaaagtgggtgctaaaattttaagctggttcccgttgggaaatttcccaagcagatattatcccgaggcttggccccagagactcaaagtttgggggcggattcataagcttttgggcggtagccaatgggtaccccccttgtctgaaaattcaacccccttaaggccctccctcctatgaaatataaacagctccctttatttagcg

SEQ ID NO: 56733 - protein, 92 aa, Zea mays
  misc_feature: Ceres CLONE 1499349
  misc_feature (2)..(91): Pfam Name: Ribosomal_L37ae Pfam Description: Ribosomal L37ae protein family
MTKRTKKAGIVGKYGTRYGASLRKQIKEMEVSQHSKYFCEFCGKFAVKRKAVGIWGCKDCGKVKAGGAYTMNTASAATVTSTIRRLTEQTEA

SEQ ID NO: 56734 - DNA, 703 bp, Zea mays
  misc_feature: Ceres CLONE 1499351
  misc_feature: Translation starting site: 174
caagctggagctccccgcggtggcggccgctctagaactagtggatcccccgggctgcaggaattcgtctcacccctagaaaaaacggcataccacactagagccgccggcgccgccgtttctgcgcaccgtaccctatccctcgtcagcggtgggttcgagctcatccagacatgatgttcaggcggaggaatggagaacgcgacaagaacgggcgcggccacgtgaagtacatcctctgctacaaatgggccaagtgctgccccaacgataaagctatcaagacggttcttggtgatgaacattgttgagcaggctgccgtgagatatgtgcaggaggcctgtgtacatgatggatatgttctaccccaattgtatgcaaaggtacatcaatgtgtctcatgagcaatccatgcgcacattgccctgttcctctctcgcgagaacacgacgaaccgtgagcccccgctgcgcttcacacgacgggatgatggcccaaggactgagtcatggcccgccgcgcccatgcggtgcagctcctgatgctacagctgctgctgatcctcatacctaaagtatggaagtaactaccggactttgtattgttaaacattacttgtttcgaaaaaccattggtactgtgtccccttgatgcccgaccttttatcgtcaattgtgcgtctaaaaaggatggtctaaaaat

SEQ ID NO: 56735 - DNA, 815 bp, Zea mays
  misc_feature: Ceres CLONE 1499354
  misc_feature: Encodes the peptide sequence at SEQ ID NO. 56736
  misc_feature (7)..(7): n is a, c, t, g, unknown, or other
  misc_feature (13)..(13): n is a, c, t, g, unknown, or other
  misc_feature (14)..(14): n is a, c, t, g, unknown, or other
  misc_feature (26)..(26): n is a, c, t, g, unknown, or other
  misc_feature (27)..(27): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
tttgggnggggtnntttttttttttnntnnnnnnggnnnnnnnngcccaagctggagctccccgcggtggcggccgctctagaactagtggatcccccgggctgcaggaattcgtctcacccctagaaaaagcatttccatcctgtcgtgggatcccagccaccgccgctagaagaagagctcggcgattcccaggtcccgcgagaatatgccgaagcagatccatgagattaaggacttcctcctcaccgcgaggaggaaggatgcccgctcagtgaagatcaagaggagtaaggatgttgtcaagttcaaggtgcgctgctccaagtacttgtacacgctctgcgtcttcgatgctgagaaggcaaaccagttgaagcaatctcttccccccaggtttgaccggcgaggaggtctgattggatacatggcaaccccgagttgaactacccaagcttctttatcagtaccaccacatgctactctatggacttttggaacctacactattacaccctgtcacggttggatgtctggacctcgcctctttcgggaaatccccaatttacctcgttcacggatgcaagtttattaccctgtttaaccggcgcttaacctttagattgatgcccttcctccccgcccacaaaaaaagaaaacgagaacggtgcgagggacgccatgtttgcccctaaatatgagtgtactatttacacgaacgactcatcgggccgtctgtgtttccacgccgctggtggtggtgtggttacctcccttggcggtgtcccccaaagtaggaaagcggccagtgcggg

SEQ ID NO: 56736 - protein, 78 aa, Zea mays
  misc_feature: Ceres CLONE 1499354
  misc_feature (2)..(69): Pfam Name: Ribosomal_L38e Pfam Description: Ribosomal L38e protein family
MPKQIHEIKDFLLTARRKDARSVKIKRSKDVVKFKVRCSKYLYTLCVFDAEKANQLKQSLPPRFDRRGGLIGYMATPS

SEQ ID NO: 56737 - DNA, 720 bp, Zea mays
  misc_feature: Ceres CLONE 1499356
  misc_feature: Encodes the peptide sequence at SEQ ID NO. 56738
aagctggagctccccgcggtggcggccgctctagaactagtggatcccccgggctgcaggaattcgtctcacccctagaaaaagcctcccttccgctcccctgcctgcctaatccctccggccaccccgaaaccgctcgctcgctcgctcgctccccgcgcccagagacaagcccggagaccatggcggaccagctcactgacgaccaaatcgccgagttcaaggaggccttcagcctcttcgataaggacggcgacggttgcatcacaaccaaggagcttggaactgtcatgcgttcactgggtcagaacccaacggaggctgaactccaggacatgatcaatgaggtggatgccgacggcaatggcacgatcgacttccccgagttcctcaacctcatggcccgcaagatgaaggacacccactccgaggaggagctcaaggaggcgttcagggtgttccacaaggaccagaacgggttcatctctgccgcggagctccgccacgtgatgaccaaacctaggcgaaaagctgaccaacaaggaggttcgacgagatgatccccgaggcccaacttagaaggcaatggcccgatccacctccaaggaagttcttcaagggtcttgatggccccaatggagctaagccccgccgccaacggtcttatcaccccccgccccgcaaggggggaaacccgtggcccgcctttttagtaaaggg

SEQ ID NO: 56738 - protein, 125 aa, Zea mays
  misc_feature: Ceres CLONE 1499356
  misc_feature (12)..(40): Pfam Name: efhand Pfam Description: EF hand
  misc_feature (48)..(76): Pfam Name: efhand Pfam Description: EF hand
  misc_feature (85)..(113): Pfam Name: efhand Pfam Description: EF hand
  misc_feature: SWISSPROT Homolog: EC 2.7.11.1 Non-specific serine/threonine protein kinase
MADQLTDDQIAEFKEAFSLFDKDGDGCITTKELGTVMRSLGQNPTEAELQDMINEVDADGNGTIDFPEFLNLMARKMKDTHSEEELKEAFRVFHKDQNGFISAAELRHVMTKPRRKADQQGGSTR

SEQ ID NO: 56739 - DNA, 682 bp, Zea mays
  misc_feature: Ceres CLONE 1499357
  misc_feature: Encodes the peptide sequence at SEQ ID NO. 56740
ctggagctccccgcggtggcggccgctctagaactagtggatcccccgggctgcaggaattcgtctcacccctagaaaaacaataaaatactgtaacacaatcttcagagtagaacatgtatacatgtgcatcgatgctattcagcgctgctggtattatctcatattaagctctggaaggaaattctgttacagcacaagtctaggacattcctcgaatgcttaaaacaaaatttctcatatatacttgctatgcctatacagtacgttttttagtcacagatctttgctattattgacttcaggcgcgccagcaatgacctcgaggggtctactggagaaggatttcgagcagattggggagttcctccaccaggcagtgaccatctgcctgaacatccagaaggagtacggcaagctcctcaaggacttcaacaagggcctggtgaacaacaaggacatcgagaacctcaaggtccaggtggagaagtttgccgactccttcgacatgcctgggttcacgcttgagagcatgaaatacaaggagtagacatgcctcccatgcgcggcaaggtcctcctgtaccgatgtctttccttgtggtggcgcagggtgccatggcactgcactgccgccacacttacgatgatgatggtgggttatggattttgtctacaatgtc

SEQ ID NO: 56740 - protein, 77 aa, Zea mays
  misc_feature: Ceres CLONE 1499357
  misc_feature: SWISSPROT Homolog: EC 2.1.2.1 Glycine hydroxymethyltransferase
MTSRGLLEKDFEQIGEFLHQAVTICLNIQKEYGKLLKDFNKGLVNNKDIENLKVQVEKFADSFDMPGFTLESMKYKE

SEQ ID NO: 56741 - DNA, 869 bp, Zea mays
  misc_feature: Ceres CLONE 1499365
  misc_feature (20)..(20): n is a, c, t, g, unknown, or other
  misc_feature (21)..(21): n is a, c, t, g, unknown, or other
  misc_feature (33)..(33): n is a, c, t, g, unknown, or other
ggggaaaaggttggaaaaannggagagggtttntttaatttcctttttttttaaactggtactccccgcggtgtgcggccgctctataactagtggatcccccgggctgcatgaattcgtctcacccctagaaaaagaaacccaagcaaccaacgtccaaggccaaaacaaatttccatcaaccctcctcctcctccattctccagaacagcaacagccagcaggtcatcgccagtgatggcggcggcggtaccttctggaggctcaggatagaacacacctgcgactgcgactacacctagcctgttcgcggcggcgtgcggtgcgctgagccaatacgtcaaggcggcggatgcctagaggactgcgcgcgcggtcgctggtgcgccggcccctgccgctcatggcgggcaccgtacgtcaaccaggaggagactaaaacagggggtatatatgaacataaaggtacggaatggcggaccattgatagctcgttctaacaaagctaaatagacatggaaaaaagactcatgaagaaaccatagttctctgtcatgaggaagctacgtaggaagggacatagagtaatacccgaatctggatattactcatcataaatactccaaaattacccataaaagattaacaacatgatataaacatacagatgagagaaagcgaaaaaagaaaacagggaaaaaatcagatagaagaaagaaaggaaaatagcagcaagaacaaatagaaagccgcaaatataaaaaatgacgaagaataaataacaacaaaaacaaagaagaacgatggaattagatagagtaggatacaccaaaagaaataaacatctattgagccagacactggtggct

SEQ ID NO: 56742 - DNA, 870 bp, Zea mays
  misc_feature: Ceres CLONE 1499369
  misc_feature: Encodes the peptide sequence at SEQ ID NO. 56743
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
nnnnnnnnnnnnnnnnnnnccccctcctttatttgggggtttttttattctggtactccccgcggtggcggccgctctagactagtggatcccccgggctgcaggaattcgtctcacccctagaaaatccactcgccctcccacacagaaaaccctagccgccgccaccgaagcggcctcccaggtaagcaggagcgtccaccccgccgctgtcatgaagcgcaatccccgcgtcacgagctcccgccggaagtgccgcaaggcgcactttacggccccgtcctccgtccgccgcgttctcatgttcgccgggctgtcgacggaactccgtcactagtacaacgtgcgctccatccctaaccacaaggactaacaggtgtgagtttggggcgcggcacctacaaggggcccttttttttccacccgcgtgcaggggcggggggggggggcgctggtttccatcctctttactatccgcatccccccccctcagatcgggggaaccgtggcgcaccagattcggagcgccgggccccgcgcctccctcactcaggtgcagcgcccgtctgccggtgcgacaacctatgcaatgccgcccgcgctcctggcgccgcgctgggtaccaacaaatggagcaccaggtagacctcctccggcgaaaataaaatctgaatgggccttttggctctcgccccgctcgaatgttcgtggcgacgcaggagcgagggcgccgccggcgccggttgggtggggcgaccaatccgtggttgatcatcgggttccaccagcgtggtcgcggcgggatgtgctcctggaaataattatcacacgaatttcttcaaaagacccttaaaaactctaccaaaccga

SEQ ID NO: 56743 - protein, 87 aa, Zea mays
  misc_feature: Ceres CLONE 1499369
MPPALLAPRWVPTNGAPGRPPPAKIKSEWAFWLSPRSNVRGDAGARAPPAPVGWGDQSVVDHRVPPAWSRRDVLLEIIITRISSKDP

SEQ ID NO: 56744 - DNA, 752 bp, Zea mays
  misc_feature: Ceres CLONE 1499374
  misc_feature (228)..(228): n is a, c, t, g, unknown, or other
  misc_feature (232)..(232): n is a, c, t, g, unknown, or other
  misc_feature (233)..(233): n is a, c, t, g, unknown, or other
  misc_feature (241)..(241): n is a, c, t, g, unknown, or other
  misc_feature (255)..(255): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (353)..(353): n is a, c, t, g, unknown, or other
  misc_feature (355)..(355): n is a, c, t, g, unknown, or other
  misc_feature (356)..(356): n is a, c, t, g, unknown, or other
  misc_feature (411)..(411): n is a, c, t, g, unknown, or other
aaagctggagctccccgcggtggcggccgctctagaactagtggatcccccgggctgcaggaattcgtctcacccctagaaaaactgacgctcgacgcctctcctcctctcctcccccacccgtccatcgcccctccctccggtctgcgctcccacagcctcacccctgcgcccccgccgattcgcgtcgccctttgttggaaggaacgatggagcagaccttcatcnatgnnatcaagcnctccgaaccggggncggtcccaaggccggggggggggggggggnnncccccccccccccccccccgggccgtcggggggggggggggggtgggggggggggggggggggggncnncgggggtggggttgttcttttgtggtttccctgtcccacccgcccccgcgcggcngcaactgggtttgaaggtgaaagcggggggggtgcgcgttgccccgtcgcgaggccgcccccaaatcatccctccgcctccccgcctgtgtgtgtgtgatactacataatcgcgttcttggtcttcatatatatgattggtgtggcgttatgatgcgagccacactactcctcataacaatcaactggcccactatacagacttaactttattacctttattacgtagcactttattatcgctgtgatcatcaagggagatacaaaataggaagactagttaatcatttaaacacaagtgatgagaggagcagggggatgccgagctattcgtgtactggt

SEQ ID NO: 56745 - DNA, 747 bp, Zea mays
  misc_feature: Ceres CLONE 1499378
  misc_feature: Encodes the peptide sequence at SEQ ID NO. 56746
aaagctggagctccccgcggtggcggccgctctagaactagtggatcccccgggctgcaggaattcgtctcacccctagaaaaaaccggacagctccccacaaaaccgtcagttctcttttcccctgtaaatcgcaaattcgtcttccctgcccatctatcgcttggacacctctgcaagggagcacatggctctcgagaaggccaaggagatcatcgcgtcctccccggtcgacctagctctccgaaaggccaaggagaccgtcgcctcccaccccgtcgtcgtcttcagcaaaacttactgtcctttctgcacccgagtgaaacaattgctaaacaagttgggggcaagttacaaagctaatgaagtggatgtggaaaatgaaggcgctaacctgcattccactcctgcctgaatggactgccagaaaacctgttccaatgccttcctgaaaagggaccgaattggtggctttaacccacccctggcaaattaccaaaggcccaaaaattggggcccttttctccccaaaggtggggaaaatttttacctttgccaggggtttgggaaataaaaaccccccccctttgttttaaaacaattttttaaaaagctttgttcccccccccctttggggggattatataaaaagggttgtacaggagaaaaaaaacccccctttccgggggaaaaaaaaagaaaaaaaaaacactcttcactccttttttttaaaaaaaaaacaaaaaa

SEQ ID NO: 56746 - protein, 75 aa, Zea mays
  misc_feature: Ceres CLONE 1499378
MALEKAKEIIASSPVDLALRKAKETVASHPVVVFSKTYCPFCTRVKQLLNKLGASYKANEVDVENEGANLHSTPA

SEQ ID NO: 56747 - DNA, 924 bp, Zea mays
  misc_feature: Ceres CLONE 1499385
  misc_feature: Encodes the peptide sequence at SEQ ID NO. 56748
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
nnnnaaaannnnnnnnnnnntttttttattttttttttttttttttcaaactggagctccccgcggtggcggccgctctagactagtggatcccccgggctgcaggaattcgtctcacccctagaaaaaagctagctggctagcatggccgggaaagagcttacgctgctggggttatgggcgagcccgttcgtgctccgggcgcgcatcgcgctcagcctcaaaggcctcacctacgcttactccgaggagaacctcgacgacaagagcgagcttctcctcagctccaaccccgtgctcaagaaggtgccccgttgctcatccaccacggcaagcccggtctgccaatccccgatttatcgggcagtacgtcgaacaaggcttttccccggccgccacaccttattttcctttccttcccaaccccctaagaacgccgccctttgctcgcctttctggggcccccccctcttcaaacctacagtgttctatccgcgccctgggaatccccctttttttccgggccacggaaccccccgcaataaaaaatgtggtaaaactcctgctaagagtgaagcccccctcccccggcgccttttgaaacacctttgaaactagcggccctctctgtggtgttggcctccccgggggggaagagcgtcccctctctcccggaggggaacaacccgtggtggggttccaccacataacacagatgatccgcccgcccccttattggggggggggggggtacccaccccgcccggggcgcctctccggtggttggaaatccccccccccccgaccccgagaagaggctaccccctgtggcgggcgggagggggcggagagagcttccccctcccgcgcttgtggtgtcttccggcgtctttccgcgcctcagggtgggggccgtgtttggtg

SEQ ID NO: 56748 - protein, 155 aa, Zea mays
  misc_feature: Ceres CLONE 1499385
  misc_feature: SWISSPROT Homolog: EC 2.5.1.18 Glutathione transferase
MAGKELTLLGLWASPFVLRARIALSLKGLTYAYSEENLDDKSELLLSSNPVLKKVPRCSSTTASPVCQSPIYRAVRRTRLFPGRHTLFSFPSQPPKNAALCSPFWGPPLFKPTVFYPRPGNPPFFPGHGTPRNKKCGKTPAKSEAPLPRRLLKHL

SEQ ID NO: 56749 - DNA, 725 bp, Zea mays
  misc_feature: Ceres CLONE 1499390
  misc_feature: Encodes the peptide sequence at SEQ ID NO. 56750
aaagctggagctccccgcggtggcggccgctctagaactagtggatcccccgggctgcaggaattcgtctcacccctagaaaaagagaggaagactacagctactttcgaatgataaaagcagttcttcatctaggcaggagggctcaggaaggatgagatggcgtctaagaggattcagaaggagctcaaggatctgcacaaggaccctcccacctcacgcagcgcagggcctgttggtgaatacatgttccactggcacgaaactataatgggtccatctgatagtccatattctggtggagttctcctactgacaaaccattttcctcctgattatcctttcagaccaccaaaggtggcatttcgcactaatgggttccatcccaacatccacaccgaccggagcatttgcccccgacatcccaaacgatcagtggagtccgtcactaaccatctcctaaggtgcttctgaccttctgatccgggttcactgaccaaaaccccgaagacccttttggacccccgaaaaaccttacctggtcaaaacggaacgggccccgggaccaaaaaacccccccggacctggaaccctctggattggccaggtgtattttttttttcctgggcactttggggcccccccctggttggttttgcacgggaaatggaaatacccccccaaaaaccccggtgtttcccccccctgacaaaaaagaaaaaaaa

SEQ ID NO: 56750 - protein, 104 aa, Zea mays
  misc_feature: Ceres CLONE 1499390
  misc_feature (5)..(103): Pfam Name: UQ_con Pfam Description: Ubiquitin-conjugating enzyme
  misc_feature: SWISSPROT Homolog: EC 6.3.2.19 Ubiquitin--protein ligase
MASKRIQKELKDLHKDPPTSRSAGPVGEYMFHWHETIMGPSDSPYSGGVLLLTNHFPPDYPFRPPKVAFRTNGFHPNIHTDRSICPRHPKRSVESVTNHLLRCF

SEQ ID NO: 56751 - DNA, 817 bp, Zea mays
  misc_feature: Ceres CLONE 1499396
  misc_feature: Encodes the peptide sequence at SEQ ID NO. 56752
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (10)..(10): n is a, c, t, g, unknown, or other
  misc_feature (31)..(31): n is a, c, t, g, unknown, or other
  misc_feature (32)..(32): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (106)..(106): n is a, c, t, g, unknown, or other
nttttnnttntttttttttttttttttgggnngggnnnnnacaacaacccaacaaagctggagctccaccgcggtggcggccgactctagaactagtggatccccncgggctgcaggaattctgtctcacccctacgaaaaaaaaaaaaaaaaaaagcactactcctatatccagccgccatcgtgctcggagctctcatctctaatcttcgggttcgcgtcgcagtgtcttccgcccgggctaccaccatgccgaagcagatccacgagatcaaggacttcctgctgactgcgcggtggaaggacgcacggtcggtgcggatcaagcgggccaaggacgccctcaagttcaaggtgcgctgctccaggtacctctacaccctctgcgtccacgacgccgacaaggccaacaagctcatagcagtcgctcccgccaggtctgactgtccaggagatttaaggtatcaagccacaaacctgtgcttttttttcggtgtcagggacgtttgctccaatgttactttagtttttacgtgcggctccattgctgtgtttaattgatttatgaaatttgagtttgggatgccaatgtatgtgtccaaacctatgaccctgtgttgtataggtaacccccacaccgtctagcgattggcaatcctatcataaggttaaactggattttccaacacaaaaaaaaacaaaaccgaaaacccctctgtgagaaccaccaattccgcccccttatagggggggccccgccacttactaccccccgcccccaccgtgtggcaggtcagtttttctcacaacaccctgc

SEQ ID NO: 56752 - protein, 103 aa, Zea mays
  misc_feature: Ceres CLONE 1499396
  misc_feature (2)..(62): Pfam Name: Ribosomal_L38e Pfam Description: Ribosomal L38e protein family
MPKQIHEIKDFLLTARWKDARSVRIKRAKDALKFKVRCSRYLYTLCVHDADKANKLIAVAPARSDCPGDLRYQATNLCFFFGVRDVCSNVTLVFTCGSIAVFN

SEQ ID NO: 56753 - DNA, 699 bp, Zea mays
  misc_feature: Ceres CLONE 1499400
  misc_feature (214)..(214): n is a, c, t, g, unknown, or other
  misc_feature (215)..(215): n is a, c, t, g, unknown, or other
  misc_feature (300)..(300): n is a, c, t, g, unknown, or other
  misc_feature (304)..(304): n is a, c, t, g, unknown, or other
  misc_feature (323)..(323): n is a, c, t, g, unknown, or other
  misc_feature (330)..(330): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (512)..(512): n is a, c, t, g, unknown, or other
  misc_feature (513)..(513): n is a, c, t, g, unknown, or other
  misc_feature (533)..(533): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (544)..(544): n is a, c, t, g, unknown, or other
  misc_feature (581)..(581): n is a, c, t, g, unknown, or other
  misc_feature (665)..(665): n is a, c, t, g, unknown, or other
aaagctggagctccccgcggtggcggccgctctagaactagtggatcccccgggctgcaggaattcgtctcacccctagaaaaaataggggccatcagatccaagaagagggaagagcaccaaggaccttcggcgcccgttcaggatccacatcttcccgagcgagttcttggttgacctcttcccccttcggaccacctccaaggctcttggnngtgtagcttggccactctcaccaatcaagttttcatgtctgatctcggcattcagatcccaactgccttcgatcccttcgctgangccnatgctggggactctggtgncgcagcnaggttcaaaggactacgtttcacgtgcgcatcccgcagcgaaatggtcccaaagagccttgacctccctttccagggatttgaaaaagaatttcccccttcccgcaaatccctcaaaaatccccaaaaaaaagagggtttttttctctcgcgccgnnnnnnnnnnnnnnnngnnnnnncttnntgggtccctccccccgctgngtnnnggggcnctccctccttgccctgtttttcttgtttctgtcttgnggggcgtcgtggcgctgggcctgtcgccttgcttttctttgggggggggttgtgttttgggtggggtcgggcggcctccccccncgtgttttggcttcttggcacccccccacaccac

SEQ ID NO: 56754 - DNA, 972 bp, Zea mays
  misc_feature: Ceres CLONE 1499409
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (10)..(10): n is a, c, t, g, unknown, or other
  misc_feature (11)..(11): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (26)..(26): n is a, c, t, g, unknown, or other
  misc_feature (32)..(32): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (51)..(51): n is a, c, t, g, unknown, or other
  misc_feature (797)..(797): n is a, c, t, g, unknown, or other
  misc_feature (848)..(848): n is a, c, t, g, unknown, or other
  misc_feature (942)..(942): n is a, c, t, g, unknown, or other
nnnnnccccnnccccnnnnnnccccncccccngnnnccgtggctannnncnacaaactggtactccccgcggtggcggccgctctagaatagtggatcccccgggctgcaggaattcgtctcacccctagaaaaagtatatgacgtgacagaccaagaaagcttcaataatgtgaagcaatggttgaacgagatagaccgttatgcaagtgataatgttaacaagctccttgctgggaacaagagtgaccttactgccaacaaagttgtggcaactgagacagcaaaggcgtttgctgatgagaggggcatcccattcatggagaccactgcccaaaacgccctccaccttgaaccagcgccttctggctatggggtgcttccatacaggataggaggggcacactaacaaaccgccggccaacccctctgccaaccaaccttgtgagaatccccggggcaatccctgtccaaccaaagaaacccctttgggtgaccccctgccatataaattgccccccctccccctgtggtccccacttgactaaaatgtttatagtaaggttagagggcggcaccccccgcaaaatatataatgtcctatactcccgtcccgaaaaaattgtatacctgtttcttgttttgtagacctatatcaataaaactacgatacctgtaagacaaagtatctcttttcgatacacacactcgcccatgttatgaccgggaaaagtcgacccgctacaggagcactacctcacggccccttctatacgggcgtgcccacgccggccactnccctccttcacattgtgtcttttctgtatgataataacgaattatataganctccaccaatcttcttcacaatatatgacatcggtgaatctgatcccctatatgtctctcacttctctcctatcttccctctctctccaacagnctaaatagtataaattattaaaaaaaaaag

SEQ ID NO: 56755 - DNA, 825 bp, Zea mays
  misc_feature: Ceres CLONE 1499436
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (227)..(227): n is a, c, t, g, unknown, or other
  misc_feature (228)..(228): n is a, c, t, g, unknown, or other
  misc_feature (286)..(286): n is a, c, t, g, unknown, or other
  misc_feature (363)..(363): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (470)..(470): n is a, c, t, g, unknown, or other
ggggggggnnnnnnnnnnnnnnnnnnnnnnnnnnggggggggnnnngccaccacagatcccccccgtggcggccgctctagaactagtggacccccgggctgcaggattcgtctccccctagaaaaaaaaaccttgcccctgctcctcacgccgccgccgccgccgccgtcgccgccaccacatccgtagcgcccagccgccggagaagaggagggaggcagcaccnnccaccttgggtcgcgtccgcaccaagaccgtgaaaaaaacctccggcaggtgatcganaactcctctcccccatgaccctcgacttccacccaacaagaaggttctggaccagggctggggcctcccccccgaanccccttttttttttggttcccgggctcccccaccaattgatttttttttttccccccccccccgggggaaagaaaagagggnnnnnnnnnnnnnnnnntnnnnnccntttttggccttctgaaaaaaaaaaccccaaacacaccccctcgggggggggcgggggtggctccccgctttcctactttctcccctggggcgggccccgcccccgcccccgccgacgtcccaccccccacgcgcgtgtggggggcgctggtcggagtcgtccccggcctctgcggcgcgttttgttccctgttcgtgtcggttagtccgtgctctacccgccgccgaccaacgctagctcctcgctccagacctcccaatctatccccgatcaactctcccaaccccccctcccccctcttctatcccgacctagcggcgcccgtgagggagcgcccccgcctctctgttgcggc

SEQ ID NO: 56756 - DNA, 724 bp, Zea mays
  misc_feature: Ceres CLONE 1499439
  misc_feature: Encodes the peptide sequence at SEQ ID NO. 56757
aagctggagctccccgcggtggcggccgctctagaactagtggatcccccgggctgcaggaattcgtctcacccctagaaaaaattcacgcacctagggttttcgcgccgccgccgccgccgccgccgcagccgcaacaatgccgtcgcacaagaccttccggatcaagaagaagctggcgaagaagatgcgccagaaccgccccatcccctactggatccgcatgcgcactgacaataccatcaggtacaacgccaagcgcaggcactggcgccgcaccaagctcggcttctgagcgtcgggattggccggctgctgcgtcggaaggctagggtctaagagctatcttccttctgttttatcaatgtgtcagtttttctgtaagctagcaagtgttgctatgacgcttttattaagattctggtgagcggtgatgttaagagaatattggcactactgtggtgtaccccaagattccttgcagccttgctatgctaagtaaagaaccctttatccttattattaaaaaaaaggaagaaaggaggtagtgatacatgatgatgcaaattataaaataaggaccccggccccccggagggcccccattcccccccataggggggggtataacccccggctcctggggccgctcttttaaacacccccggacggaggaaaacccggggggttaacccacattataagccctgtggagaccatcccc

SEQ ID NO: 56757 - protein, 51 aa, Zea mays; identical to SEQ ID NO: 2355
  misc_feature: Ceres CLONE 1499439
  misc_feature (9)..(51): Pfam Name: Ribosomal_L39 Pfam Description: Ribosomal L39 protein

SEQ ID NO: 56758 - DNA, 709 bp, Zea mays
  misc_feature: Ceres CLONE 1499440
  misc_feature: Encodes the peptide sequence at SEQ ID NO. 56759
  misc_feature (447)..(447): n is a, c, t, g, unknown, or other
atagctggagctccccgcggtggcggccgctctagaactagtggatcccccgggctgcaggaattcgtctcacccctagaaaaaaacactcaggcaacccagctttggctgcccttgcttgctgctcagttctttgccccctgttcctcctcctcctcttttcgcacctcggcgcctgcttcggcatcaactgcgaccgagatggaggcgcaagacgactgcaagtggcgccaagtcccggcgttcggcgactggaacctgtgggacgacatgcccgtcacccagtactttcaggcagggaccttcttcttcgccgcgccgacgacagagaaggacgacgacgaggatctcttcaaggtgccccagttccctgccacgccctacagctacaagaagtgcgttgttcgagtgaagggggagaaagaaactgctgtgcctccggcggcnaagaagggaggaaagatgcccccgcgtgaacgagcaacataagtggaagcccaagggagctgtggacgaggacctctacaagaaatccccgcaccttccctgcaagggaaaaaaaagaaacctcctgaagaacctgctgggaaggggcccgggccctacctcatcccattgaccaaaaaacccctccttaaaaaatttccggggaaatttttttttccggggggggcccggaaaaatttaataggcccccccaaaatgggaa

SEQ ID NO: 56759 - protein, 95 aa, Zea mays
  misc_feature: Ceres CLONE 1499440
MEAQDDCKWRQVPAFGDWNLWDDMPVTQYFQAGTFFFAAPTTEKDDDEDLFKVPQFPATPYSYKKCVVRVKGEKETAVPPAAKKGGKMPPRERAT

SEQ ID NO: 56760 - DNA, 633 bp, Zea mays
  misc_feature: Ceres CLONE 1499443
  misc_feature: Translation starting site: 186
  misc_feature: Pfam Name: SelR Pfam Description: SelR domain
  misc_feature: SWISSPROT Homolog: EC 1.8.4.12 Peptide-methionine (R)-S-oxide reductase
  misc_feature (78)..(78): n is a, c, t, g, unknown, or other
aagctggagctccccgcggtggcggccgctctagaactagtggatcccccgggctgcaggaattcgtctcacccctangaaaaagcctcggtgcctgcatcatagtcattcgtactcgtacatatcctcctctgctgtcctggcgtttgcgggcccggtgctttctcttccttccggccgcggcaatggcgtcggggaacaacaacaagcagaggagcgaggaggagtggcgcgtcgtactctcccctgagcagttccgcatcctccgcctcaagggcaccgagttacccgggacaggagagtacaacaaattctacggcgacggggtttataactgcgctggctgcgggactcccctgtacaagtcgccacaaaatttgattctggctgcggctggcctgcattctttgaggggcttccagacccttaaacgaaagacaaatcctgatggtagaaggtaaaaaacacatgtgccaccttgcggggccaacttggccaaggggttaaagggaaaaggctcaaaaaacctcctggataacccccctcgcggaaaaagcggctcaaaaaaattaaaacccggggcccccccaaaaaaactccgaagaaaatcccgggcaaaaaaaatcccgagaa

SEQ ID NO: 56761 - DNA, 732 bp, Zea mays
  misc_feature: Ceres CLONE 1499447
  misc_feature: Encodes the peptide sequence at SEQ ID NO. 56762
  misc_feature (401)..(401): n is a, c, t, g, unknown, or other
  misc_feature (409)..(409): n is a, c, t, g, unknown, or other
  misc_feature (412)..(412): n is a, c, t, g, unknown, or other
aaagctggagctccccgcggtggcggccgctctagactagtggatcccccgggctgcaggaattcgtctcacccctagaaaactgccactccactcctaccccacacagaagcggcggcggcggagcaaacgcaggcgaaggcgagggtgtgagggaaggagcaccagccatggtgcacgtcaacttctaccgcaactatggtaagacgttcaagaaaccaaggcgtccttatgagaaggagcgtcttgatgctgaactgaagctggtcggtgagtatgggctgaggtgcaagcgtgagctttggagggtccagtatgcactgagcaggatccgtaatgctgcaaggcacttgctcacccttgactattagaaccccccccggaggggggagggagaggcncttcttcnccncatgaacccctatgggctgcttgctgagggtcagaacaagcttgattatggtcttgccctcccccctgaaaacttcctcgcaaggcggcttcaaacacttgtcttcagggctggcatggcccaatcccttccccatgctcgtggcttgatcaaaccgcctcacttcgggttgcccggcaaatttgcaacgccccctccttcttgggagggggggagcctcaaaaccacattgcccttttccttgtcaagcctatttgcgggcagcccccccagagtggggtacaatgaagaaccttagaaatggcgccctcccccgccct

SEQ ID NO: 56762 - protein, 66 aa, Zea mays
  misc_feature: Ceres CLONE 1499447
MVHVNFYRNYGKTFKKPRRPYEKERLDAELKLVGEYGLRCKRELWRVQYALSRIRNAARHLLTLDY

SEQ ID NO: 56763 - DNA, 746 bp, Zea mays
  misc_feature: Ceres CLONE 1499448
  misc_feature: Translation starting site: 204
  misc_feature (746)..(746): n is a, c, t, g, unknown, or other
atagctggagctccccgcggtggcggccgctctagaactagtggatcccccgggctgcaggaattcgtctcacccctagattatccaccactcatcaccaccagctgccattgccatctactgacctgtgacctccgcatttccaaacagcccgagcgagcgagctagcagagcggcggcaggcacctccctcctcaaggaacatggcccgcacgcagcagttggcagtagtggcggcggccgtggtggccttggtgctgctggcggcggcgacgtcggaggcggccatcagctgcgggcaggtggcgtcggccatcgcgccctgcatctcctacgcgcgcggccagggctcggggccctccgccggctgctgcagcggcgtcaggagcctcaacaacgccgccccgcaccaccgccgaccgccgcgccgcctgcaactgcctcaagaacgcccccgccggcgtcagcggcctcaacgccggtaacgccgccatgatccccctccaagtggcggggtcaggatccccctacaccattcagcaccttccaccgactgcttccagggtgaacctgaaccctaaaacgaagaaccacggcgcccggcggcccgccttgaagaacaatccattatctatccccccccttcctccggcccctggcgggtccggaaccgtccttgaaccttatcctaccctaccccatgaatccccaacttggcatgtccaaacctaacaaccacccggaan

SEQ ID NO: 56764 - DNA, 788 bp, Zea mays
  misc_feature: Ceres CLONE 1499453
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (32)..(32): n is a, c, t, g, unknown, or other
  misc_feature (33)..(33): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (640)..(640): n is a, c, t, g, unknown, or other
  misc_feature (683)..(683): n is a, c, t, g, unknown, or other
nnnnnnnnnnnnnnggggnnnaaccactttcnnggggggggnnnnaaaaagctggagctccccgcggtggcggccgctctagactagtggatcccccgggctgcaggaattcgtctcacccctagaaaaaagtcgtcatcgcttggcgtccgcctcagcccgccgccaggagagccggctcggtcggttcgtcgaagatcccggatctgctctgccacgaggtctttcggcgggtgttgtctcccgtggggtacgagcccaggttcggagtgttcgagaagctgaaatggctcctaaagcgctccggcccagagggtgtggcaacaacccggccttccaggtggacagggggtcaacctggttgtgtgttttttggcgtttatctctccccctctgtcgtctttttttttcccccccccctgggggggggggggggggccttaatacgcttttctttccccactcccccggaggtggccccccttggttgccccgttttggtgggtgggggggggcgggggggttggttggggggtggtgggggtgggtgtgggtgggggtgtggggtgtgtgtgttgggggggggtgctgtgtgtggggtggcgggatagtctggcggggggggtggtgtgggttgggntgtgtagaagctgagaggtgctggggatgcgccagatgaggcnattgtgggcctgtgggggtggggtggtggctgtgtggggaccgtgtgtcggggcgctgggtgtggaggcccctgcgggctgcgtggttggggcatgagtaaggcg

SEQ ID NO: 56765 - DNA, 808 bp, Zea mays
  misc_feature: Ceres CLONE 1499454
  misc_feature: Encodes the peptide sequence at SEQ ID NO. 56766
  misc_feature (1)..(1): n is a, c, t, g, unknown, or other
  misc_feature (10)..(10): n is a, c, t, g, unknown, or other
  misc_feature (32)..(32): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
nttttttttnttttttttttttattggggggnccccccnnnnntcaaactggagctccaccgcggtggcggccgctctagaactagtggatcccccgggctgcaggaattcgtctcacccctagaaaaaaccgcgcggcctcaatttccccttaacacagcacagaggaagcaggcggcggcgatggcatggcgggcgagcctgtctcggagcctaaaggagatccgcgtcctcttctgtcagtcctccccggccagcgccgctgcccgtgagttcgtgaagaagaactatggtgacatcaaggcccgcaacccctccctccccttccttgtccgcgagtgctccggtgtccagccccagctctgggcgcgctacgatatgggtgtggagagatgcgtgaacttggatggcctgacggaagcacagattgataaaaagttggaggagcttgccaaggcctggcgagccccccaaaaccaaatagttttggaactctatcctggcctgtttaactttcccaaataaatgatgccatatgggtgagcaattgtcactctaccgttatctgtagtcgggccgtgcaattacgcctttaaattggctccaaccttgtggaaataaacactaccccttttaactttgcctaaaaaaaaaacaaaaaaaccgggaacgcctcgagggtacccccacttcccccccaatgaggcggccggtattaacagcccggcagacgggggcccggccgtttgaacaagccccgccgaattggggagaaaaccctggggcggtatccccgtagttgtttttc

SEQ ID NO: 56766 - protein, 113 aa, Zea mays
  misc_feature: Ceres CLONE 1499454
  misc_feature (20)..(93): Pfam Name: L51_S25_CI-B8 Pfam Description: Mitochondrial ribosomal protein L51 / S25 / CI-B8 domain
MAWRASLSRSLKEIRVLFCQSSPASAAAREFVKKNYGDIKARNPSLPFLVRECSGVQPQLWARYDMGVERCVNLDGLTEAQIDKKLEELAKAWRAPQNQIVLELYPGLFNFPK

SEQ ID NO: 56767 - DNA, 951 bp, Zea mays
  misc_feature: Ceres CLONE 1499455
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (25)..(25): n is a, c, t, g, unknown, or other
  misc_feature (27)..(27): n is a, c, t, g, unknown, or other
  misc_feature (30)..(30): n is a, c, t, g, unknown, or other
  misc_feature (31)..(31): n is a, c, t, g, unknown, or other
  misc_feature (33)..(33): n is a, c, t, g, unknown, or other
  misc_feature (36)..(36): n is a, c, t, g, unknown, or other
  misc_feature (38)..(38): n is a, c, t, g, unknown, or other
  misc_feature (762)..(762): n is a, c, t, g, unknown, or other
  misc_feature (951)..(951): n is a, c, t, g, unknown, or other
aaaannnnnnnnnnnnnnnnttttntngtnntnatntnatgttttgtttttcaaactggtactccccgcggtggcggccgctctagaactagtggatcccccgggctgcaggaattcgtctcacccctagaaaaaccggcctcccccccccccccccccggtggtcatcacatctcccccaattcgccgccccctccgacctcgccgtactcctctcgctccgggttaatcgctgctgtcttctgcagttgaagtagccacttcatctgctcgccccatttcgcccgttgcccatggcggacgaggtggtcactgatccaaacgctttcccttagaaattttcaaaggcaaaaatgattgcctccttgtcatctatttcataaatgggttaaagatgattgaagaatggacaaaaacttcggcaaaaatcaacctgtttcggtatatgtacttttgagttaaggacaaatagtatataaacaaagcaccggctcccacccacaaaaatatcattttgtataatgtttgttattttgtactgtgtgggacgggcttcttccccgttcctttccatgttttcactcccttccttttcttatttttcgtctacattaaacatgtggctatctcgcgtcttggtgtggctgcactcctttatatttgcgcttctctaccgtggcgggccctccactatatttgtgtctttggagggagagtgttttctgtcccacccctcagtgtggttttcactacaacctgttntctcaattgtgaaccaccaattggagctttacctttttgagcggcggttgctaacctaacgtggtcatgcactgcctgaggtctcaccatgcgtttagtgttgggcggtgggtgttattagtgaaacgctcttcaatatgtattgttatacaagttgtttgctgagccacacaattataataatacatn

SEQ ID NO: 56768 - DNA, 699 bp, Zea mays
  misc_feature: Ceres CLONE 1499456
  misc_feature: Encodes the peptide sequence at SEQ ID NO. 56769
aagctggagctccccgcggtggcggccgctctagaactagtggatcccccgggctgcaggaattcgtctcacccctagaaaaatcctccatcgccatccaatggccgccaccgccctgagcatgagcatcctccgcgcgcctgcgccctgcttctcatccccactcatggtcatggacgcggttgccaaggcgttggcggcccctatgcggtgccagatgctgctcgcgcaggccacctagaacgagcaactcatcacgcccgaggcgaacttgcagatgcaggtgcgcataaacgcttacatcgtgtagtacatgtatcaggaatgaggcgacctctccatcgctgccccagcggctggctgatcttcgtgatccggcgagtcggcctctgggtccagcgaatagtcacaccacaacttcatcacgagaatcgaggtgcctacagtggaaccgctcactgcgctgctacaccaccatcgacgtgcatgtctagacgcacaggactatgacctgctattattcgtgctgactatactccgcacggcccggacgtcttggacatcaacgaggacttccacctgctgaagaaatgagacttgccgcctcaataactcgacaatgatatttaaaaatgcatgcctgaacggtcttttgctctgggaccaacagaccattttcgcctcttcaggattgaaacc

SEQ ID NO: 56769 - protein, 46 aa, Zea mays
  misc_feature: Ceres CLONE 1499456
MAATALSMSILRAPAPCFSSPLMVMDAVAKALAAPMRCQMLLAQAT

SEQ ID NO: 56770 - DNA, 737 bp, Zea mays
  misc_feature: Ceres CLONE 1499457
  misc_feature: Encodes the peptide sequence at SEQ ID NO. 56771
atagctggagctccccgcggtggcggccgctctagaactagtggatcccccgggctgcaggaattcgtctcacccctagaaaagacgcccgtactgtctccactctagagttgtgccgcctcgtctctctcctctctgctgcgcccgcctatcgtgcgtgattctatccgggattctagggttagttcgcctcgtctcgcgatggacaagggcagcgttgttgtggctacggaccctgttgatgctgcagtgaagaaggccaagcgcttcgagatcaagaagtggaacgccgtctctctctgggcctgggacatcgtggaggacaactgcgccatcggccagaaacgcatcatgcacctttgaatccagtgcaagtcgaaccacgcgagcgccaccagcaaggactgcaccgtcaacttgcgcaatttgcaaccttgcattcccatttccactgaatgaccctttggataaagaaccgacaaaggggggccccttggacaacagggagggggaagtcccgaaaggatggccccttaaaaaaaaaaggctccccgctaaaaatagcttcaacttttccggcccaaaaaaaattaggggccaccgaaaaaaattccgggggaaaaatggttcgggaattgggaaccttttcccaaaagtccccctttttccgtgaaaacttgtgggggaaaacaccccgggtaatggcctattttgtgcgcgcttcgggaggcgtttgt

SEQ ID NO: 56771 - protein, 53 aa, Zea mays
  misc_feature: Ceres CLONE 1499457
MDKGSVVVATDPVDAAVKKAKRFEIKKWNAVSLWAWDIVEDNCAIGQKRIMHL

SEQ ID NO: 56772 - DNA, 739 bp, Zea mays
  misc_feature: Ceres CLONE 1499459
  misc_feature: Encodes the peptide sequence at SEQ ID NO. 56773
caagctggagctccccgcggtggcggccgctctagaactagtggatcccccgggctgcaggaattcgtctcacccctagaaaaagtggacgcatcgtcatcaatcgagcagaggggagggagagagatgaaggagggcacggcgaactgcatcgacatcctcatcgccatcatcctcccgcctctcggcgtcttcctcaagttcggctgcaaggtcgagttctggctctgcctcctgctcaccttcctcgcctatctccccgggatcatctacgcgatctacgttatcaccaaggactagccagatagcgccgtaaaccgggacaaggtgagagagctagctgatcagccagcggaggtaatggagatgaacgtactgctgagatcactgtaatttgccctgttgctcaatgtttctggatggagactggatctcagctgtgatgttgctatatactaccgattgatcctgaaatttgtcgcttttcgttcgtgtctgcatagtatgtgatgcatagtctgtaaaatttgtctcagactcttgtgctattgtatgtaaaaaaaaaaaaaaaacgagaccctcgaggtacccaattcgcccttatagggagtcgtattaccccgcgctccctgggccgtcgttttacaaccgccgggaccggggaaaaccccgggcgttccccaactttaatcccctttgaagcccatcccccttttcgccaggtggcgaaaaaaccaaa

SEQ ID NO: 56773 - protein, 57 aa, Zea mays; identical to SEQ ID NO: 52573
  misc_feature: Ceres CLONE 1499459
  misc_feature (6)..(56): Pfam Name: UPF0057 Pfam Description: Uncharacterized protein family UPF0057

SEQ ID NO: 56774 - DNA, 721 bp, Zea mays
  misc_feature: Ceres CLONE 1499461
  misc_feature: Encodes the peptide sequence at SEQ ID NO. 56775
  misc_feature (567)..(567): n is a, c, t, g, unknown, or other
  misc_feature (568)..(568): n is a, c, t, g, unknown, or other
  misc_feature (635)..(635): n is a, c, t, g, unknown, or other
  misc_feature (721)..(721): n is a, c, t, g, unknown, or other
aagctggagctccccgcggtggcggccgctctagaactagtggatcccccgggctgcaggaattcgtctcacccctagaaaaagtccaattcatccaccttgtccgtccctccctgagaaccagaaggccacccaccttccaaggcaggggaggggccatggacgaccccgtcgagcgcttgaaggacgggttccacaagttcaagaccgaggtctatgacaagaagccggagctgttcgagcctctcaaggccggccaggcccccaagtacgtggtgttcgcctgctccgactcccgcgtgtgcccgtcggtgaccctgggcctgcagcccggcgaggccttcaccgtccgcaacatcgccgccatggtcccagcctacgacaagaccaagtacaccggcatcgggtccgccatcgagtacgccgtgtgcgcgctcaaggtggaggtcctcgtggtcattggccacagctgctgcggtggcatcagggcgctcctctccctccaggacggcgcacctgacaacttccacttcgttgagaactgggttaaagatcgcttccctgccnnagattaggtgaagaaagaccacgcatcggtgccgttcgatgaccagtgctctattctagagaaagangccgtgaacctgtcccctgagaaccctcagacctaccccttcgtcaaggaagggctggcccacgggacgctcaagctgggtcgcgn

SEQ ID NO: 56775 - protein, 138 aa, Zea mays
  misc_feature: Ceres CLONE 1499461
  misc_feature (31)..(139): Pfam Name: Pro_CA Pfam Description: Carbonic anhydrase
  misc_feature: SWISSPROT Homolog: EC 4.2.1.1 Carbonate dehydratase
  misc_feature (137)..(137): Xaa is any aa, unknown, or other
MDDPVERLKDGFHKFKTEVYDKKPELFEPLKAGQAPKYVVFACSDSRVCPSVTLGLQPGEAFTVRNIAAMVPAYDKTKYTGIGSAIEYAVCALKVEVLVVIGHSCCGGIRALLSLQDGAPDNFHFVENWVKDRFPAXD

SEQ ID NO: 56776 - DNA, 692 bp, Zea mays
  misc_feature: Ceres CLONE 1499462
  misc_feature: Encodes the peptide sequence at SEQ ID NO. 56777
aagctggagctccccgcggtggcggccgctctagaactagtggatcccccgggctgcaggaattcgtctcacccctagaaaaaccctctccttccccttcccaacgctctcggtgcagaggaaaggcgaagatggcgatgaccgtcgaagtgcttgctgcactcgcgttcatgttttccacgagtattctactgcagatactggcatgcgctttgtacaacaactggtggcccatgttagcaactctcatgtacgtccttgtaccaatgccatgcctgttttttggtggtggatccacacacttcttaaccagcaaagaaggtggagggtggattaatgctgcaaaattcttgactggtgcgtcagccatgggaagccttgctattccagcaattctgaggcacgctggcttagtcaagaccggggccatgttcatcgagttcacgtccttcttcatccttgtatgcacagtgctgtgcttccatagggcgactctggatgaagactggcaaatgcgcatttcacagtcaccctgaaccctagcgagtcttggctgctgctgtccatgcaaagaaaaattcctgttggaagccaacctggatctgtacaaaaaagcgtatttcgagcgtagccttagctgatgtcctatgtagaccctggtgaaagattatgtgaccatgggccaatgcata

SEQ ID NO: 56777 - protein, 134 aa, Zea mays
  misc_feature: Ceres CLONE 1499462
  misc_feature (8)..(124): Pfam Name: Vps55 Pfam Description: Vacuolar protein sorting 55
MAMTVEVLAALAFMFSTSILLQILACALYNNWWPMLATLMYVLVPMPCLFFGGGSTHFLTSKEGGGWINAAKFLTGASAMGSLAIPAILRHAGLVKTGAMFIEFTSFFILVCTVLCFHRATLDEDWQMRISQSP

SEQ ID NO: 56778 - DNA, 734 bp, Zea mays
  misc_feature: Ceres CLONE 1499464
  misc_feature: Encodes the peptide sequence at SEQ ID NO. 56779
  misc_feature (401)..(401): n is a, c, t, g, unknown, or other
  misc_feature (734)..(734): n is a, c, t, g, unknown, or other
aaagctggagctccccgcggtggcggccgctctagaactagtggatcccccgggctgcaggaattcgtctcacccctagaaaaatcgcacaaatcctcttcctcgagttctcctcaaccaaattcaaagtcacagcggcgaaactctcgacgatgtctggccgcggcaagggcgggaagggtctgggcaagggccgcaccaaccgccaccgcaaggtgctgcgtgacaacatccagggcatcaccaagccggccatccgcaggttggcaaggaggggcggcatcaaacgcatctcctcgctcatcaacgaagagacccgcggcttgctctatatcttcctcgagaacgtcatccgggacgccgttacctacacccaccacgcccgaggggggagggtgacntccatgtaccttgcctactctctcaagcgccagggccgcaccctctacggtttcggcgggtaggtcgcccctctccccggggcaaatttactggggggcggggccccccctgttgccttcctggggcaaataggcccgagtagcctttaaccgagccgctttctgaggggggcggccctgcacctttcctaatttctaaggccccggggccgtgcatgctccccgcgccgtaaaacaaggaaatgccccccctgtctggcaaaaaaaaaaaaaaaaaaatgagaggggcggtgggcgaggtgtgcgcgtataaaggagatgtataaaaaaacn

SEQ ID NO: 56779 - protein, 103 aa, Zea mays
  misc_feature: Ceres CLONE 1499464
  misc_feature (25)..(94): Pfam Name: Histone Pfam Description: Core histone H2A/H2B/H3/H4
MSGRGKGGKGLGKGRTNRHRKVLRDNIQGITKPAIRRLARRGGIKRISSLINEETRGLLYIFLENVIRDAVTYTHHARGGRVTSMYLAYSLKRQGRTLYGFGG

SEQ ID NO: 56780 - DNA, 702 bp, Zea mays
  misc_feature: Ceres CLONE 1499467
  misc_feature: Encodes the peptide sequence at SEQ ID NO. 56781
  misc_feature (587)..(587): n is a, c, t, g, unknown, or other
atagctggagctccccgcggtggcggccgctctagaactagtggatcccccgggctgcaggaattcgtctcacccctagaaaaagcaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcgcaacaagaaggccaatgctcttctggggttcgagaagcttgtgaaggccaagacacaagtggttgctggcacgatgtactatctcactattgaagtgaaggatggcgaagtcaagaagctctacgaagctaaggtctgggagaagccatgggagaacctcaaggggctgcaggaattcaagcctgttgaagagggtgctagcgcctaaggatgtctccttctccatgtgcgagcctgaagctcaaagcaaagttgcagaataaggagccatgctcccttgtgtaatttcataagactacaacccctatanggcttgtttggttgtgtctgtatccaaggggaattgaaggggattaattttcctttctatctaaaagaggggttttaatctcctcaaaactcttcaaatcccacctaaaccgaac

SEQ ID NO: 56781 - protein, 103 aa, Zea mays
  misc_feature: Ceres CLONE 1499467
  misc_feature (10)..(98): Pfam Name: Cystatin Pfam Description: Cystatin domain
MANNTGTLVGGIQDVPGSENDLHLQELARFAVDERNKKANALLGFEKLVKAKTQVVAGTMYYLTIEVKDGEVKKLYEAKVWEKPWENLKGLQEFKPVEEGASA

SEQ ID NO: 56782 - DNA, 717 bp, Zea mays
  misc_feature: Ceres CLONE 1499469
  misc_feature (159)..(159): n is a, c, t, g, unknown, or other
  misc_feature (373)..(373): n is a, c, t, g, unknown, or other
  misc_feature (388)..(388): n is a, c, t, g, unknown, or other
gctctagaactagtggatcccccgggctgcaggaattcgtctcacccctagaaaaaagcagcagcacagtcatccacactaacgaacgaactgaggtcgacgacgactgatcgagcagcgacgatggcggctgtgctgaacagcaggaagacgccgcangtggttgccgtgctggtggcggcggcgctgctggcgtcgtccgcttcggcggcgatcacctgcgggcaggtggggtcgtccctggctccgtgcatcccgtactctacgcggagggccggcgcgctccccgcgtcgtgcttttttggcgtcaagagcctcacacggggggggggtattttttttcccccccccccggggaaaagatacggggggnaaccctctcccacancttctatatcgtttaattggaaaaccaaccccccccttccccgggggggggcgggggtctcccctctaatttccccctccaccctggcctccggccttcctcctgtttccagcctcggcttcccgaagtacctaccctctttctctcccccccgtcgttctcctggcccctccccgctcggttgtaccgcaggcgctctcaccttcgcggggcggtggtgtgtagtgggcttcgttgtcttcgcccctgcccactcctcctcctctctccctctctccttccattcgtctgctccctctacccttcccctcgccgccgcccgcgcctcc

SEQ ID NO: 56783 - DNA, 735 bp, Zea mays
  misc_feature: Ceres CLONE 1499471
  misc_feature: Encodes the peptide sequence at SEQ ID NO. 56784
atagctggagctccccgcggtggcggccgctctagaactagtggatcccccgggctgcaggaattcgtctcacccctagaaaaaagccgagcaaataagacgacttgttgcattgattctcgaagagatcgagcttcttttgcaccacaaggtcgaggatgtcttgcaactgcggatcaagctgcggctgcggctcaagctgcaagtgcggcaagaagtaccctgacctggaggagacaagcaccgccgcgcaggccaccgtcggcctcggcgtggccccggacaagaatgccgcgcccgagttcgtcaaggccccggcggaatccggccaggccacccacgactgcagctgcggaggcaactgccagtgcgacccctgacactggtgagggcatggatcgacaaccctggatatgatcatcacctatctggcttgggagggcgctttaacccttaatcccgaggccgaactcgctgccctacatatgtattgtgtggtgatgtgtgaaaacataaaacaccgagccctgcagctttgcaacccctccccgcatgtttggccgcccgccttggggcccctggacccaacggggtggcaccctggcggggtggttgagacctgttgcccccctgctggggcccccttggtaaatttgtgccccccgacgatgccactcccaacacacctccgcacactagaaccccgacacttgctttcttaaataaaaaaaaaaa

SEQ ID NO: 56784 - protein, 73 aa, Zea mays
  misc_feature: Ceres CLONE 1499471
  misc_feature (1)..(73): Pfam Name: Metallothio_2 Pfam Description: Metallothionein
MSCNCGSSCGCGSSCKCGKKYPDLEETSTAAQATVGLGVAPDKNAAPEFVKAPAESGQATHDCSCGGNCQCDP

SEQ ID NO: 56785 - DNA, 675 bp, Zea mays
  misc_feature: Ceres CLONE 1499635
  misc_feature: Encodes the peptide sequence at SEQ ID NO. 56786
acagctggagctccccgcggtggcggccgctctagaactagtggatcccccgggctgcaggaattcgtctcacccctagaaaaagccgcaagtccaaagggcaaagggcaaagcggaagttgcggttggcctcgtcctcctcttctccgtcgcggctcagatctctgcgtgcggcgatggcgtcgttctcggaggctccccccgggaacccgaaagccggcgagaagatctttaagaccaagtgcgcgcagtgccacacggtcgacaagggcgccggccacaagcaaggtccaaacttgaacggtctttttgggaggcagtctggtaccactgcaggctactcctactctgcgggaaacaaaaacaaggctgtagtctgggaagaagacactttgtatgagtacctgcttaaccctaaaaagtacattcctggaacccagatggtcttccctgggctgaagaagccgcaggagcgtgctgatctcatcgcgtacctgaaaggagcaactgcatagttcattgacatgccttttgccatggaaagaaaaattgtttttgcattttataaaaaacatttttagaccacttggggcaccctggtttaaccggggggcaaccacgtctcattatttttcgtccttatggggccccgtatggaatgccctaggtgtttaa

SEQ ID NO: 56786 - protein, 112 aa, Zea mays
  misc_feature: Ceres CLONE 1499635
  misc_feature (12)..(111): Pfam Name: Cytochrom_C Pfam Description: Cytochrome c
  misc_feature: SWISSPROT Homolog: EC 1.9.3.1 Cytochrome-c oxidase
MASFSEAPPGNPKAGEKIFKTKCAQCHTVDKGAGHKQGPNLNGLFGRQSGTTAGYSYSAGNKNKAVVWEEDTLYEYLLNPKKYIPGTQMVFPGLKKPQERADLIAYLKGATA

SEQ ID NO: 56787 - DNA, 725 bp, Zea mays
  misc_feature: Ceres CLONE 1499637
  misc_feature: Encodes the peptide sequence at SEQ ID NO. 56788
  misc_feature (725)..(725): n is a, c, t, g, unknown, or other
aaagctggagctccccgcggtggcggccgctctagaactagtggatcccccgggctgcaggaattcgtctcacccctagaaaaaaagaaccactttcacctgaactcctgaagcaaaagcaatggccatgagagcgcttccgctgaccccttccaggagctcctcgtttggagctcaccaaaccaggccgagcggcggcggccccagatcagtgagagcttatgcgaagggagacgaggagggcgacaagcagtccctcttcggaagcatcaccgaggcgctggacttctcgcaggtccggtcggagaaggacgccgagctgctgtacgaggccagggagtccaccacaggtggagggaggatgacaagggagcagcccggagcactttagcccgaggattgtggccccctaccaggaattctttcaagtcaatatgtttgaagtccaacggccaatcccctggaaggaaggtttgggtccgaccaagaccctggcaaggatcctgccaggaaaggaaaccaaaggcggggaacccccaagccccggtttgaaaaagcctacggaaacaaaaccccttcaaccgtttgccgtggctctggggaaaacccccccaaaccccaaaaaaaatctttttttcggccaaagatctcttccccccaggaaagaaacctatatgcctgccctctccggtcacaaaaggccgtttgtccctcccccctccccn

SEQ ID NO: 56788 - protein, 89 aa, Zea mays
  misc_feature: Ceres CLONE 1499637
MAMRALPLTPSRSSSFGAHQTRPSGGGPRSVRAYAKGDEEGDKQSLFGSITEALDFSQVRSEKDAELLYEARESTTGGGRMTREQPGAL

SEQ ID NO: 56789 - DNA, 715 bp, Zea mays
  misc_feature: Ceres CLONE 1499641
  misc_feature (80)..(80): n is a, c, t, g, unknown, or other
  misc_feature (81)..(81): n is a, c, t, g, unknown, or other
  misc_feature (482)..(482): n is a, c, t, g, unknown, or other
aaagctggagctccccgcggtggcggccgctctagaactagtggatcccccgggctgcaggaattcgtctcacccctagnnaaggtaccacctctccatccttaatccttcactagcttagctagccagccacctccgttcactccatctcttgccggccagtgctccgtcgatcgacccgtagccaaccaccgacaactagctagcaacaatggctgccgtcgtcaacgcgcgagccgcaactgctcgttgctcggccgccggcgggccaccacccggtgctgcgtcctcgtttccgccgtcgacgataaggacgaggaagaggacgaccgcggcggccggcggccgcgggccggtttgtcccgccctcgccggggggggggggggcggcctaaaggcaccccgtatttcatcgcccgatcggtggcccgcggacccccgccagcaccggcgtccccaacctcttctctcgccagggcaanagcccccgcccgcaacgggagccggggttactccccaaacgctagccgcgaacaccttcggaccaacgtcctcgcgccggaacggacaacacccgaagatgacctggctcccccgcccttatccccccccccgcctcatctcgtaccacatacccgccacacccttgtaacccacctcactactcctacataatcggttataacccccgcaatcccccccccattccctctag

SEQ ID NO: 56790 - DNA, 666 bp, Zea mays
  misc_feature: Ceres CLONE 1499644
  misc_feature: Encodes the peptide sequence at SEQ ID NO. 56791
  misc_feature (1)..(1): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (403)..(403): n is a, c, t, g, unknown, or other
  misc_feature (421)..(421): n is a, c, t, g, unknown, or other
nacagctggagctccccgcggtggcggccgctctagaactagtggatcccccgggctgcaggaattcgtctcacccctagaaaactcccggctcagacttctgctgcagcgcctccgccgccgccgccgcatctaacgcagttccctccgccgcagcccgaggcaagatggttctccagaacgacattgatctgctcaacccgccggcagaactcnnnnnaagctcaagcacaagaaaaagagactcgtccagtcgcccaactccttcttcatggatgttaagtgccaggggtgcttcagcataaccactgttttcagccactcccagactggttgttgttgtgcccctggctgccaaactgtcctctgccaccccgcagcaggagagggagggctcactganggctccccttttcccccngaaagggagagtagagcggaagtggccttcaagttttgcctcatgccagatactagcgtcttgaattgcctttacttaaaatttttcctaagttggtccccaagcacctggggggtgccatgcctgggtcccttcccaaacttacactctcgcggtggctttggaatctggttgggcacccatcgcgcccttcctaaactttattaccccccaagtgtcttaacaccccaaacataaccaaacca

SEQ ID NO: 56791 - protein, 128 aa, Zea mays
  misc_feature: Ceres CLONE 1499644
  misc_feature (1)..(51): Pfam Name: Ribosomal_S27e Pfam Description: Ribosomal protein S27
  misc_feature (44)..(44): Xaa is any aa, unknown, or other
MDVKCQGCFSITTVFSHSQTGCCCAPGCQTVLCHPAAGEGGLTXGSPFPPERESRAEVAFKFCLMPDTSVLNCLYLKFFLSWSPSTWGVPCLGPFPNLHSRGGFGIWLGTHRALPKLYYPPSVLTPQT

SEQ ID NO: 56792 - DNA, 627 bp, Zea mays
  misc_feature: Ceres CLONE 1499647
  misc_feature: Encodes the peptide sequence at SEQ ID NO. 56793
  misc_feature (627)..(627): n is a, c, t, g, unknown, or other
gcatttctcccccatcccccgggctgcaggaattcgtctcacccctagaaaaaatcgccattcgccacaaagccatttgaaccccccacgtctcctcgcctcgttccccatttgctgcgtctccttgcccgcgccgccgctcgccgtttgcccctcgtctccgcaccgcgcgctgttgtccatccttgtgcagcaaaaatgacggctggctacattgttggctcactggtcggatcctttgccattgcatacctgtgtgacacatttatctctgacaagaaggcatttggaggtagcacccccaagactgtttctgagaaggagtggtggtaagccacagacaccaagtgccagggctggcctcgcactgctgggccaccggttgtcatgaaccccatcagccgccagaacttcatcgtcaagtccactgagtaggtttgggctggagaagctggttctgcgacttggtgccgccatgaagccagagttccttttctaaggtcttaatcaattgcaataaaacgaaatacagtcaggatttttttgggaatttttacttgatctggtgagcgaaaactgggtcttttcaccttgtccatccaaggggtttctgcctccttgggtgan

SEQ ID NO: 56793 - protein, 44 aa, Zea mays
  misc_feature: Ceres CLONE 1499647
  misc_feature (3)..(45): Pfam Name: DUF1138 Pfam Description: Protein of unknown function (DUF1138)
MTAGYIVGSLVGSFAIAYLCDTFISDKKAFGGSTPKTVSEKEWW

SEQ ID NO: 56794 - DNA, 651 bp, Zea mays
  misc_feature: Ceres CLONE 1499649
  misc_feature: Encodes the peptide sequence at SEQ ID NO. 56795
aaagctggagctccccgcggtggcggccgctctagaactagtggatcccccgggctgcaggaattcgtctcacccctagaaaaaatctcacggctagctagcacaagcatagtgcaggggcttgccacctaagtaaggcccgcctgagagccatggcatccaaggccgtcctcttcttggctctcaacctcctgttcttcacggtggccaacgcctgcggcaactgcccgaccccaacgcccccggtcgagccaccgccgccgcctcctgctgctaccccacccccttcgtccagcggcaagtgcccgctgaacgcgctcaagttcggcgtgtgcgccgatgtgctcggcctcgtcaaaggcgaggttggcaaggtgcctgccgagccatgctgtaccctcatcaaaggccttgcggacttcgaggccgccgtctgcctctgcacggccatcaaggccaacgtgctcggcgtcgtcgtcgatgtccccatcaagctcagcgcgctcgtcaactactgtggcaagtgcgtgcccaagggctacatgtgcccgtaaacaagctccgggcggttacacgctcctagctgttcacctcccagaattatatatgccccccacccttgcaggcaacaaaatgcatgcattggggccc

SEQ ID NO: 56795 - protein, 133 aa, Zea mays
  misc_feature: Ceres CLONE 1499649
  misc_feature (51)..(132): Pfam Name: Tryp_alpha_amyl Pfam Description: Protease inhibitor/seed storage/LTP family
MASKAVLFLALNLLFFTVANACGNCPTPTPPVEPPPPPPAATPPPSSSGKCPLNALKFGVCADVLGLVKGEVGKVPAEPCCTLIKGLADFEAAVCLCTAIKANVLGVVVDVPIKLSALVNYCGKCVPKGYMCP

SEQ ID NO: 56796 - DNA, 499 bp, Zea mays
  misc_feature: Ceres CLONE 1499653
aaactggagctccccgcggtggcggccgctctagaactagtggatcccccgggctgcaggaattcgtctcacccctagaaaaaaggataggctcattacataaaaaaaagatatggaaatagccataatacataacaaaaaagaaaaaaaggagcggggagagccaaatgaatcgaaagattcatgtttttggttcgggaagaatctaaaatgtaactaatagcagatatctacttcataaagattattaatatcgaaaacgagattttagtctattcaattcggaaattgctaagggactttgacaatccgaaagttcgttcgattccaaagtcaactgtaacccataatttcaaaagaagggacctctgaaataccccgaaaaaaaaatttgttaagcgcctctttttgttggggacttttgaaaatttaaaaccaacccctttttttttaaaaaaaggggggattaattgtcgccccaaacggttttttccaaaac

SEQ ID NO: 56797 - DNA, 689 bp, Zea mays
  misc_feature: Ceres CLONE 1499660
  misc_feature: Encodes the peptide sequence at SEQ ID NO. 56798
caaagctggagctccccgcggtggcggccgctctagaactagtggatcccccgggctgcaggaattcgtctcacccctagaaaaaagccagccagcaagcaagcagagaacaaggataacacagcaactgaaaaccttagaacaaacaaccacaagaggctttgcaagttcacagaggtagctgttcactgcgaatgaacaaccagaggaagcctggagactggaactgcaagaactgccagcatctcaacttcagccgccgtgactactgccagcgttgccgtgatccacgccctgacttgcagttcggcgacggctatagcacggttggtgtgctgacctccctggacatccgcccaggtgactggtactgcagctgcggctaccacaacttcgccagccgcagcagctgcttcaagtgcggcacgatcgtcagagacttcccagcggggcaaggcgccacccggtgctgagggtgactttggggggggacccaacagcgccgcagtccgtgctgggtggaaagctggcgactggatctgcacgaggcctggttcccaactaacacaacttttgcgaaccaggaatgaaattgctattaggtgcaaatgcacccaagggaaggctaggcccccgggggaggtaaaaaggccacacttgggggtgaaacccaaggaacccttgaaaat

SEQ ID NO: 56798 - protein, 92 aa, Zea mays
  misc_feature: Ceres CLONE 1499660
  misc_feature (54)..(82): Pfam Name: zf-RanBP Pfam Description: Zn-finger in Ran binding protein and others
MNNQRKPGDWNCKNCQHLNFSRRDYCQRCRDPRPDLQFGDGYSTVGVLTSLDIRPGDWYCSCGYHNFASRSSCFKCGTIVRDFPAGQGATRC

SEQ ID NO: 56799 - DNA, 652 bp, Zea mays
  misc_feature: Ceres CLONE 1499664
  misc_feature: Encodes the peptide sequence at SEQ ID NO. 56800
caaaagctggagctccccgcggtggcggccgctctagaactagtggatcccccgggctgcaggaattcgtctcacccctagaaaaaatccaccatcacacacagcaatccacacaagcacttcgacgtcacacgggcgctgcacacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtcgcacgcgccggcgccaaccaccaccaccaccatggtcaccacggcggccacggcttcgtggtgcgcgagacccaggtcgaggaggacatcaacacctgcaccggcgaagtccacgagcgcagggagagcttcctcgccagggctaactgagcagcccgggcggcccgcatccacgcccgttcgtgcctgcctgcgtgccttatgtatgtctgtgattgtgcagggtcatcgtacttggctagcgtacgtacgtgcacgcactcaactcctgtacaattacgaaaataagctcgtgacctgaataaaactccttcgaaaacctaatactacctcacccccaaaaaaaaaaag

SEQ ID NO: 56800 - protein, 93 aa, Zea mays
  misc_feature: Ceres CLONE 1499664
MAYYQEVDYCSEEVRSVAPAGFGRHGGGVQQHVVKEKFEEVDTVARAGANHHHHHGHHGGHGFVVRETQVEEDINTCTGEVHERRESFLARAN

SEQ ID NO: 56801 - DNA, 740 bp, Zea mays
  misc_feature: Ceres CLONE 1499665
  misc_feature: Encodes the peptide sequence at SEQ ID NO. 56802
aaagctggagctccccgcggtggcggccgctctagaactagtggatcccccgggctgcaggaattcgtctcacccctagaaaaagagcagcaacaagccaacaactaaaggcaggcgcggcacaccgcgacaccgtaccggcctagacacttggagaaaggagaagcagcgcagcggcatgggcaccagtcccgtcatccctgcgacgatgctcgtcgtcgctctccttgtcgctagtagtactgtctgcttcggcgccaccgccaccgacaccgacaccgacggcgccattcgtctccccagcagctctggtgctgttggtcgaaccgtgggagtgctgtgactatgtcaccaaaggagccgtttatcagggcccccccggtggccgctgcaacgacgttgggggacaagtgcctccccccgacctgcccagaagtcgaaggagttcccccgggccggcgaacggcttttctccctgcccggggcctggatatttttcgccctggttccaagcccccccggttctgcacacccccagggcctcgggggaatttgcttgccgaattttcccccgttcttgctgaaaggggggcttatatttcccccctaattggcccagtgcgcgggaaactgtgggtgggaaatccttgccccccccagccaccctgtaaaaaccctttccaaacccttgtgtggaaaccccgaaaccccttccctccgttaacccggaggcgccaaag

SEQ ID NO: 56802 - protein, 54 aa, Zea mays
  misc_feature: Ceres CLONE 1499665
MGTSPVIPATMLVVALLVASSTVCFGATATDTDTDGAIRLPSSSGAVGRTVGVL

SEQ ID NO: 56803 - DNA, 687 bp, Zea mays
  misc_feature: Ceres CLONE 1499777
  misc_feature (547)..(547): n is a, c, t, g, unknown, or other
  misc_feature (596)..(596): n is a, c, t, g, unknown, or other
  misc_feature (656)..(656): n is a, c, t, g, unknown, or other
cgattgggtccgggcccccctcgagccactgcagtggtaaaggagcagcatccttgtgtatagatcggcctgctactcgcggctacacataagtatattccggccttccctctcttgtgctcttggcatctcgttgctttcgtgcacccgtcgtcgcacaccagctgtggcatcttgcgcaccagatgtgccatcaccatcccgccggtgcaccaatgactggccattatggcgcgtgaagaagggtctgctggtgctggctcttgggctcgccatgtccgctacctcgtctgccgtcttctacaaggtctgatacacctcctggtggaccatccttggcaacgtcaactacgccgactgcacttccaagaagaacttccgtgtcgcacacaccataaatttcacgtacccgccaggcatccacaacgtgctgcaggtgaaaaaagcctactacgactgctgcaccaactcgacgccgatcgccacgtatagctcgagcgacgacgatatcgtcatctatagcaccgtgcacagcatgctcatatgncggctgacctgccactgctccgcgagctccaaactctacgtgcgcgttntcagtgacgcgctcatctgacgcgccttccaatgcgacctctgcgagctcaataacaggntttgagaggtgtgacctccagccccaccacc

SEQ ID NO: 56804 - DNA, 874 bp, Zea mays
  misc_feature: Ceres CLONE 1499779-R
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (874)..(874): n is a, c, t, g, unknown, or other
ctccccgcggtggcggccgctctagaactagtggatcccccgggctgcaggaattcccagagctctggtttttttttttttttttccatttttttttttttttttaaaaaaagataacctaaaccccgggagattaaaaattcactcgtaatttcaagggttgcaaatttttgccccccttggccggaaaaaaaaaaaaaggggaaagggtagggaaaacgccccccgggggggaaaaaaaaaaggaggtgggggttggaaccaaaaaaacaccccccggggtttttttggggggctttcggattggccaaaaaaaaaaaattttttccttttttaaacccgcattttgggaaacctttcttgggaaaaggggaagggccccccggggttaaggcgcagggtttcctttttacaccgaaaccaagtgtggacaaaaatacccccaaaagggtccctgttttgcccggaggccctgggggaggaacgggggcttaagggagaggcccccggccctcttggggggcggaagaggggccccccccccctccttgggggccctcccaagggcctcctagatgcccgggctaaatgagggccaaaaaaggttgtcaaacctcaacccgtatttccggaggcggggggaaacagtgcccttttggaggcccacaaacggtttggggcgcgggtccaccaacccgtgaagaagcgggttaataagggaaaaattttggtgcggcgccgggaccgggaacttttttcctcaccttgggcatgggccgggggaaaaccttttccttctctttaacacggaattgggggggggggcgccgtcatcatnnnnnnnnnnnnnnnnnnnnnnnnnnnnnnnnnnccn

SEQ ID NO: 56805 - DNA, 664 bp, Zea mays
  misc_feature: Ceres CLONE 1499781
  misc_feature: Encodes the peptide sequence at SEQ ID NO. 56806
cgattgggtaccgggccccccctcgagccactgcagtggtaaagggagccattcaccgcaccaacacacaacggcagagaccactgaagccgtgaccgtgggagagctccgagcgccagccgcgtgcggcgtgtccatactccatacacggaggaagaggaacagaggaagagcaggaggagatgtacttccgtccgccgcccaagggcccggagtggtacgccagcgatgcggagacggggcaggcggcgcggccgctgtacccaatgatgctggaggacccgcgtctgcggtgggcctttatccggaaggtctacagcatcctctccatccagatgctgctcaccgtcgccgtagctgccgacgtcgagtacgttcgccccgtcgctctcttcttcgtctccacgcccggcggcttcgggctctacatcttcctcctcatcctcccgttcatagagctttgccctctgtactactactaccagcaccacccggtgaacctgctgctgctcggcctcttcaccgtgggcatcagcttcgccgacggcttcatctgcgccttcaccaaaggggaggtgatcctcgagtcggcggtcctcactgcgggggtggtgctgagcctcacggcgtacacgttctgggccgcgaagcgcggcacgacttc

SEQ ID NO: 56806 - protein, 160 aa, Zea mays
  misc_feature: Ceres CLONE 1499781
MYFRPPPKGPEWYASDAETGQAARPLYPMMLEDPRLRWAFIRKVYSILSIQMLLTVAVAADVEYVRPVALFFVSTPGGFGLYIFLLILPFIELCPLYYYYQHHPVNLLLLGLFTVGISFADGFICAFTKGEVILESAVLTAGVVLSLTAYTFWAAKRGTT

SEQ ID NO: 56807 - DNA, 675 bp, Zea mays
  misc_feature: Ceres CLONE 1499788
  misc_feature: Encodes the peptide sequence at SEQ ID NO. 56808
  misc_feature (545)..(545): n is a, c, t, g, unknown, or other
cgattgggtacgggccccccctcgagccactgcagtggtaaagggctcttatcctatcctgcttttcttcgcttctctcttccccgctctctcattcttctcatacaagtctgttgttggagggacacacgtatccagcccaccaaagatttactcaatttatcccagacgagacacacactcgcaacgaccggaccgtcgaatctcgcgactccggcgacatgtcgacggcggtggcagaggtgcggccgccctacgggttccccggatccgggaaggggagcggcggcgggtatgggaaggaggcgcacttggccgcggccgggaagaggaggagcgacggcttcttcatagaggaggaggttgaagaagacgtgctgactgacaactcgtcgatcggggcgccgtctccctcgggatcgtcgatcggtgagaactcgtcgtcggaggccggcggggacgacggggaggaggaggtcgagagcaagctcaaggagggtgatgtgctcggctgcttggacgcgctcgaggactccttgccgatncagaagggcctctcgagcttctactccggcaagtctaagtcgttcaccagcctcgccgaagccacagcggcggcggcggcggtcaaagaagtgctgggccagccggagaagccctttcacagcgccgcgg

SEQ ID NO: 56808 - protein, 151 aa, Zea mays
  misc_feature: Ceres CLONE 1499788
  misc_feature (108)..(108): Xaa is any aa, unknown, or other
MSTAVAEVRPPYGFPGSGKGSGGGYGKEAHLAAAGKRRSDGFFIEEEVEEDVLTDNSSIGAPSPSGSSIGENSSSEAGGDDGEEEVESKLKEGDVLGCLDALEDSLPXQKGLSSFYSGKSKSFTSLAEATAAAAAVKEVLGQPEKPFHSAA

SEQ ID NO: 56809 - DNA, 704 bp, Zea mays
  misc_feature: Ceres CLONE 1499792
  misc_feature: Encodes the peptide sequence at SEQ ID NO. 56810
cgattgggtaccgggccccccctcgagccactgcagtggtaaagagggtagagagagagagggatggtgtgagggagggaagggagcaaaggcaaagcagccaacgaccagagagacacggaggctgacagagagagagagagagagatttgggaatcgagaaagcagggaggaagaagaagatggagcaggaggaagcgtgcacctcgtcgctgcggcagtgcaggatttgccacgacgaggaggacgagcggcgctccgccatggagtcgccctgcgcctgttccggctccctcaagtacgctcacaggggatgcgtgcagaggtggtgcgacgagaagggaagcgccgtctgcgagatttgcctccagaactttgagctgggctacaccgttcctcctcagaaaacccaacctgctgatgtcgcggtgaccatcatagacagcgtgggggtgcccaggccgcagcacgaccctgaagaagaggatcaggagcatgtggacgcggcgttgatccggagcagcgaccccgaatacccccaagtgcgcccgcgcctcccggaaggagcgcgttcttggtgcccgtccgtaggccctccacgtttcagggccgtcctggttgttgaggaacctggtcccccggggtcccgggtgcgaaacgggcccacccgtttccccttcgggcccccccaccggtaatctttg

SEQ ID NO: 56810 - protein, 171 aa, Zea mays
  misc_feature: Ceres CLONE 1499792
  misc_feature (14)..(61): Pfam Name: zf-C3HC4 Pfam Description: Zinc finger, C3HC4 type (RING finger)
MEQEEACTSSLRQCRICHDEEDERRSAMESPCACSGSLKYAHRGCVQRWCDEKGSAVCEICLQNFELGYTVPPQKTQPADVAVTIIDSVGVPRPQHDPEEEDQEHVDAALIRSSDPEYPQVRPRLPEGARSWCPSVGPPRFRAVLVVEEPGPPGSRVRNGPTRFPFGPPHR

SEQ ID NO: 56811 - DNA, 621 bp, Zea mays
  misc_feature: Ceres CLONE 1499802
  misc_feature: Encodes the peptide sequence at SEQ ID NO. 56812
  misc_feature (350)..(350): n is a, c, t, g, unknown, or other
cgattgggtaccgggccccccctcgagccctgcagtggtaaagggtggtctcctcctcccgccgcagatcagcggacgcgccgttgcctggggcaggcgaatccaacgcagtgcagttcacgctcgagcacgaccttggcgacggcaagggcttcgccccagctggaaccttctcggcccgcctcaagaccttcgcccacggcacgcagaccctcactaaacttcgctttacaaggaatgattttactgaggatgataaagcggcgttcaaaaaagtgcttcaggaagatggcttttatacaattaggctgccatctaatgtgttggacactacaaagaaacatcatggnttgtttcttcaatcaaagctagatgcattccacgtttacagttttggaatgaccacctttggttatccccccacgggggggggggggggaaaaaaattttgggggggagcaacaaaaaaagcccccccctttaaggggggggcccccccccccccccccccccccccttaaaatatctccccccaaaaaaaggaagtctttttttttttttctcttctcaaaagaggggggggggggggggggaaaaaaccccccttttttttttgttgtt

SEQ ID NO: 56812 - protein, 44 aa, Zea mays
  misc_feature: Ceres CLONE 1499802
  misc_feature (38)..(38): Xaa is any aa, unknown, or other
MILLRMIKRRSKKCFRKMAFIQLGCHLMCWTLQRNIMXCFFNQS

SEQ ID NO: 56813 - DNA, 670 bp, Zea mays
  misc_feature: Ceres CLONE 1499805
  misc_feature: Encodes the peptide sequence at SEQ ID NO. 56814
cgattgggtaccgggccccccctcgagccactgcactgtgactccgtgagctccctgcctgctgccctgcactgctgcacactccccgcccagccgcaccagctcagctcagctcagctcagcagtcatggctcgcccctgccgcagcagcagcgccgctgcccgcctcctgctgctgctcgccgccgtcgcagcggcgctccaggccgcggccgccgcgccgccggtggccagcggcttcatccgcaaatcctgccgcgcgacgcagtacccgtcggtgtgcgagcagagcctcgcggcgtacggaggctccccgccgccgcggagcccgcgtgagctggcgcgcgccgcgctggcggtgagcgcggaccgcgctcgggcagcgtccgcgtacgtgggccgcctgtgcggctcccggtccggatccggcgacggcagcccccgccgcggcgccggcgcgatgaaagggtcggcggccgcgggtcccgtgcgcgactgtctgaagaatctagcggacagcgtgggccaccctccgcgacctccgcgcaagaaaaaggcggcgccgggaatggcccgcgccggggacgcgcgcggttcagggtggcacctccaacaaacctgcaaaccctgggtgcaagcgccccgcctcacggaaagaggaaacccctgc

SEQ ID NO: 56814 - protein, 181 aa, Zea mays
  misc_feature: Ceres CLONE 1499805
MARPCRSSSAAARLLLLLAAVAAALQAAAAAPPVASGFIRKSCRATQYPSVCEQSLAAYGGSPPPRSPRELARAALAVSADRARAASAYVGRLCGSRSGSGDGSPRRGAGAMKGSAAAGPVRDCLKNLADSVGHPPRPPRKKKAAPGMARAGDARGSGWHLQQTCKPWVQAPRLTERGNPC

SEQ ID NO: 56815 - DNA, 619 bp, Zea mays
  misc_feature: Ceres CLONE 1499807
  misc_feature: Translation starting site: 104
  misc_feature (208)..(208): n is a, c, t, g, unknown, or other
  misc_feature (212)..(212): n is a, c, t, g, unknown, or other
  misc_feature (213)..(213): n is a, c, t, g, unknown, or other
  misc_feature (218)..(218): n is a, c, t, g, unknown, or other
  misc_feature (222)..(222): n is a, c, t, g, unknown, or other
  misc_feature (234)..(234): n is a, c, t, g, unknown, or other
  misc_feature (235)..(235): n is a, c, t, g, unknown, or other
  misc_feature (248)..(248): n is a, c, t, g, unknown, or other
  misc_feature (249)..(249): n is a, c, t, g, unknown, or other
  misc_feature (259)..(259): n is a, c, t, g, unknown, or other
  misc_feature (260)..(260): n is a, c, t, g, unknown, or other
  misc_feature (278)..(278): n is a, c, t, g, unknown, or other
  misc_feature (279)..(279): n is a, c, t, g, unknown, or other
  misc_feature (290)..(290): n is a, c, t, g, unknown, or other
  misc_feature (291)..(291): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (476)..(476): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (525)..(525): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (534)..(534): n is a, c, t, g, unknown, or other
  misc_feature (537)..(537): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (560)..(560): n is a, c, t, g, unknown, or other
  misc_feature (561)..(561): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (578)..(578): n is a, c, t, g, unknown, or other
  misc_feature (593)..(593): n is a, c, t, g, unknown, or other
  misc_feature (600)..(600): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
cgattgggtccgggccccccctcgagccactgcagtggtaaaggaaggaacaaagggagaagtagatctgcatctgcgagaggaggcagcgggggtggtgatgatggagagccagccgctgcaggccccgacggccacggctccgccccccggatctgcggagccagccggagctccgccggccgtcacccccggcaaggagttcacngcgnncaccntggncaagggggcccnntcgtcgtcgtgcnntcatcggagnngatacgtgctggctcagnntctctctttgnnaactcaaaaaacccgcccccttttccccctttaaaaaaaaatcccccccttgagtggggggccgcgtttttcccgcgggggggggggaaaaaaaaaaaaaaagaaactcccccccccccgggggggnnnnnaaggggggttttttgggggttttctctttttttggggagaggggattttttttncccccccccnnnnnncccccccccccnnnnnnccgaccggataagaggnctnnnnntnttnttgnnnnnnnnnnnnnnnnnagnnggggggnnnnnnnnngngggcagagggctttnctactanttttnnnnggggggggggg

SEQ ID NO: 56816 - DNA, 777 bp, Zea mays
  misc_feature: Ceres CLONE 1499811
  misc_feature: Encodes the peptide sequence at SEQ ID NO. 56817
  misc_feature (37)..(37): n is a, c, t, g, unknown, or other
  misc_feature (38)..(38): n is a, c, t, g, unknown, or other
tccccccctctttatttttctctcctgattaatcccnncctatttttttttacgattgggtccgggccccccctcgagccctgcagtggtaaagggagatccattcccaactgcacctgcgcgcctcgactggtatcccgaaccctagctagcaggtcggaggcgagagagcagccatggcgcggtgcctcgcgctcgtctccctccttctcctcggcctcgcctccgccgcctccgctgccgatgcgccctttgtcgtcgcgcacaagaaggtttcgctctcccgccccaagccgggcgtcgagcgcgtcgccgtctccctcgacctctacaaccagggatccgcgactgcctatgatgtgtcacttaatgacgactcttggccaacacaagcatttgagcttgtctctggagagaaatcgaagacattggaaaggcttgaccctggtgccactgctacataattatatgtcctggagaccaaaacaactgggcaggtccccgggcttcaccacctatcattacgcacccgtgttccccaaaaagactgcctcttccaagccaactctacttcccatccttcccccctgtgaaattccccgctgaaaagacctttcctgaaaaagaacgttttgaaatgggccccaaaaaggcttggggggccgaaaaaatgggggcaacctggaggtccggtttggtccccaaattggtacggaattggttgattctaaccctctggttgggcgaacccccttttcccaaatcatcttccctccg

SEQ ID NO: 56817 - protein, 95 aa, Zea mays
  misc_feature: Ceres CLONE 1499811
MARCLALVSLLLLGLASAASAADAPFVVAHKKVSLSRPKPGVERVAVSLDLYNQGSATAYDVSLNDDSWPTQAFELVSGEKSKTLERLDPGATAT

SEQ ID NO: 56818 - DNA, 674 bp, Zea mays
  misc_feature: Ceres CLONE 1499813
  misc_feature: Encodes the peptide sequence at SEQ ID NO. 56819
cgattgggtaccgggccccccctcgagccactgcagtggtaaaggacgctgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagcttgcagataattgcactggtctccagggcttcctcgtcttcaacgctgttggtggaggaacgggctctgggcttggttctctcctcctggagcgcctgtctgttgactatggcaagaagtccaagctcggt

SEQ ID NO: 56819 - protein, 168 aa, Zea mays
  misc_feature: Ceres CLONE 1499813
  misc_feature (49)..(168): Pfam Name: Tubulin Pfam Description: Tubulin/FtsZ family, GTPase domain
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLG

SEQ ID NO: 56820 - DNA, 667 bp, Zea mays
  misc_feature: Ceres CLONE 1499815
  misc_feature: Encodes the peptide sequence at SEQ ID NO. 56821
  misc_feature (615)..(615): n is a, c, t, g, unknown, or other
cgattgggtccgggccccccctcgagccctgcagtggtaaagggagacacagcaacctcccactccactgtccactccacccccaccacctttgcctctcctagcttttccttggcatcctagctcttcctcctcagccgcagcagatcgactaggaaacatgtgcggcggcgcgatcatctccgagttcatcccgcatcgcggcgccaagcggggtctctgcgccgaggacatctggccgcacgcggccgccgacttcgacgacctcctccacgcgcacgcgcacgcgcacggccacgacgacgacgacttcgccgccgccgcctccttccatcccgaccaagagccgccggcccgcaagcgggagcgcaagaccatgtaccgcggcatccggcgccgcccctggggcaagtgggcggcggagatccgggacccggccaagggcgcgcgcgtctggctcggcactttcgccaccgccgaagtctgcgcgcgcgcctacgaccgcgccgcgcgccgcatccgcggggccaaggccaaggtcaacttcccccacgaggacccgccgcccgagtacgacgacgacgacgacggtcacgcccacgcccacgccgtcgnggggcaggggatgctcgccatgtccgccggcgaggcagggacgaacacctag

SEQ ID NO: 56821 - protein, 168 aa, Zea mays
  misc_feature: Ceres CLONE 1499815
  misc_feature (72)..(123): Pfam Name: AP2 Pfam Description: AP2 domain
  misc_feature (152)..(152): Xaa is any aa, unknown, or other
MCGGAIISEFIPHRGAKRGLCAEDIWPHAAADFDDLLHAHAHAHGHDDDDFAAAASFHPDQEPPARKRERKTMYRGIRRRPWGKWAAEIRDPAKGARVWLGTFATAEVCARAYDRAARRIRGAKAKVNFPHEDPPPEYDDDDDGHAHAHAVXGQGMLAMSAGEAGTNT

SEQ ID NO: 56822 - DNA, 700 bp, Zea mays
  misc_feature: Ceres CLONE 1499820
  misc_feature: Encodes the peptide sequence at SEQ ID NO. 56823
  misc_feature (365)..(365): n is a, c, t, g, unknown, or other
  misc_feature (366)..(366): n is a, c, t, g, unknown, or other
  misc_feature (379)..(379): n is a, c, t, g, unknown, or other
  misc_feature (428)..(428): n is a, c, t, g, unknown, or other
cgattgggtaccgggccccccctcgagccctgcagtggtaaaggcgtctaccttctctatctccacccccaactccccaagagccgatcagaccatttgtaccgacccccgagaggcgaccaggcagtccggaagcgcgtccgtccgttggtgctgctggtgccttgtggtcgagcgatgtcgaacgccgccgacgtggaggcgggcgcccaggcgagggcggcgccggcgacgacggggatcaagccgcccccggggcggtacaacaacatgaccagcaacgggccgtacacgccaccgtcgccgttctactacgaccccgcggcggcgcacgggcggcaccactggtcgtggctggtgccgcnntgtgtcatcgccnacgtgctcatgttcgtgctggtcatggtctacaacaactgcccgcgcancggcggggactgcttcggccggggctttctcaggggcttcttctttccggcgcttaagaaaaaccccttccttggcccccagggagcccccttggaaaaatacggaacccctcaattggtaaaagggctgtgaagggaaaccagcccgggggtggggattttggccctggtttgaccccgggtcttttccccggtgtgccaaaaaaataaccccttttttttttgggggccccgggggagaaaatttttttttttctggggggggggcccgg

SEQ ID NO: 56823 - protein, 127 aa, Zea mays
  misc_feature: Ceres CLONE 1499820
  misc_feature (63)..(63): Xaa is any aa, unknown, or other
  misc_feature (68)..(68): Xaa is any aa, unknown, or other
  misc_feature (84)..(84): Xaa is any aa, unknown, or other
MSNAADVEAGAQARAAPATTGIKPPPGRYNNMTSNGPYTPPSPFYYDPAAAHGRHHWSWLVPXCVIAXVLMFVLVMVYNNCPRXGGDCFGRGFLRGFFFPALKKNPFLGPQGAPLEKYGTPQLVKGL

SEQ ID NO: 56824 - DNA, 680 bp, Zea mays
  misc_feature: Ceres CLONE 1499821
tcgagccactgagtggtaaaggtccgccagcctctcctcctccaccggatcgacgctgcaggcaggtagctgcagctccgtcctcgccctcagcgtctagcctccagctatatacgcccaccctatctatcgccaccagcgtcccgtcctcggtcctccatcagtagtaaccactcctcgtcgtctctctcgcggtctcgcctcctgcagctagctctcgccagaaagggaaaccgcatctgcttcagcctcccgtcccgtctcggcgccgccgcctgatcgaccagagcccagcgcggggcgtcgaggccgtccggggcgggtccggcgctcagatctgaggcgagtagcaagcgaaaaacattgcagatgcaggtcggaggaggcgcggccgaaagcccgggcgctgcggcggcggcgggctcgaaggcccctcgcccgagccgctacgaagttaaaaaagcggcgggactggcaaatcttttgggcagtacctgcccaaccccccggccgccctttggaacttgggcccgttgcaattgccccccacaatgctttgaatttccttgcgctaactttctaacaagttcgggcaagaaacaaagggccaaggcggccggggggggccccctttactttcgggaaaacacatattatcagcccccgcgcccatggccctt

SEQ ID NO: 56825 - DNA, 698 bp, Zea mays
  misc_feature: Ceres CLONE 1499828
  misc_feature: Encodes the peptide sequence at SEQ ID NO. 56826
cgattgggtaccgggccccccctcgagccctgcagtggtaaaggattctatttgactctctttggcacggcgacagagaaagtcgacagcatgggtccaccaccatgaccggtcgtatcgctgctgctctgagccgcgctagcgttcgcggcgcggcccagctcggacgtggacccggaggccacctactgcgccaataacttcacgggagcgtatacgcaggctagcatcgcccaggtcctggccgcgatggtcccgcgcgcctccactgcctactacgcgactgttactgccgactgtgacggaggctcagccaacatctgcggactgtggtactgccgcggctacgtcccgacgacccactgcgaacgctccatgacgtctgcagttcagaaggcggccaagtactgccgcccccagaagaatccgagcttctggtacaaccacagcatcttgcgctacaacgacgcctacttcctggagactgccggaaacggaggatgctgcttgttcctcacaacaccatgtaagaaaaattactcggccatcgttccaaccgctgcccaagagccagatttggtggggaagtgtccattgactttttcccgccctaatcccaacttcctggcagggtctggaaacaggagaaaccggggggaggtattggctttgtcacggggcaactttcttttcttttg

SEQ ID NO: 56826 - protein, 149 aa, Zea mays
  misc_feature: Ceres CLONE 1499828
MVPRASTAYYATVTADCDGGSANICGLWYCRGYVPTTHCERSMTSAVQKAAKYCRPQKNPSFWYNHSILRYNDAYFLETAGNGGCCLFLTTPCKKNYSAIVPTAAQEPDLVGKCPLTFSRPNPNFLAGSGNRRNRGEVLALSRGNFLFF

SEQ ID NO: 56827 - DNA, 646 bp, Zea mays
  misc_feature: Ceres CLONE 1499835
  misc_feature: Encodes the peptide sequence at SEQ ID NO. 56828
cgattgggtaccgggccccccctcgagccctgcagtggtaaaggggagctggtgcagggtcacccttcccctcggcctcaagagctctgcggttgccgcggccaagggcgtccgtggagaagcgggagcaggtggcggagatggaagagcaaggcggccaggcggcgctcgggtgggcggccagggacgactccggcgtcctctccccctacagcttctccagaagggttcctaaagacgacgatgtcacgatcaaggtgctctactgcgggatctgccacaccgacctgcacgtcatcaagaacgactggcgaaacgccatgtacccagtcgtcccggggcacgagatcgtgggcgtggtgaccggcgtcggcagcggcgtcacgcgggtcaaggccggcgacacggtcggcgtgcgctacttcgtggggtcctgccactcctgcgacagctgctgcaagggggacaacaactactgcacggggatcgtgctcacctccaacggcgtcgaccacgcgcacggtggcgcgcccaccatggggggattctccgacgtcctgatcgcgagcgagcactacgtggtccgcgtccccgacggcctggcgctggactgcatcgcgctgctgctctgcgccggcgtcaccgt

SEQ ID NO: 56828 - protein, 168 aa, Zea mays
  misc_feature: Ceres CLONE 1499835
  misc_feature (33)..(150): Pfam Name: ADH_N Pfam Description: Alcohol dehydrogenase GroES-like domain
  misc_feature: SWISSPROT Homolog: EC 1.1.1.255 Mannitol dehydrogenase
MEEQGGQAALGWAARDDSGVLSPYSFSRRVPKDDDVTIKVLYCGICHTDLHVIKNDWRNAMYPVVPGHEIVGVVTGVGSGVTRVKAGDTVGVRYFVGSCHSCDSCCKGDNNYCTGIVLTSNGVDHAHGGAPTMGGFSDVLIASEHYVVRVPDGLALDCIALLLCAGVT

SEQ ID NO: 56829 - DNA, 677 bp, Zea mays
  misc_feature: Ceres CLONE 1499842
  misc_feature: Encodes the peptide sequence at SEQ ID NO. 56830
  misc_feature (563)..(563): n is a, c, t, g, unknown, or other
  misc_feature (677)..(677): n is a, c, t, g, unknown, or other
cgattgggtaccgggccccccctcgagccctgcagtggtaaaggagttcacgagcagggacgccgagacgaggctcaggacgccggtgttcttcgcgtccatcgaccagcgcgacgacagcgccggcggggagagcgcgtgcacggcgctcgtcgcagtcctcgcggcgacgctccacgccggccacccggcgatgcccacccgaccggagctggacgcgctcatccgagccggctcgtcggagtggaggaagctctgcgacgacgaggcgcacatggcgcggttccccaaccgccacttcgacctggacaccgtgctcgcggcccggacgcggcccatcgcggtgcggcacgacagggccttcgtcggcttcttccagccggagagcttcgcgtcgctgtccggcgccatgtcgttcgacgacatctggcgcgagatcggcgggggcgatggcgaacgcgagcccagccgcgccgacgtgtacatagtcagctggaacgaccacttcttcgtgctcaaggtggagagcgactgctactacatcatcgacacgctcggcgagnagctctacgagggctgcgacaaggcctacatgctgaggttcgacggctcgtcccagatgcaagccgagggcacggacgaagtcatcgccacggggaagagtgctgcagggagtn

SEQ ID NO: 56830 - protein, 225 aa, Zea mays
  misc_feature: Ceres CLONE 1499842
  misc_feature (188)..(188): Xaa is any aa, unknown, or other
DWVPGPPSSPAVVKEFTSRDAETRLRTPVFFASIDQRDDSAGGESACTALVAVLAATLHAGHPAMPTRPELDALIRAGSSEWRKLCDDEAHMARFPNRHFDLDTVLAARTRPIAVRHDRAFVGFFQPESFASLSGAMSFDDIWREIGGGDGEREPSRADVYIVSWNDHFFVLKVESDCYYIIDTLGEXLYEGCDKAYMLRFDGSSQMQAEGTDEVIATGKSAAGS

SEQ ID NO: 56831 - DNA, 652 bp, Zea mays
  misc_feature: Ceres CLONE 1499844
  misc_feature: Encodes the peptide sequence at SEQ ID NO. 56832
  misc_feature (588)..(588): n is a, c, t, g, unknown, or other
cgattgggtaccgggccccccctcgagccctgcagtggtaaagggttggcgtacatactgctactaatggagacggcgctgcagcagagtgctgctactgctggcggcggcatgaggccggccggcgcggcgacgacggtgaagaaggcgaggcaggagctggagctggagcaggagcgggagttgcggtttccgcaggcggcggcggccgcggatcagggcggccttgacgaggagctccggcgcgggccgtggacggtggacgaggacctcacgctcatcaactacatcgccgaccacggcgagggccgctggaacgcgctcgctcgcgccgccgggctgaagcggacggggaagagctgccgtctgcggtggctgaactacctgcggccggacgtgaagcgcggcgacttcaccgccgacgagcagctcctcatcctcgacctccactcccgctggggcaaccgatggtccaagatcgcggcgcacctgccaggcaggacggacaacgagatcaagaactactggcggacgcgggtgcagaagcacgccaagcagctcaactgcgacgtgaacagcaagcgcttncaggacgccatgcgcttcctctggatgccacgcctagccgagcgcgccgcaacagccgcccacc

SEQ ID NO: 56832 - protein, 195 aa, Zea mays
  misc_feature: Ceres CLONE 1499844
  misc_feature (113)..(158): Pfam Name: Myb_DNA-binding Pfam Description: Myb-like DNA-binding domain
  misc_feature (60)..(107): Pfam Name: Myb_DNA-binding Pfam Description: Myb-like DNA-binding domain
  misc_feature: The sequence is a functional homolog of SEQ ID NO 156 in the 10/225,068 US patent application
  misc_feature: The sequence is a functional homolog of SEQ ID NO 262 in the 10/374,780 US patent application
  misc_feature: The sequence is a functional homolog of SEQ ID NO 282 in the 10/225,066 US patent application
  misc_feature: The sequence is a functional homolog of SEQ ID NO 1565 in the 10/374,780 US patent application
  misc_feature (174)..(174): Xaa is any aa, unknown, or other
METALQQSAATAGGGMRPAGAATTVKKARQELELEQERELRFPQAAAAADQGGLDEELRRGPWTVDEDLTLINYIADHGEGRWNALARAAGLKRTGKSCRLRWLNYLRPDVKRGDFTADEQLLILDLHSRWGNRWSKIAAHLPGRTDNEIKNYWRTRVQKHAKQLNCDVNSKRXQDAMRFLWMPRLAERAATAAH

SEQ ID NO: 56833 - DNA, 670 bp, Zea mays
  misc_feature: Ceres CLONE 1499856
  misc_feature: Encodes the peptide sequence at SEQ ID NO. 56834
cgattgggtacgggcccccctcgagccctgcagtggtaaaggggtacggcctgtcggaccagccgccggagaacgaggaggcgtcctgggtctgggatgatctcgtcgcggacgtgctcgccgtcctcgacgcgctttccatcccaaaggcgttcttggtgggcaaggacttcggcgccatgccggcgtacgacttcgcgctgcagcacccggaccgcacctgcggcgtggtgtgcctcggcatccccttcagccccgtccctttcgccttcgacaccatgcccgagggcttctacgtcctgcgctggggcgagcctggcagggcagaggctgacttcggccggtacgacgtcaggcgcgtggtgcgcaccgtctacgtgctcttctcccgcgccgacatcccgattgccaaggaagggcaggagatcatggacctggccgacctgtccgtgcccctcccggagtggttcaccgaggaggacctggacgtctacgccaagctctacgagaagtccggcttccgctacccgctccagatgccatacaggtgaaactccatggcagtaatttgccaaactgtacaggacagattacagcaggttttaaggtggtttacccaccgcttgccttccctggatgggccaggtctctaccccaagatgccgcaacg

SEQ ID NO: 56834 - protein, 182 aa, Zea mays
  misc_feature: Ceres CLONE 1499856
  misc_feature: SWISSPROT Homolog: EC 3.3.2.10 Soluble epoxide hydrolase
IGYGPPSSPAVVKGYGLSDQPPENEEASWVWDDLVADVLAVLDALSIPKAFLVGKDFGAMPAYDFALQHPDRTCGVVCLGIPFSPVPFAFDTMPEGFYVLRWGEPGRAEADFGRYDVRRVVRTVYVLFSRADIPIAKEGQEIMDLADLSVPLPEWFTEEDLDVYAKLYEKSGFRYPLQMPYR

SEQ ID NO: 56835 - DNA, 650 bp, Zea mays
  misc_feature: Ceres CLONE 1499861
  misc_feature: Encodes the peptide sequence at SEQ ID NO. 56836
cgattgggtacgggccccccctcgagccctgcagtggtaaaggagaagtaaaggcgaaggcggagcactacctgtgcgcgtgcctgggccggaacggcggcaacggcagcgacgacgtggagcggagccccggcgggatgctgtacgtgcgccagtggaacaacctccagtacgtctccagcgccgccttcctcctcaccgcctactcgcgctacctcgacgccgccgccggcggcggcggcctcctccgctgccccgcgggcgcccccgccacgccgtccgacctgctggccctggcgcgctcgcaggccgactacatcctgggccgcaacccgctgcggctcagctacatggtcggctacggccgccggtacccggtccgcgtgcaccaccgcggcgcctccatcgtcgcgcacaaggccaacagccgcttcatcggctgcatgcagggcttcgacgactggttcggccgcggccgccccaaccccaacgtgctcgccggcgccatcgtcggcgggcccaactccagggacgagttccgggacgagcgcgagaactacatgcagaccgaggcctgcacctacaacaccgcgccaatggtcgccgtcttcgccaggctgcaccgcctggtggcgcgcgacggcggcgct

SEQ ID NO: 56836 - protein, 216 aa, Zea mays
  misc_feature: Ceres CLONE 1499861
  misc_feature (1)..(204): Pfam Name: Glyco_hydro_9 Pfam Description: Glycosyl hydrolase family 9
  misc_feature: SWISSPROT Homolog: EC 3.2.1.4 Cellulase
IGYGPPLEPCSGKGEVKAKAEHYLCACLGRNGGNGSDDVERSPGGMLYVRQWNNLQYVSSAAFLLTAYSRYLDAAAGGGGLLRCPAGAPATPSDLLALARSQADYILGRNPLRLSYMVGYGRRYPVRVHHRGASIVAHKANSRFIGCMQGFDDWFGRGRPNPNVLAGAIVGGPNSRDEFRDERENYMQTEACTYNTAPMVAVFARLHRLVARDGGA

SEQ ID NO: 56837 - DNA, 670 bp, Zea mays
  misc_feature: Ceres CLONE 1499863
  misc_feature: Encodes the peptide sequence at SEQ ID NO. 56838
cgattgggtaccgggccccccctcgagccctgctgtggtaaaggatgcgcctgcggacatggacttcgtgctccaagtcatgctgcgagtggtgatgagaagaagcatccgcctgctgcaagaggtcgttgacatcgacgtggacatcggcacggatgtattcttggacgtgcgggactccggcctcttcttccgccgccggctgcccacgccgacatacgacatcgtcctcgtcgacgacgtactactactcaccggggacgtcctcctcgatcggcatgattgtgcgataggattaattattgacaagctctaaatgagctagctagctagctagggccgaaagatgtatacttctgcgcggcggggcatgtacgaaccaaggtcatatatctgtgccttcttttttgaggaatcaaaccaaattccctagctaccctagatatatgtgttatgctattgctctaactatatctatacgtgtgtaaattgaggaaaaaagaacataaaaccagagctctggtaattcctgcagcccggaggatccactatttctagagtggcagcctccgagacgcacctcccgctttcgttccccttagcgaaggtaaattccgagattgccggagtgctggacagaggtgctacctgtgtgaaattgctatccgct

SEQ ID NO: 56838 - protein, 85 aa, Zea mays
  misc_feature: Ceres CLONE 1499863
MDFVLQVMLRVVMRRSIRLLQEVVDIDVDIGTDVFLDVRDSGLFFRRRLPTPTYDIVLVDDVLLLTGDVLLDRHDCAIGLIIDKL

SEQ ID NO: 56839 - DNA, 679 bp, Zea mays
  misc_feature: Ceres CLONE 1499866
  misc_feature: Translation starting site: 116
  misc_feature (396)..(396): n is a, c, t, g, unknown, or other
cgattgggtaccgggccccccctcgagccactgcagtggtaaagggagcacctgcagcgccgccagacactccgtagtctgtaccccaagcaccggcgcggcggcggcggctaccatggcagtcgggaagaacaagaggatctccaagggaaagaagggtggtaagaaaaagaccgtcgatcccttctctaagaaggactggtatgacatcaaggccccatcggtcttcagtgtgcgcaacattgggaagactctcgtgtccaggacacagggtaccaggattgcctctgatggtctgaagcacagagtctttgaggtttgtctagctgatcttcagggtgacgaggatcaggcttacaggaaaatcaggctccgtgctgaagatgtgcaaggcangaatgtgctcacaaacttctggggcatgaattttaccacggataagctcagatctctagtaaagaagtggcagacattgattgccgcccatgttgatgtcaagacaaccgacaactacatgctgcgtttgttctgcattggttttaccaagaggcggcccaaaccaggtcaaagagaacctgctatgctcaggcatcccagatttcgcagattccccccaagatggttgagattatgatcaaccaggctcctacctgtgacctttaaggaacttgtttctaaa

SEQ ID NO: 56840 - DNA, 704 bp, Zea mays
  misc_feature: Ceres CLONE 1499867
  misc_feature (15)..(15): n is a, c, t, g, unknown, or other
  misc_feature (329)..(329): n is a, c, t, g, unknown, or other
  misc_feature (537)..(537): n is a, c, t, g, unknown, or other
tacgattgggtaccnggcccccctcgagcactgcagtggtaaagggagaaggaaaaacaattttctcgtaaccttccgggctcctcttcctctcctcgcgttcccccaccaaaccctaatccgagcacccagcgtcccagcccctacccgcttcctctcgcgccggcctttggggctctcaccctgagcggtaggaatccgcagggctccagttgggtgccagaagcatccaagtcgttggcgggagactggaaaatggcggaaaaagagggggcgaaagttggggcttaacacatggaagagcgggacaggaaggggaggctgagaangtggaattaaattttcttctcttcaacgggttcaaaatcgcccccctgggggggggggggggggacccaccaccgtccccgctctaaaggattgggttgttgcccaactggccaaaaaaaaaacaaattttcccaaaggctgttagtggattaaaacttaataatgggagggcaaattttcttaaaaaggacaggaattgtttcccanttcccaaacttcctttttggggaattttcccaaaaagcggctactcgccaacgccggttgttttggcccaacctcgcggaattcccaattaaaaaatcggaagccaagggtcccccaaaattccccccaaccccgcttcgtttggttaaaagaccgcaattggggag

SEQ ID NO: 56841 - DNA, 660 bp, Zea mays
  misc_feature: Ceres CLONE 1499869
  misc_feature: Encodes the peptide sequence at SEQ ID NO. 56842
  misc_feature (215)..(215): n is a, c, t, g, unknown, or other
cgattgggtccgggccccccctcgagccactgcagtggtaaaggcggcgtgcgcggacgaagccagatccatcggagtgacagcgagcgagagcgagagagacagagagattgtccgcgcgtcagcgactcccggcgaagacgatggggaaggggttcgcatcctacctggcgatgaagacggggccggagggcggcgacgcggcggcggcgcancaggctctgatcgacgcggacctgcgggagctcggcgtcgccgcgcggaagctcgccaaccacgcattcgtcctcggcggcgggctggggttcggcacctccttcctcaaatggctggccttcctcgccgcagtgtatctcttgatattgcatcgcaccaattggaagacaacatgctgacagctctcttgggtccttactttttctcaccctgcctaagtgctgttttctctgatcagaggagaggtgggaaaatggattgcgattattgctgttattctgcgtctatttctttccacgcccttcccagattggttaagagcttcctggttcatcatcctgctcacagggtcgcccctagcctgttcgcggacagcttcggggagacctcgttgggtgtctcatatgccttgggatccgatgctacctgctccaaaaccacttg

SEQ ID NO: 56842 - protein, 83 aa, Zea mays
  misc_feature: Ceres CLONE 1499869
  misc_feature (9)..(82): Pfam Name: WCOR413 Pfam Description: Cold acclimation protein WCOR413
  misc_feature (24)..(24): Xaa is any aa, unknown, or other
MGKGFASYLAMKTGPEGGDAAAAXQALIDADLRELGVAARKLANHAFVLGGGLGFGTSFLKWLAFLAAVYLLILHRTNWKTTC

SEQ ID NO: 56843 - DNA, 678 bp, Zea mays
  misc_feature: Ceres CLONE 1499873
  misc_feature: Encodes the peptide sequence at SEQ ID NO. 56844
  misc_feature (285)..(285): n is a, c, t, g, unknown, or other
  misc_feature (366)..(366): n is a, c, t, g, unknown, or other
  misc_feature (396)..(396): n is a, c, t, g, unknown, or other
tcgattgggtaccgggcccccctcgagccactgcagtggtaaagggacgggaagaaatccttgatcagcacaggcagagagcactgtgctgtcgcctgaggatggagctccgccgaccactccatgtggcgttggtgaaccgaggtcctgacacggagctgctggtagcgaacccggtcgaggtttctgggaagggtaggccgctggtgttctacgacatcacccttgctctcaagaatcttcagagacgaatcttcttggctgagattgggaggcacgttgtgnaaagcagggagtgggaggtctacagattgcacttcggtgaggagcacgagctctcgtctgcgctgcggaagaagattgtgnatgcaccccccaacatgctgaggggggtgnaactgatggcactgctgctgctgccgtggctccgtctgaaacattatgcttaagggtctttcagaaactaacctatttgggggaagccaaaaaaaaaacactgattcctttctcttaaatgccgccgttttccgctaagggcgaaaccatggacacctttggttatctaaaagtcccctaggaaccgggttcctcttatctagggggcccccaacctgatgtttttcccttcccggaacctgtttccaaatcccggtgggggcaattaattacccctttttt

SEQ ID NO: 56844 - protein, 148 aa, Zea mays
  misc_feature: Ceres CLONE 1499873
  misc_feature (95)..(95): Xaa is any aa, unknown, or other
  misc_feature (122)..(122): Xaa is any aa, unknown, or other
  misc_feature (132)..(132): Xaa is any aa, unknown, or other
DWVPGPPRATAVVKGREEILDQHRQRALCCRLRMELRRPLHVALVNRGPDTELLVANPVEVSGKGRPLVFYDITLALKNLQRRIFLAEIGRHVVXSREWEVYRLHFGEEHELSSALRKKIVXAPPNMLRGVXLMALLLLPWLRLKHYA

SEQ ID NO: 56845 - DNA, 601 bp, Zea mays
  misc_feature: Ceres CLONE 1499876
  misc_feature: Encodes the peptide sequence at SEQ ID NO. 56846
cgattgggtaccgggccccccctcgagccactgcagtggtaaaggtccacctcagctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgctttctctttcggcgaagaaagcccggtcaccggtcttttggcatcagggaaccccgaaggagatccccgtggggtgaggcttgtgctaattatgtcctggaatccaccggtgtctttcattgacaaagaacaaggtgctgcccatctgaggggtggttgccaaaaaggttgtttacctctgccccaaaacaaaaatgcccccctggtttttttgtttggtggcaatgaagaaacaaaaccccctcccaaagttaaaatttgttt

SEQ ID NO: 56846 - protein, 93 aa, Zea mays
  misc_feature: Ceres CLONE 1499876
  misc_feature (4)..(94): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGQWKHSDIALKDSKTLSLSAKKARSPVFWHQGTPKEIPVG

SEQ ID NO: 56847 - DNA, 666 bp, Zea mays
  misc_feature: Ceres CLONE 1499884
  misc_feature: Translation starting site: 172
  misc_feature (548)..(548): n is a, c, t, g, unknown, or other
  misc_feature (586)..(586): n is a, c, t, g, unknown, or other
cgattgggtaccgggccccccctcgagccactgcagtggtaaaggattctcatccccgacccccgcaccgcagcgtaaaccctagtccccggcggcgaccttgcggcctccgctgcgctctgactggtgcgcgtttagacgaggagctgcggcggccaagaccaatcgaccatggctacccgtatccagtttgagaacaactgtgaaattggtgttttctccaagctgacaaatgcttactgtctggtagcgattggagggtcagagaacttctacagtgcctttgaggctgagcttgcagatgccatccctgtggtcaagacctctattggtggcactagaataataggccgactttgtgttggaaacaagaatggacttctattgccacatactacaaccgaccaagagcttcagcatctgaagaattgcttgcctgatcaagtggtggttcagcgcattgatgagaggttatctgcccttggcattgcatagcctgcaatgaccatgttgcacttacgcaccctgacctttgacaggagactgangagttcattgcagatgtgcttgggggtcgagtgtttangcagactattgctgggaatatctttgtggggagtactgcgcctctctaacaggggtgtttggttcatcccctacatcggt

SEQ ID NO: 56848 - DNA, 661 bp, Zea mays
  misc_feature: Ceres CLONE 1499894
  misc_feature: Encodes the peptide sequence at SEQ ID NO. 56849
  misc_feature (351)..(351): n is a, c, t, g, unknown, or other
cgattgggtaccgggccccccctcgagccactgcagtggtaaaggattctcatcacactcgatcgcagtttgcagaaagctagaagacacaagaacatggcgtccaagcgactcctcgtgctagtagctctcctgctcgccgccgttttccttgccgtctcagcagcagctaacgacgaccaagcccaaccgaggaaggacgacggcggcgagaacaaagccgacgtgcaggactaccgtggcggcggcggcggctggcgcggtgggggtggctaccccggccgtggctacccgggcgggggcggctaccctggcggcggcccgcgcggttactgcaggtgggggtgctgncaccgcgggtactatggcggctgccggtgctgctcgcgcgccgacaaggtcccggagcccatgtaccgcccggagcccaccgaggtccacaactgaagcccagccacacatcgatctacaaagatgcatggacgacgactcttatcgtagcttattaaatagcactgcatccatgtcccacatagctagggccctagccctactatacgtcgtcagcagaaagtctggttttgatttcaataataagatgcccctatatgtgtgtgttatatgtaaaaaaaaaaaaaaaacctgagctctggggattcct

SEQ ID NO: 56849 - protein, 116 aa, Zea mays
  misc_feature: Ceres CLONE 1499894
  misc_feature (1)..(93): Pfam Name: GRP Pfam Description: Glycine rich protein family
  misc_feature (85)..(85): Xaa is any aa, unknown, or other
MASKRLLVLVALLLAAVFLAVSAAANDDQAQPRKDDGGENKADVQDYRGGGGGWRGGGGYPGRGYPGGGGYPGGGPRGYCRWGCXHRGYYGGCRCCSRADKVPEPMYRPEPTEVHN

SEQ ID NO: 56850 - DNA, 676 bp, Zea mays
  misc_feature: Ceres CLONE 1499898
  misc_feature: Encodes the peptide sequence at SEQ ID NO. 56851
  misc_feature (1)..(1): n is a, c, t, g, unknown, or other
  misc_feature (415)..(415): n is a, c, t, g, unknown, or other
ncgattgggtaccgggccccccctcgagcctcttgctttggtaaagggttcccaagcaaacagccaaacacacgctgaagaaaaggagatagagtacaggttacagacaggcagagagcaaagatgtgtggtggtgcgatcctcgccgagctcatcccgaccacgccggcgcgccgcggcggcgcggcgtggcccgccggcaagtgcaagcggcggaaggcgaacgacttcgaggccgcgttccgggagttcgacgaggactccgaggaggaggaggaggacgacgagggggtggtggagagcaagcccgccttcgtcgtcgtcgcctcgtccgcggcgacgcagcccagggcgcgccaggagcagcggagccggcgccgggcgcccgaccagcagcagtacaggtgcgtccggngccgcccgcgcggcaagtgggccgccgagatccgcgaccccgtcaggggcgtccgcgtctggctcggcaccttcccctccgccgaggccgccgcgcgcgcctacgaccacgccgcgcgccacatttgcgggcccagggccaagcttaaattcccctcctcttcgccttcgccgcgggggcccccgcccagccggaagcgcgcccgcgccgccgacgccgacgccgtcttcgacctcgagaaacagaagcagcccccggccg

SEQ ID NO: 56851 - protein, 184 aa, Zea mays
  misc_feature: Ceres CLONE 1499898
  misc_feature (91)..(142): Pfam Name: AP2 Pfam Description: AP2 domain
  misc_feature (98)..(98): Xaa is any aa, unknown, or other
MCGGAILAELIPTTPARRGGAAWPAGKCKRRKANDFEAAFREFDEDSEEEEEDDEGVVESKPAFVVVASSAATQPRARQEQRSRRRAPDQQQYRCVRXRPRGKWAAEIRDPVRGVRVWLGTFPSAEAAARAYDHAARHICGPRAKLKFPSSSPSPRGPPPSRKRARAADADAVFDLEKQKQPPA

SEQ ID NO: 56852 - DNA, 727 bp, Zea mays
  misc_feature: Ceres CLONE 1499900
  misc_feature: Translation starting site: 94
  misc_feature (401)..(401): n is a, c, t, g, unknown, or other
  misc_feature (727)..(727): n is a, c, t, g, unknown, or other
tcgattgggtaccgggccccccctcgagccactgcagtggtaaaggttcttcactcccacgctagctgcccccactccccgcgcgctatgcctatggccgaccgcgtccaccccatgccatctccctcctccccgccgcttccacctccgccagggcgacggcgacccgacgccgcggccgacgccgccacggagacgacgccgctgcacccgtccttcttccacgacatcccgctgtcaccgcccccagcaggcacgtacatcgtgcaggtgcccaaggaccaggtcctccgcgagccacctccggaccgcgcgcgccgctacaagaagctcgcaggccggcccgcgccggggccgccgcctccgccgcgcgtgccgcctctccggcggggggctcctcnccatactccttcgccgccgccgccctccttcccgggggactgtctgcctccttcttcgcccgggggggcgccgacccttctccggggcccctcggggggcggccatctgcggggcctccccaccgccaaagggtgggcggccggggccccggttcctcccccgggttttaaagcccccccggggagtacccaaaaagggggggccgaccggcgaaagtgggggctcgggaagccccccccgcggggggccccccgccccgcggggggccccccaccggtggcaccccaccctggggcccccgggcccctggtgttctccacttacn

SEQ ID NO: 56853 - DNA, 657 bp, Zea mays
  misc_feature: Ceres CLONE 1499904
  misc_feature: Encodes the peptide sequence at SEQ ID NO. 56854
  misc_feature (408)..(408): n is a, c, t, g, unknown, or other
  misc_feature (457)..(457): n is a, c, t, g, unknown, or other
cgattgggtaccgggccccccctcgagccactgcagtggtaaagggtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgagggccagtcccgcggncggcgtggaccccccggcggtgggtacggtggtggccgtgaaggcggcngctacggcgggtgcgggccgccgtgatggcggtgggcgctacggcggtggcggcggctacggtgggcggcggcggctacgggggtggttgcggcggctacgggcgtgggaaccgtggcgggcgggtacggaacctccgacgggaaactggaggaacctgaaccgggggggcccgccccgcccaatgttttcctgttccct

SEQ ID NO: 56854 - protein, 112 aa, Zea mays
  misc_feature: Ceres CLONE 1499904
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (105)..(105): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEGQSRGRRGPPGGGYGGGREGGXYGGCGPP

SEQ ID NO: 56855 - DNA, 718 bp, Zea mays
  misc_feature: Ceres CLONE 1499911
  misc_feature (141)..(141): n is a, c, t, g, unknown, or other
  misc_feature (194)..(194): n is a, c, t, g, unknown, or other
  misc_feature (199)..(199): n is a, c, t, g, unknown, or other
  misc_feature (206)..(206): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (409)..(409): n is a, c, t, g, unknown, or other
  misc_feature (414)..(414): n is a, c, t, g, unknown, or other
  misc_feature (426)..(426): n is a, c, t, g, unknown, or other
  misc_feature (461)..(461): n is a, c, t, g, unknown, or other
aactattgggtaccgggccccccctcgagccactgcagtggtaaagggcctccccagcgtaacaagtgtccttcctccatcttcctcctccactccactcccaagtccccaccacccccaaccccgtctctccactggggngcaggcttcgcttcggctccgctcggctcgaggagaagaaaagcaacgggcantgcangccgtcnggtcacacggcaatgttcttaaatatgctgttctaccacacatcagcgctcccaagccagcaatgcttcctgctgccttttctcccaaagggggaggggcatctgcctcccctatataatcgaggaatttaaaactgccccctgcagccccaattttttctttcctcccccccaggggggaaagaaaagggggggnnntttcnccccncccccccccacnaatactcccctataataaaaaaacaaaactccctnaaccccccccccgggcgggggggggtttcggtggcttggtttcccccctcccccacaaacaaaacacagtcccccgccccctctcccgttgaaaaaaaactcatcctttccccccccttaccccgggacaccgataggccggcccccccccccccccttccctttttgcgcctgtccatcatcgcccaccaaaaaaaccccgttcttacttctccctcttcgcccgcaaccccaaatactttccctacgcaaccccc

SEQ ID NO: 56856 - DNA, 662 bp, Zea mays
  misc_feature: Ceres CLONE 1499913
  misc_feature: Encodes the peptide sequence at SEQ ID NO. 56857
cgattgggtaccgggccccccctcgagccctgcagtggtaaaggttttccacctcagtcctagctagcaggtagcagctccgtttactcatccgtcacccccttcccctccattctccatcccttcctcaagaagccgagagcgagaggcgcaatgggcgaccgggcgtacgcgccggccgtgaagccggttcccgtgcgggccaccaacggcaccgcgaacggcggcggcgtggggcctccgcggcccgcgccgccgtccatggtgcccggcgggcgcgtgccccctccgccgatgtacaggcggaggcccgcgcagtcgcgtcctccggcgcggcgccccgggcggagcgcccgcgggtggtgctgcgcgtgctgcctgtggctgacgctggtgctggtggggctggcgttcctgggcgccatcgcggcgggggtgttctacgtggtgtaccggccgcggcccgccagcttcgcggtgacgtcgctgcgcctggcggcgctgaacgtgtcggacttcgacgcgctcacctcccgcgtggagttcacggggaacggccgaacccagacgaacaagattgcctttccaataccggggaactgggggttgtcttctgcctcgggcggcgcccggacttgggccaaccccttggtccccgggtt

SEQ ID NO: 56857 - protein, 169 aa, Zea mays
  misc_feature: Ceres CLONE 1499913
MGDRAYAPAVKPVPVRATNGTANGGGVGPPRPAPPSMVPGGRVPPPPMYRRRPAQSRPPARRPGRSARGWCCACCLWLTLVLVGLAFLGAIAAGVFYVVYRPRPASFAVTSLRLAALNVSDFDALTSRVEFTGNGRTQTNKIAFPIPGNWGLSSASGGARTWANPLVPG

SEQ ID NO: 56858 - DNA, 674 bp, Zea mays
  misc_feature: Ceres CLONE 1499914
  misc_feature (1)..(1): n is a, c, t, g, unknown, or other
  misc_feature (353)..(353): n is a, c, t, g, unknown, or other
  misc_feature (403)..(403): n is a, c, t, g, unknown, or other
ncgattgggtaccgggccccccctcgagccctgcagtggtaaaggcgctgtttgtggtgggtgagtttggaggcaacgactacaatgctcccctctttgcgggcatgggcatccctgaggcctacaaattcatgcccgatgtcatacagggcatctctgacggtattgaggcactgattgctgagggggttgttgagatgattgtgcctggtgtcatgcccacgggctgcttcccagtttacttgaccatgcttgatgagcccaaagaagataccgcccccacagtggttgtgtccgccggtacacacattctcctgggtgcacaatgcacatctttaagccatgcttgaaangctccggactacccaccccatgtgaggatcatatatgctattactacacntcagtcgtccagttcatgcttcagcctgagaagtttggttctgccaaaccactgcccagagcatgttgtggcgcgccatcgactcctgagagagcaacttacaacttcaatgtcacggccaaatgccgtgagcctggtgcaactgcctgtgctgatccgacaacccattggagctgggaccggattccacttgacggaggctgccctacgccataatcgcaaaggctggctatacgggtcttttcgaaggaccaacctatccttcctatcc

SEQ ID NO: 56859 - DNA, 610 bp, Zea mays
  misc_feature: Ceres CLONE 1499915
  misc_feature (223)..(223): n is a, c, t, g, unknown, or other
tcgagcactgcagtggtaaagggttccttgcgctggagggaggtttcgttctcgctggccatggtttggctgagaagcagcagcggcagcatcttgatgccaaatctctgagctttatgaagatcgccactcacctgcgccgctcctgcttcctccactccttctcggttgtcttcctctactggttttatgtgatctcataaatttgccctcccccggatcngacattcccccgtgccctctcttcgtcccctcaaacttctccctcctttcttgctcccctcaacaattcgccaaataacagcacataccggaagcgggtaaaagatttttttccaaggtaaactaaggccggccggtttcccttggggaaaaaaaaaaaaaaaaaaaaaacccctgcctttgaatgtgcccccccccccctttgtccccccaacagcgggaaaaaaaaaattccgggtccaaaaaagggaaaattgatgggggagaaaaccccaaaaggggcccaaaaaaaaccccccggtttttccaaaccccaaaattatttgccccccggggtttcttcttttttccgaaaaaaaaaaaaaaccccttcttgtaaaaaaaaagg

SEQ ID NO: 56860 - DNA, 666 bp, Zea mays
  misc_feature: Ceres CLONE 1499917
  misc_feature: Encodes the peptide sequence at SEQ ID NO. 56861
  misc_feature (291)..(291): n is a, c, t, g, unknown, or other
  misc_feature (294)..(294): n is a, c, t, g, unknown, or other
  misc_feature (323)..(323): n is a, c, t, g, unknown, or other
  misc_feature (330)..(330): n is a, c, t, g, unknown, or other
  misc_feature (341)..(341): n is a, c, t, g, unknown, or other
  misc_feature (359)..(359): n is a, c, t, g, unknown, or other
  misc_feature (360)..(360): n is a, c, t, g, unknown, or other
  misc_feature (405)..(405): n is a, c, t, g, unknown, or other
cgattgggtaccgggccccccctcgagccctgcagtggtaaaggctgctccctccgtcggcgaacaagggcaccaacttcagccagggcgccaacttcgcggtgatgggcgcgacggcgcttgacctcaagtacttcaaggacaacaacgtgtggagcatcccgcccttcaacacgtccatgggcgtgcagctggagtggttccaggaagtgaagcgcagcatctgccccgacgaccccggcgcgtgccgcgcccctgtcgggagggccctgttcgtgttcggcgagttcngcngcaacgactacagcttcgcgtggaaggcngactggntcgctgaaaangtgaagacaatggtgccnngcgtggtggcctccctggtgggcggcgtggagccgctgctggacnagccgccccgcacgtcgtggtgccggccacctcccccgcggatgcatccccatcacgctcaccatgtacccgtccaaggaccgctcccaagtaccaaccgcgcacgggctgcctcaaagaaataaaacagcgtcgcgctctaccacaacggccttgctccgcgtcgcgctcaaacgcctgcagcgcccccccccggattcccgcgtcttctaacccaatactaaacgccctaaataaggttcggcccccccccaacctcta

SEQ ID NO: 56861 - protein, 141 aa, Zea mays
  misc_feature: Ceres CLONE 1499917
  misc_feature (63)..(63): Xaa is any aa, unknown, or other
  misc_feature (64)..(64): Xaa is any aa, unknown, or other
  misc_feature (76)..(76): Xaa is any aa, unknown, or other
  misc_feature (79)..(79): Xaa is any aa, unknown, or other
  misc_feature (86)..(86): Xaa is any aa, unknown, or other
  misc_feature (101)..(101): Xaa is any aa, unknown, or other
MGATALDLKYFKDNNVWSIPPFNTSMGVQLEWFQEVKRSICPDDPGACRAPVGRALFVFGEFXXNDYSFAWKADWXAEXVKTMVPXVVASLVGGVEPLLDXPPRTSWCRPPPPRMHPHHAHHVPVQGPLPSTNRARAASKK

SEQ ID NO: 56862 - DNA, 658 bp, Zea mays
  misc_feature: Ceres CLONE 1499918
  misc_feature: Encodes the peptide sequence at SEQ ID NO. 56863
  misc_feature (382)..(382): n is a, c, t, g, unknown, or other
acgattgggtaccgggccccccctcgagccactgcagtggtaaagggttggccgaaagggtaagcttcctagggtttgtggcggcgggcggcggctgtagcaggagctggcgacgcatcctcctcgtctggccagccgcacattgtgatctaatacaatggctagcgatggtgatgcttcacctccacggaagcgtatgttattggagttgccttgtgatgaagaaagtgcaaatgtgagtcaaaatgttggtgtgtccgcatcatcagccacacctgccgctgccagagattctcatgaacaaggtgaaaatccagaaggtggaagtaatgttgatggggatgattcttcaaaggaaaagcagtcaaagaagtccacttcnaatgtttggcagtattttgagaagtatgaggttgtggtagaggagaatggcaaatcagtgaagcaaatttgggccaaatgcaagtatcctggctgcaaaaacaagactagcaaagctagggcagaaagcaatagaggaacaactgcttttttgttctcctttaaggaattatcataagattgtgagggggcaacaggaactcaaaggcaaaaaaggatcatggcacagttgacatgatttaagtcaagtatcgaaaaaagagctttgatagctact

SEQ ID NO: 56863 - protein, 133 aa, Zea mays
  misc_feature: Ceres CLONE 1499918
MASDGDASPPRKRMLLELPCDEESANVSQNVGVSASSATPAAARDSHEQGENPEGGSNVDGDDSSKEKQSKKSTSNVWQYFEKYEVVVEENGKSVKQIWAKCKYPGCKNKTSKARAESNRGTTAFLFSFKELS

SEQ ID NO: 56864 - DNA, 667 bp, Zea mays
  misc_feature: Ceres CLONE 1499920
  misc_feature (667)..(667): n is a, c, t, g, unknown, or other
cgattgggtccgggccccccctcgagccctgcagtggtaaaggacgctgtcgggtgccggtgccgacggcctctctcacgcaacaaagcggcataaacggagcaacagctgatgtccgctctccctcacctcgctccccgacggacggacggatgacggattggtgacattcttcttttccctcccagcaacggggaggctcgtggattggctggctggctgtacattgtgtgctgtgcttggtgacaagctgagacctccggcgtattctttgattcgatcacccccccgcccgccatcccattgtttacgtaaagaaaaggaaccgtggagctttccatcgcggattgtgaagccgctcttgtacacaggcttccatcaatgtgagaagctcccccttcctggaagatctccgtggtgaaacctgtagccacctgaaaaatgtgatgatgcccaaaaaacactctgccaaaaccactggttagtcgaggttggtgggttaacttatggaccgggggtttctgtttttgcggggaaggggaatttgcccgggctttctcccccagaaaattgagacccccccggttgggggggctttttttttccccccaaaaaaaaaaaaaaaaaaaaaaacaccccgaacgccttctgggggaaaatttccccn

SEQ ID NO: 56865 - DNA, 662 bp, Zea mays
  misc_feature: Ceres CLONE 1501234
  misc_feature: Encodes the peptide sequence at SEQ ID NO. 56866
  misc_feature (1)..(1): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
ncgattgggtaccgggccccccctcgagcactgcagtggtaaaggagaggcagctccccaactgttagaatggacgacacggaagccgccaagaacacggccaccaccggccccactttcgcctcccctctcttctctttctccaacctcggcggtgcttccttcggctctggctttggcttcaaatccagcgctcctctgccgcctgccatcgaggtccagctctgcgaggaatcacccgttccggcagctaggttggagccagtcgtggtcgatgactccttgacgatctacaagggcagagtgagtacatctgacgtgtttggtgtcaaagactctgatttggtccctggaaaatatgaaggtgggttgaagctgtgggaaggttcattagacttggtgaaagccctgaattctgatatcaaagaagataaatttcatctggaaggcaaacgcgtattggagcttggatgtggacatggcctccctggcatttttgcgggtctcaagggtgctgacctgattcatttccaagatttcaatgccgaggtgcttaggtgcttgactataccaaatgtaaaagtcaatctttttcaaggatttcacagaaggaacatacgggnnnnnnnnnnnnnnnnnnnnannnnnnnnnnnnnnnnnnn

SEQ ID NO: 56866 - protein, 184 aa, Zea mays
  misc_feature: Ceres CLONE 1501234
MDDTEAAKNTATTGPTFASPLFSFSNLGGASFGSGFGFKSSAPLPPAIEVQLCEESPVPAARLEPVVVDDSLTIYKGRVSTSDVFGVKDSDLVPGKYEGGLKLWEGSLDLVKALNSDIKEDKFHLEGKRVLELGCGHGLPGIFAGLKGADLIHFQDFNAEVLRCLTIPNVKVNLFQGFHRRNIR

SEQ ID NO: 56867 - DNA, 706 bp, Zea mays
  misc_feature: Ceres CLONE 1501245
  misc_feature: Encodes the peptide sequence at SEQ ID NO. 56868
cgattgggtaccgggccccccctcgagccctgcagtggtaaagggcgtcagggcctctcgatcgctcatcagtcgccagaggagtagttgatcgaggtgagtgaggttgaaaagcaggcggcgaacaaaggcaccatcgtcatggacggcggatactacggcggccgcgatcagcgctacagcggcgggtactacggcggcggtggcatcgcgacgccggggtacgctccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcgaccggaaggtggtgcttggcccccgccaacccccaaggacaagttcccccccttggatcaaggacctgccggtgaacccccaacctccaggaccaaagaaaggtaccccggggtttccccctggggaaaaaaagccacccgggggaggcacttaagccacccccgtgggggaagcccccccccgggggcccctgggggcccccaacaacccggagattttttggaaccaaatcccggttttttgaaaaagaaaaaaccccacaaatctggaaaaagggtgttcccctggcgcccccctgggggaaaaaaaaatttctccccaaattttgcgcccccccccccggagaaaaa

SEQ ID NO: 56868 - protein, 122 aa, Zea mays
  misc_feature: Ceres CLONE 1501245
MDGGYYGGRDQRYSGGYYGGGGIATPGYAPAVPYGMSQVNIEGNGCGRALPPQPTVKVYCRANPNYAMSVRDRKVVLGPRQPPRTSSPPWIKDLPVNPQPPGPKKGTPGFPPGEKKPPGGGT

SEQ ID NO: 56869 - DNA, 668 bp, Zea mays
  misc_feature: Ceres CLONE 1501246
  misc_feature: Encodes the peptide sequence at SEQ ID NO. 56870
cgattgggtaccgggccccccctcgagccactgcagtggtaaaggagaggtccgctagcggtggccttcaagcccatctcggtagccggagaacgagctgcagctgatgctatggcgtcccctgatcctggccacgcgggctgggtaaggcgaggactctgcctctccctcctcgggggctccccgaaagctccagagcttcgcacctgggctgtggtcataatacacagcttatgatgatgcatttgcggagaacattaagggatgtattgcggatgctctgggtcttgtgagagacctccggcggaggctattggatgtgcccctgttgcaggattcattctgctcggacgccctcgacgatgtttcttccctcttaccatgaggccgctcatagactgagtacgatttactgaatgctgccaagcctactatgatgtagtacctatcatctattcagaacttgatgaaagcatcagaatacactcttgacaaagtagctgtctgtgaaatcgatgtgcaccgtgggcgcactgatcttagatctactgcgacgcagatgcaatctcttataggttccatttacaacgctagatctcctgctgcaagtctgatggatagactacgaactcttccgaccatgatagctctcgatctgcgagctgagg

SEQ ID NO: 56870 - protein, 67 aa, Zea mays
  misc_feature: Ceres CLONE 1501246
MKASEYTLDKVAVCEIDVHRGRTDLRSTATQMQSLIGSIYNARSPAASLMDRLRTLPTMIALDLRAE

SEQ ID NO: 56871 - DNA, 658 bp, Zea mays
  misc_feature: Ceres CLONE 1501256
  misc_feature: Encodes the peptide sequence at SEQ ID NO. 56872
  misc_feature (658)..(658): n is a, c, t, g, unknown, or other
cgattgggaccgggccccccctcgagccactgcagtggtaaaggaagcctgtggacgcgagtgagtgaacaccagccgtattgtcccgactcctgacccctaccgatcctcgcctgctgcagccatggcgacctccgcggcgctctccaccgccgccaatcccacccagctctaccggtcccgcgcttcgctgggcaagccggtgaaggggcttggcctgagcatgggccgcgagcgcgcccagcggagcattgtgtgccaggcggcgagcagcatctccgccgaccgcgtccccgacatggagaagcggaagctgatgaacctcctcctcctcggcgccatctcgttgcccaccgtcggcatggtcgtcccctacggcgccttcttcgtccctgccggctccgggaacgccggcggcgggacctacgcgaaggacaagctgggcaacgacatcacggtggaagcgtgggctcacacgcacggtcccaacgaccgcacgctcgcgcatgggctcaagggtgaccccacgtaccctgtggtggagcagggacagacgctggccacctacgggatcaacgccgtgtgcactcaccctcgctgcgtcgtgccgtggaaacgccctgaagacaagttcatctgcccctgccacggatcccan

SEQ ID NO: 56872 - protein, 177 aa, Zea mays
  misc_feature: Ceres CLONE 1501256
  misc_feature (54)..(92): Pfam Name: CytB6-F_Fe-S Pfam Description: Cytochrome B6-F complex Fe-S subunit
  misc_feature: SWISSPROT Homolog: EC 1.10.99.1 Plastoquinol--plastocyanin reductase
MATSAALSTAANPTQLYRSRASLGKPVKGLGLSMGRERAQRSIVCQAASSISADRVPDMEKRKLMNLLLLGAISLPTVGMVVPYGAFFVPAGSGNAGGGTYAKDKLGNDITVEAWAHTHGPNDRTLAHGLKGDPTYPVVEQGQTLATYGINAVCTHPRCVVPWKRPEDKFICPCHGS

SEQ ID NO: 56873 - DNA, 841 bp, Zea mays
  misc_feature: Ceres CLONE 1501257-R
  misc_feature: Translation starting site: 261
  misc_feature: SWISSPROT Homolog: EC 2.4.1.215 Cis-zeatin O-beta-D-glucosyltransferase
  misc_feature: The sequence is a functional homolog of SEQ ID NO 8 in US patent 7148405
  misc_feature (619)..(619): n is a, c, t, g, unknown, or other
ctccccgcggtggcggccgctctagaactagtggatcccccgggctgcaggaattcccagagctctggttttttttttttttttttgaaactgaggctttaagtatagtataaatagggttttcatcccgagaactcaaaattgaaactagtaaaaatagtcaaatacgggacgcttttcatcttgctatgtaagcaacaaagtcgtcaaggtccttgcgcgaaaacccgccctcggccacagagggggaaaaaaaccccatgagctcctgggccctctcccgcaccgccaaaccttcatcgggggccatcaccttctcgatcacctcggggatggtttccgcaggggtcacagcactgggttgctcccatggccttacaaggagcccggccttgaggcacttgcacacaagctcccccaccagcggctggtcggagtgcatgggccaggcaagcatcggcttcccggggctcaggctctccagggtcgagttccagccccagggactcatgaaccctgccggggcgccgggggccaggatctccagctgcggcgcccacccggggatcaccaacccgatgccttgagtttcctcggggaactcggataggaacctggngtgcctactctccacggcttcctcctcgggtaccacaccgcgataagggtcgcgcaaaacccaaacaaaccgctttttgctgtcgcgcagcgccccggcgagttccgcgatttgctccgcccgcagaggacaaacttgggccaaaaaacacgtacagcaccgacccccgggggttgcttgttcaaacaatccaaaaaactcgtgccggggcacctctgtccc

SEQ ID NO: 56874 - DNA, 662 bp, Zea mays
  misc_feature: Ceres CLONE 1501257
cgattgggtaccgggcccccctcgagccctgcagtggtaaaggggaatcccttgccgatgccttggcggcggagccgctaccggcacatggtcacctccaggcatgctccacttgtctctgctactcacgtcccgagggctttccatgcactacgcggtgctcggctcgtacttccgccaggcgcgcgcgcgcatgacctgctggtgcaacaacgcccaccgctgcatctacttccacgactatcgaggtccccgcgcacgccaccccgccgccggactcgtgtctatccttcgacgttcacgtcccagataatatgcatgaacttacgcatctcctacatgcgcgcctgccaaaatggctagcctcttgaggagtttctcctggcgacagcggtcgatttcagtcctgtacaattccctcctctccatcttcgcccctgagtgggcgcgtatccccacgacagaatcgatcccactgctgagcaggtccgcgtgatccaactcagcgacgtcggactctccggaattcgctcctgttcatatactgcctcgatgtaccgcatacgttcgcctgcatgacatctgagctcccgcagtacattagttcgatgcagtagaacatgcgtagacaggccttcgctcaattattggccaacacgcgc

SEQ ID NO: 56875 - DNA, 779 bp, Zea mays
  misc_feature: Ceres CLONE 1501257-R2
  misc_feature: Translation starting site: 150
  misc_feature: SWISSPROT Homolog: EC 2.4.1.215 Cis-zeatin O-beta-D-glucosyltransferase
  misc_feature (503)..(503): n is a, c, t, g, unknown, or other
ggatatggttttcatcacgagaactcaaaattgaaactagtagaaatagtcaaatacaggacgcatttcatcttgctatgtaagcaacgaagtcgtcaaggtccttgcgcgaagacccgccctcggccacagagcggcgaataaactccatgagctccttggccctctcccgcaccgccaaaccttcatcgcgtgccatcaccttctcgatcacctcgcggatggtttccgcaggtgtcacagcactgtgttgctcccatggccttacgaggagcccggccttgaggcacttgcacacgagctccgccaccagcggctggtcggagtgcatgggccaggcgagcatcggcttcccgtggctcaggctctccatggtcgagttccagccgcagtgactcatgaacgctgccgtggcgccgtgggccaggatctccagctgcggcgcccacccggtgatcaccaacccgatgccttgagtttcctcggtgaactcggataggaancctggcgtgctactctccacggcttcctcctcgtgtaccacaccgcgatcagcgtcgcgcagaacccagacgaaccgctgttttgctgtcgcgcagcgccgcggcgaggtccgcgatctgctccgcccgcagcgacgacttcgtgccgaacgacacgtacagcaccgaacgcggcggttgcctggtcaagcaatccaagcactcgtggccggcactctgtcccgctgtcggcggcggtcacctttaacagcggattctctcggcccaactgcgaaa

SEQ ID NO: 56876 - DNA, 647 bp, Zea mays
  misc_feature: Ceres CLONE 1501260
  misc_feature: Encodes the peptide sequence at SEQ ID NO. 56877
cgattgggtaccgggccccccctcgagccactgcagtggtaaagagggaagtgtgaaggtaggagagagagagggggagccaagggaagctctcttctttcttcctcctcctcgtcctctcgaattccgtctcttgtctctgtccttctcgctcggcttccccggttcttgagaggggaaagaggaggcggaggagagggatggggagggacgagaggttcccagtgtgggaggccgcgctcggcgctggggtcgccgccgccttcgccgctgggctcgtcggggtttacctttccatgccggactccgactacagcttcctcaagctgccacgtaatctccaggaactccaaatcctcactggccatcttgagaactatactagcgactacaccctacaggtgttggtaggctactgcgccgtgtacatcttcatgcagaccttcatgatcccagggacaatattcatgtcactgcttgctggtgctctgtttgggcagctccggggcgttgccctggtagtcttcgccgccactgctggcgcttcttcgtgctatttcctgtcgaagatgattgggaagccactggtgttcacgctgtggccagataaactcagcttcttacagagacaggttgctaagagaaga

SEQ ID NO: 56877 - protein, 149 aa, Zea mays
  misc_feature: Ceres CLONE 1501260
MGRDERFPVWEAALGAGVAAAFAAGLVGVYLSMPDSDYSFLKLPRNLQELQILTGHLENYTSDYTLQVLVGYCAVYIFMQTFMIPGTIFMSLLAGALFGQLRGVALVVFAATAGASSCYFLSKMIGKPLVFTLWPDKLSFLQRQVAKRR

SEQ ID NO: 56878 - DNA, 837 bp, Zea mays
  misc_feature: Ceres CLONE 1501263-R
  misc_feature: Pfam Name: CIA30 Pfam Description: Complex I intermediate-associated protein 30 (CIA30)
cgcggtggcggccgctctagaactagtggatcccccgggctgcaggaattcccagagctctggttttttttttttttttttaaatgctccttttttctaccactttttcttaaacctcaaaagtaaaacaaaatccttttttaagtgcataaaggagttgggaatctgggctatggttacccctggggttggggccggctgataagttcagcggcccccctggagcagggtgataaaaaaggaaagggccgatgtgaaataaaactatgacttggggaggtcacagagctctcaacgctttgatccaagcaacatcaagcctaaaatcaccaggcccagtcttggcgccaggaacaccgccttctgcgtttacagaaagagacatccccacgatccgagcagggttcatttccaactttgccgggatcacatttcctctccatgggggtaaatagcgatcaagagggatctttaaaacttcccatctgtcttgaggaggtatgtacacaaaagcctgccacgagttgtcttcttgttgcccgggtgaattcacccaattctccgtgtatattgtaaatatgtagcatcttccaccccctttgatcttcattgctattgtatcataggcatcagggtcaatgaacccttcaaacttctttgatcgcatcccacaaaatccatagcgcctgatcctccatgttgactcttcagacatatccaaagaagagttaccaaaaaaccaccatgttaatggagtatctcccactgaaaccgccatccgttttttctaaggatgcaaaaaaacaacctccatactcctgaatctgatacaaatgc

SEQ ID NO: 56879 - DNA, 659 bp, Zea mays
  misc_feature: Ceres CLONE 1501266
  misc_feature (1)..(1): n is a, c, t, g, unknown, or other
  misc_feature (446)..(446): n is a, c, t, g, unknown, or other
ncgattgggtaccgggcccaccctcaagccctgacagtgctcaacgacaccccgacctcggctgtcgtgccctatgaggctgcccccttccaagcttaggctgatgctgatgctgacgctgctgcgcctgctgatgcctagggagtttccctcggccgagcatccggccccgccgcatcccgaggccactgctcctgcgtctagccaaggagcccactgccgtcaatcccgtcgctcacgctgacgctgctgctcctgctggacctgacgagactcctgcgttcaagcatcaggcaacccccgaggaagaggcgtgctgctgctcctcctgctcttgccgatcatccctcactgactcgatctgctcgctagttcgactctgctgatccctatcagctcaccccggacgagccagaggctcctgctcctgctcctgcagaacgcangaaacagccgtcgacaaaaaggctgctgctcctcaggagccctagaagggccgcgatgcaggccttgttcactaagctccggcggcctgaggaccatcaccagatcatcgctcaggtcacatgtcgcgaactctctcagactctaacatagccagtgactcgccatgtactgtccacgagctatctctagtgccgacctgccgctcacgggaa

SEQ ID NO: 56880 - DNA, 481 bp, Zea mays
  misc_feature: Ceres CLONE 1501270
  misc_feature: Pfam Name: Herpes_glycop_D Pfam Description: Herpesvirus glycoprotein D
  misc_feature (109)..(109): n is a, c, t, g, unknown, or other
aaagctggactccccgcggtggcggccgctctagaactagtggatcccccgggctgcaggaattcgcacgagaccattacctagaacatcctaatcgaaaactaataancatttcctactcctgccgcatcagactagcgagccaagccaccgacggccgacgtcgagcctccgcggccgagcctccgcctagcaccaactccgtcgtcgatcgtcctatgcgaccacgcccccgtccgccttccgtctcctgcctccactgagtcgcgggcgcgacatcggggaacgccaaggctgagcttcgcccagacgcctaccgccctgttatgcccaaacgccgtgctgaggtccgcccaggccggcaggagcttctccggcagaccacccccgcccacggagctcctgcctccgccagggccattgttcgagctacgcccacgctcctggccatgccctggcacttaaagggtccgcccaacct

SEQ ID NO: 56881 - DNA, 612 bp, Zea mays
  misc_feature: Ceres CLONE 1501278
  misc_feature: Encodes the peptide sequence at SEQ ID NO. 56882
tccccgcggtggcggccgctcttcactagtggatcccccgggctgcaggtattcgcacgagaccattacctagaacatcctaatcgaaaaaattccggcgccgccgcctgatcgctccagcgccctcgccgtcggcagctcggccgccgtactcccgctaccgagctaggagacatcaccttcgccggtccaacatgggtaagacacgtggtatgggagctgggcgcaagctcaagacccacagaaggaaccagaggtgggctgacaaagcctacaagaagagccatctcggcaacgagtggaagaaaccctttgctgggtcatctcacgcaaagggaatcgtccttgagaagatcggcattgaggctaagcagcctaactctgctatccgtaagtgcgctcgtgtccagctggtgaagaacgggaagaagattgctgcctttgtgccaaacgatggttgcttgaactacatcgaggagaacgatgaggtgctgattgctggattcggtcgtaagggccatgctgtgggagatattcccggcgtccgtttcaaggtcgtgaaggtctctggcgtttccctcctcgccctcttcaaggagaagaaagagaagc

SEQ ID NO: 56882 - protein, 139 aa, Zea mays
  misc_feature: Ceres CLONE 1501278
  misc_feature (8)..(139): Pfam Name: Ribosomal_S12 Pfam Description: Ribosomal protein S12
MGKTRGMGAGRKLKTHRRNQRWADKAYKKSHLGNEWKKPFAGSSHAKGIVLEKIGIEAKQPNSAIRKCARVQLVKNGKKIAAFVPNDGCLNYIEENDEVLIAGFGRKGHAVGDIPGVRFKVVKVSGVSLLALFKEKKEK

SEQ ID NO: 56883 - DNA, 684 bp, Zea mays
  misc_feature: Ceres CLONE 1501281
  misc_feature: Translation starting site: 345
  misc_feature (381)..(381): n is a, c, t, g, unknown, or other
  misc_feature (382)..(382): n is a, c, t, g, unknown, or other
  misc_feature (385)..(385): n is a, c, t, g, unknown, or other
  misc_feature (396)..(396): n is a, c, t, g, unknown, or other
  misc_feature (417)..(417): n is a, c, t, g, unknown, or other
caaagctggagctccccgcggtggcggccgctctagaactagtggatcccccgggctgcaggaattcgcacgagaccattacctagaacatcctaatctaaaaagataagcaactccagtccaagcaggagcaagaacaacaggaagagtcgaagagaggagagggacaagaacaaccagaaagaggagaggaggctcatcaatcgcgactaattctcgcagtcgcagagacaagcaatcatcagacatgagaacccaggcgctgttcttcctcgcactcgcacttctcggcgccgtgctcgcgcagtccagcaacaggcaccaccaccactaccaccacgcccatgtccaaggcaaagggcagggagcccggaggagganngangggagctggcnagccgggcgaaagcggcggcncgcgcgtggccgtgctgtgacagctgcggcgggttgcaccaaatcggaagccgccgcggtgccagtgccctggacgcggcgcccccgggggtgcccccccggccttggaaggattgcgttaaattccagcctctaacgccaacccccccggtgtaccaaggatttggacccggttccccaaatttttgccaaggccctctggacccccccccccccccccccccggggcccttaaccaacccgcgggggggaacccaaaccccccca

SEQ ID NO: 56884 - DNA, 644 bp, Zea mays
  misc_feature: Ceres CLONE 1501285
  misc_feature: Encodes the peptide sequence at SEQ ID NO. 56885
  misc_feature (549)..(549): n is a, c, t, g, unknown, or other
  misc_feature (552)..(552): n is a, c, t, g, unknown, or other
  misc_feature (555)..(555): n is a, c, t, g, unknown, or other
aaaagctggagctccccgcggtggcggccgctctagaactagtggatcccccgggctgcaggaattcgcacgagaccattacctagaacatcctaatcgaaaactaccacttagcactacactaccaccgtttcagtgctataggataggattttcttttgacggccatgaaaccccctcagctgtcggccggggagcgctcctgggctcacgaggtcaagcaggccctccgtgagaaactccggcgctcctacggcgccgcctccgccacaccggcggccggtgaaccgagccgtggcgccgactgccgcggctcggccgccgaggaccccataaggagagtcatgttcttggctccctggggccacacataaaacacagacccagatctgggcttgcaagagcatggccggatctgcagagaactgctcaagctcaaccatacttaaaaggaactggagcttgtcttgtaaactatggagcatgctgcttgcaccacgaacatgaacgcatggctggttaactaggagattggggtgtggatggggnganaanagagagaaaaaacagggtatgtagtccacgtctctgatcttggatggagaggcatgagatcttgggatgctcatgcatgggtcatgggt

SEQ ID NO: 56885 - protein, 68 aa, Zea mays
  misc_feature: Ceres CLONE 1501285
MKPPQLSAGERSWAHEVKQALREKLRRSYGAASATPAAGEPSRGADCRGSAAEDPIRRVMFLAPWGHT

SEQ ID NO: 56886 - DNA, 661 bp, Zea mays
  misc_feature: Ceres CLONE 1501296
  misc_feature: Encodes the peptide sequence at SEQ ID NO. 56887
  misc_feature (460)..(460): n is a, c, t, g, unknown, or other
  misc_feature (461)..(461): n is a, c, t, g, unknown, or other
aaaagctggagctccccgcggtggcggccgctctagaactagtggatcccccgggctgcaggaattcgcacgagaccattacctagaacatcctaatcgaaaaacaatgcttacaaaacccattcatcattttagctgttgatacaaagagaagggaatggccgagataaccctagagccgagtgatcttatggcgcaaacaaacaaaagaatagtgccaaagttcactgaaatcttccccgtggaggacgcgaactacccttacagcgccttcatcgcgtcggtccggaaagacgtgatcaaacactgcaccgaccataaagggatcttccagcccgtgctgccaccggagaagaaggtcccggagctatggttctacacagagctcaaaactaggaccagctccatcacgctcgccatacgcatggacaacctgtacctcgtgggcttcaggaccccnnggcgggtgtgggtgggagttcgggcaagaacggcgaacccacctcctcggcgacaaacccaggtggctcggctccggcggcagtacccggacctcatcggcaacaagggcctggaaaccgtccccatggcccgcgcgaaaggacaaggccgcaaaaacctggcaaaaaaaaaaagggcccacccctgggggagaggaggg

SEQ ID NO: 56887 - protein, 168 aa, Zea mays
  misc_feature: Ceres CLONE 1501296
  misc_feature (18)..(168): Pfam Name: RIP Pfam Description: Ribosome inactivating protein
  misc_feature: SWISSPROT Homolog: EC 3.2.2.22 rRNA N-glycosylase
  misc_feature (102)..(102): Xaa is any aa, unknown, or other
MAEITLEPSDLMAQTNKRIVPKFTEIFPVEDANYPYSAFIASVRKDVIKHCTDHKGIFQPVLPPEKKVPELWFYTELKTRTSSITLAIRMDNLYLVGFRTPXRVWVGVRARTANPPPRRQTQVARLRRQYPDLIGNKGLETVPMARAKGQGRKNLAKKKRAHPWGRGG

SEQ ID NO: 56888 - DNA, 600 bp, Zea mays
  misc_feature: Ceres CLONE 1501301
  misc_feature: Encodes the peptide sequence at SEQ ID NO. 56889
catagctggagctccccgcggtggcggccgctctagaactagtggatcccccgggctgcaggaattcgcacgagaccattacctagaacatcctaatcgaaaactcgttattccatcaccagttcaccaccgtcttcctcaactcttcctctcctctctcttctgcaccatctggtgtgtgtgcgcgttactcgccgcgtcgatcgaagaaagaggcgcacgggagcgagctacgcgaagcaaggcaatggcgaagggcgggctgtccaagcttcggtgcatgatcaagaggtggcactcgtccagccgcatcgcccgcgcgccgccgtctcccggccccggtgaagacgaacgctgcgccgcgcgcggcgcgtcgttccacggcgcggacgaggtgcctgagggcctgcacccggtgtacgtcggcaagtcgcgcccgcggtacctcgtcggcgaagagctggtgggccacccgctgttccagaccctcttcgaacgcatcgggcggcggcggcaccggggcaacggcgggcgggtaccgtcctcggctgcaaggtcttgctgttccaccacctgctttggatgctgaaaaaccggaac

SEQ ID NO: 56889 - protein, 113 aa, Zea mays
  misc_feature: Ceres CLONE 1501301
MAKGGLSKLRCMIKRWHSSSRIARAPPSPGPGEDERCAARGASFHGADEVPEGLHPVYVGKSRPRYLVGEELVGHPLFQTLFERIGRRRHRGNGGRVPSSAARSCCSTTCFGC

SEQ ID NO: 56890 - DNA, 620 bp, Zea mays
  misc_feature: Ceres CLONE 1501302
  misc_feature: Encodes the peptide sequence at SEQ ID NO. 56891
atagctggagctccccgcggtggcggccgctctagaactagtggatcccccgggctgcaggaattcgcacgagaccattacctagaacatcctaatcgaagacaaatgtacaaggtgtgtcagtctctcgactaccctgctggtgaagacgtatttgagaagctggaaaagaagtacaacaaagttgttcagtggtcaagatcagacaggaagcttctattcgacatggccaacacaatactatcacagatccttgccccatgcttgaacatgcaaccttgggtctataccactaggaacttggccccactttggggctcagatggtctcctggagaaagtcttgcagatgctagttcagagacgggaacaccttgcatccagtgagactaagccagagaagaaaggatttgatccgaagtggccaggtttagcagactgcatcgacagggtaggaagggacattgagaggatggtaaaagatgacctgttggaagagctggtcgttgagctactgttcagttaggtttccacaattccacggccgtagtaggttttatcatggcagtacagattctttgttcttttgtttagttttttagtcagttgtagttgttcctt

SEQ ID NO: 56891 - protein, 174 aa, Zea mays
  misc_feature: Ceres CLONE 1501302
IAGAPRGGGRSRTSGSPGLQEFARDHYLEHPNRRQMYKVCQSLDYPAGEDVFEKLEKKYNKVVQWSRSDRKLLFDMANTILSQILAPCLNMQPWVYTTRNLAPLWGSDGLLEKVLQMLVQRREHLASSETKPEKKGFDPKWPGLADCIDRVGRDIERMVKDDLLEELVVELLFS

SEQ ID NO: 56892 - DNA, 591 bp, Zea mays
  misc_feature: Ceres CLONE 1501303
  misc_feature: Encodes the peptide sequence at SEQ ID NO. 56893
aaacgtcactaaaggagcttccgggctgcaggctccaacaagagaccattacctagaacatcctaatcgaaaaacagcccaatactactagccacaagacagctgcagcagcagcagcaccgcgcggacccgacctgacctgactgacctcctcccacgcccggacggcggaaggccgcagcagccaagccatggcggtggacctgatgtcctgcggcggcggcggggcgtacgagcacctggcgttccaggaggcggccgcgacggggctgcgcagcctggagctgctggcttcctcgctctccccgtgcgccgcggggcgggcggagtcgccgccgctggggcagatcgccgaccaggccgtgtcccgcttccgccgcgtcatcaacctgctggaccgcacgggccacgcccgcttccgccgcgcgcccgccgccgcggcgaagcctatagggatgacggagacggaggcggcgccccctccctcgtcgggccgacaggcggtggcggtggagccggcgcagaagacggccctgacgctggacttcgccaagccggcgtcggccacggccccggccgtgtccgcgacgt

SEQ ID NO: 56893 - protein, 133 aa, Zea mays
  misc_feature: Ceres CLONE 1501303
MAVDLMSCGGGGAYEHLAFQEAAATGLRSLELLASSLSPCAAGRAESPPLGQIADQAVSRFRRVINLLDRTGHARFRRAPAAAAKPIGMTETEAAPPPSSGRQAVAVEPAQKTALTLDFAKPASATAPAVSAT

SEQ ID NO: 56894 - DNA, 640 bp, Zea mays
  misc_feature: Ceres CLONE 1501305
  misc_feature (9)..(9): n is a, c, t, g, unknown, or other
  misc_feature (11)..(11): n is a, c, t, g, unknown, or other
  misc_feature (25)..(25): n is a, c, t, g, unknown, or other
aaagtgggnanctacgaagtggggnccgctctagaactagtggatcccccgggctgcaggaattcgcacgagaccattaacctagaacatcctaatcgaaaaaagggaaacagtcacgtctcccagatctgactgccccccgactcacgaatcccaaagcctccgtggcgacgcaccgccactgcctcccactcctcctcctcgtggccgccgccctcgccgccgtccctgctcgcgcggcgctgggcggcgggcgcggcccgctgttgggcgggtggaacccgatccctgacatgagcgactcgcacatgctggagctaggcggggtgggctctgtgggcaggccgatcacctgaaaactgggacgccgacaggtgggcggagccgccgccgaggtagggccggcgaacgagcaggaggatgccgctaagaggggaccggacaactgtgtatgtgtcccgcccgggcctgactaagaataacatatcccctcgcaggagcggacaaagaaatagaaaaataaagaatcagaaaaaaatagtaacaatatatacattatagccaaaagggtcgaagaaacaataagaataccgataaggagtaaatgtgtgggaatatgctcataaaaggaaaatcatcg

SEQ ID NO: 56895 - DNA, 637 bp, Zea mays
  misc_feature: Ceres CLONE 1501306
  misc_feature: Encodes the peptide sequence at SEQ ID NO. 56896
aaagctggagctccccgcggtggcggccgctctagaactagtggatcccccgggctgcaggaattcgcacgagaccattacctagaacatcctaatcgaaaactcttcgtcgcgcctccgcctccgccgtcgtagcatcctcctccgccacctcggccatggcgacatccccagcgctcctcttcccttctccctcctcggcatcctctgcgccttcgtcggcgcgggtggaggcagtggtgcttttcaacgtctgcgacagctacgtgcggcgcccggaccaggcggaccgcgtcatcggcaccctcctcggttccctcctctccgacggcaccgtccacgtccgcaactcctatgtcgtcccccacagcgagtcagccgaccagggtcgcatcgacatcgactaccaccataacatgtacgcctcgcaccagaaggtgaaccccaagaagtcatcgtcggagggtcccccactggatttggggttcctgggggggataccccccccccccaattccttccagggaaagtacaaaaccccttccattttaaaggcaaactgggtttcccaaggggggaaggctcccctaaaaaccttaattcaaccaaaactgccccccaaaaaaaaacaaccccc

SEQ ID NO: 56896 - protein, 159 aa, Zea mays
  misc_feature: Ceres CLONE 1501306
  misc_feature (17)..(154): Pfam Name: Mov34 Pfam Description: Mov34/MPN/PAD-1 family
MATSPALLFPSPSSASSAPSSARVEAVVLFNVCDSYVRRPDQADRVIGTLLGSLLSDGTVHVRNSYVVPHSESADQGRIDIDYHHNMYASHQKVNPKKSSSEGPPLDLGFLGGIPPPPNSFQGKYKTPSILKANWVSQGGKAPLKTLIQPKLPPKKKQP

SEQ ID NO: 56897 - DNA, 663 bp, Zea mays
  misc_feature: Ceres CLONE 1501308
  misc_feature (565)..(565): n is a, c, t, g, unknown, or other
acaaactggagctccccgcggtggcggccgctctagaactagtggatcccccgggctgcaggaattcgcacgagaccattacctagaacatcctaatcgaaaactcttgttttgtactcaatcgtcgtcgtgtacgccaaagataggaagagcagagcgcaaggatgccggctagcctggtgacgtcgtcgctcctcccgccgtgccgcgcggccgcgacgtcggcgcgcgcgttgcgttcgttcgcccgccggccgccgccttcgtccgccggtctcgtccgcgtgcgctgccacgctgccactccgccgccgccggaggtcccgggccagacgacgccgcccgaggtgcctggcacggaccgccagccgctcgaggtgccggggacgaaccgcccgccggacgaagtgccgagcatcgacacgccgccagagttcaacgcgccgccgggcgtcgacgtgccgatgccggggcagccagcgcccggaccggagctcccgggtcccgcgatgccgtcgccgccggcccggaaggccctgtcgtggcgccaaccccgaattaccgncgccaaagtcccggaagggggacccgcccaacccccccgccgagaggcgcccccccgggaacccccgggaaccgaaaagggcccccctcccttttggt

SEQ ID NO: 56898 - DNA, 536 bp, Zea mays
  misc_feature: Ceres CLONE 1501309
  misc_feature (388)..(388): n is a, c, t, g, unknown, or other
  misc_feature (409)..(409): n is a, c, t, g, unknown, or other
aaagctggagctccccgcggtggcggccgctctagaactagtggatcccccgggctgcaggaattcgcacgagaccattacctagaacatcctaatcggaaaaacagaacacttcgcttcctggaaggctggaacagaaagaaccctaaaccctagcaatggcggcggcgaacctgctgtcgcgctcccttctccccaccccaaacactatccgaacgagccaccccaccccgcggagcccagccgtcgtctccttcccccgccgccgtgcccgcctgtcccgtgtgcgccctcccgtctcatgggctcccgtccccaccgccacagcccgcggcggcccgcgtgccgaacactgcttccgcgcggcgccgacgctacctgtactgcnaggaatgaaggtgaaaacccnatggcgctgccgagccaacccccttctattctacggaaagtttaaatcctcccaaatttcgccccttaccggaaccctttccaggggctcccctccccccccccggattcccgggaaaggcaaaaaa

SEQ ID NO: 56899 - DNA, 664 bp, Zea mays
  misc_feature: Ceres CLONE 1501314
  misc_feature: Encodes the peptide sequence at SEQ ID NO. 56900
gctggagctccccgcggtggcggccgctctagaactagtggatcccccgggctgcaggaattcgcacgagaccattacctagaacatcctaatcgaaaaaggcatgagcacccctctcctccgccgtcccatggccgcgccctgttcctgggacacttccttccacgaaaaaaagcagcagcagcagcataagctctagctacctctactaccgacctggatccactcaacccgctacgctaagctcccctttcccgttcgacaagagaagagaagaggttattcatccatctgcgctgcagcctgcaaagaaggagaaggaggagacaggcgcttgacatgggcaagtacgtggagctgctggacatgggcgtgcgcatcgccgcgcgcttccactcccactgcccgcagaccgcgcgcctctactaccacccgcccgccggcgggccggcggccgcgggggacggccgcaagggggactccgccaccgccgccgccgccgccgccgtgatgctgaagcagcaggcgcacaggttcgacgcctccgagatcatccctcacaccgtcttctagcccggttggggggggggggaatactcaaggaacccgccggggggcggcggccaattatcgatatttatccccgtccttggcgggggaagcc

SEQ ID NO: 56900 - protein, 77 aa, Zea mays
  misc_feature: Ceres CLONE 1501314
MGKYVELLDMGVRIAARFHSHCPQTARLYYHPPAGGPAAAGDGRKGDSATAAAAAAVMLKQQAHRFDASEIIPHTVF

SEQ ID NO: 56901 - DNA, 702 bp, Zea mays
  misc_feature: Ceres CLONE 1501315
  misc_feature: Encodes the peptide sequence at SEQ ID NO. 56902
  misc_feature (360)..(360): n is a, c, t, g, unknown, or other
aagctggagctccccgcggtggcggccgctctagaactagtggatcccccgggctgcaggaattcgcacgagaccattacctagaacatcctaatcgaaaaacagaatgacaggaagcagcaaacctttcggtttctcgagcgcaatgcctctcgctgcagtgctccttcccctcctcgtcctcggcgcgtcgtcggtgtgtcaaggtcaaggcgctgcgagccacaacatcacggccatcctggcggcgtacccggagttcaccgacttcagcgctgccctggtcagcaccggcgcccgcggcgagatcgacccgcgcagcaccgtcaccgtcctcgccgtcgacaacgccgtcatggncgcgctaaagcgcaaaagctgcagctcgacgacttgcagcgctggatttactcccagtcctcttgaaatatttcaaccccccaagttaggaagatcccagggggtttcccccaggccctttagcttaacaagcctccgggaaaggccgggaaaccaccgaatttcaaattccccgggttccccaaaggccgggggggggttttaccccttggggcccccaaaaagggttgcaaaccgcttttttaccagtttctttaggagaaacccttttatttcccccccctcctaaggagagaaaaatattttttctccccgccccgggaagggggggtggccgccccc

SEQ ID NO: 56902 - protein, 167 aa, Zea mays
  misc_feature: Ceres CLONE 1501315
  misc_feature (72)..(72): Xaa is any aa, unknown, or other
MPLAAVLLPLLVLGASSVCQGQGAASHNITAILAAYPEFTDFSAALVSTGARGEIDPRSTVTVLAVDNAVMXALKRKSCSSTTCSAGFTPSPLEIFQPPKLGRSQGVSPRPFSLTSLRERPGNHRISNSPGSPKAGGGFYPLGPPKRVANRFFTSFFRRNPFISPPS

SEQ ID NO: 56903 - DNA, 593 bp, Zea mays
  misc_feature: Ceres CLONE 1501319
  misc_feature: Encodes the peptide sequence at SEQ ID NO. 56904
  misc_feature (255)..(255): n is a, c, t, g, unknown, or other
  misc_feature (343)..(343): n is a, c, t, g, unknown, or other
  misc_feature (346)..(346): n is a, c, t, g, unknown, or other
  misc_feature (349)..(349): n is a, c, t, g, unknown, or other
  misc_feature (350)..(350): n is a, c, t, g, unknown, or other
  misc_feature (375)..(375): n is a, c, t, g, unknown, or other
  misc_feature (389)..(389): n is a, c, t, g, unknown, or other
  misc_feature (390)..(390): n is a, c, t, g, unknown, or other
  misc_feature (393)..(393): n is a, c, t, g, unknown, or other
  misc_feature (409)..(409): n is a, c, t, g, unknown, or other
  misc_feature (427)..(427): n is a, c, t, g, unknown, or other
  misc_feature (443)..(443): n is a, c, t, g, unknown, or other
  misc_feature (460)..(460): n is a, c, t, g, unknown, or other
  misc_feature (474)..(474): n is a, c, t, g, unknown, or other
  misc_feature (476)..(476): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (514)..(514): n is a, c, t, g, unknown, or other
  misc_feature (521)..(521): n is a, c, t, g, unknown, or other
  misc_feature (529)..(529): n is a, c, t, g, unknown, or other
  misc_feature (531)..(531): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (559)..(559): n is a, c, t, g, unknown, or other
  misc_feature (568)..(568): n is a, c, t, g, unknown, or other
  misc_feature (591)..(591): n is a, c, t, g, unknown, or other
  misc_feature (592)..(592): n is a, c, t, g, unknown, or other
aaagctggagctccccgcggtggcggccgctctagaactagtggatcccccgggctgcaggaattcgcacgagaccattacctagaacatcctaatcgaaaaccaaaatcgatgggcaaaagcggaaagaaaccgagggaatcgcaccggcagggccgcggccggcgggcgtcgcacttctgcgacgaggacgactacgacttaccttcgtcagcctacgatgcgacgccgcgccaataacgaaggaaatccctncttggaaaaaaaaaaaaaaggggggggaaaaaaaaccccccccgggggagaaaaaacaccccccccccgccccggggggggggggggnagnaannaaaaaaaaaacaaacaacacccccnacccaaaaaaaaannaanaaaaaaaagaggaggnaggggggagggggggggnaggagaggaaaaaaanagaaaaaaagaaaacanacaaaggaaaaaanancaaaaaaaagagnnnngcgggaaggagagcggcggggngaggggnagaggagngnggggaaagagagaggaggggaagnnngnagaaaaggnaaagagcacaaacaacacgaggnng

SEQ ID NO: 56904 - protein, 42 aa, Zea mays
  misc_feature: Ceres CLONE 1501319
MGKSGKKPRESHRQGRGRRASHFCDEDDYDLPSSAYDATPRQ

SEQ ID NO: 56905 - DNA, 623 bp, Zea mays
  misc_feature: Ceres CLONE 1501322
  misc_feature: Encodes the peptide sequence at SEQ ID NO. 56906
aaagctggagctccccgcggtggcggccgctctagaactagtggatcccccgggctgcaggaattcgcacgagaccattacctagaacatcctaatcgaaaaccgtttcttcgtttgattccctcccgccgccgccgctggagacgcccaaccacgacagcgccccagggttcgtcctcccgctggaatagtaagtgaccggagaaaagcagcacaagagagatgtggtatctatgcgtcttctaccacaggctcctggactaccggcgaccggaggtggagtccctcgccgagctctttgccggcccaggcgcccgtgaatccgtcgagtggcgcatgccggagaaccaccacgtagactcccccttccacctcgttcgcctccctggagacgagcgcctcgccgctcaggcttgttggtgaagggggtctacgagctctggggctatggcactacctacgaggagctggagaagtcggtcagggagtaccccgacgagaggaagcttccgttcctggtcccggaaagcagcttcaagatcgttatcgacagcttcggcaaggtgatcagctcccaagagcagaacgagatcatacagagcctcacttacataccattcaag

SEQ ID NO: 56906 - protein, 66 aa, Zea mays
  misc_feature: Ceres CLONE 1501322
MWYLCVFYHRLLDYRRPEVESLAELFAGPGARESVEWRMPENHHVDSPFHLVRLPGDERLAAQACW

SEQ ID NO: 56907 - DNA, 665 bp, Zea mays
  misc_feature: Ceres CLONE 1501325
  misc_feature: Encodes the peptide sequence at SEQ ID NO. 56908
  misc_feature (481)..(481): n is a, c, t, g, unknown, or other
tggagctccccgcggtggcggccgctctagaactagtggatcccccgggctgcaggaattcgcacgagaccattacctagaacatcctaatcgaaaaagaaccgatccttacagagagacacacccagcgcgcgagatatctacatcgatcatcatcaccagcgagcgagccggccgagcagcaccgatggcggcgtacatgcgcgtgacgcaccgcgacgaggaaggcaagaaggtgacggagaagatgccggtcccggagacgcggcgcccggacacggccaagcacttcgagcgcaagctggaggagcagggcctccaccgcttcgagcggcacccggcgaacgcgccccggggcgtgggcatcggcgccccgccgcccaagtccgggcgcggcggcaagtacacctgggagggccccggcagcgtcgtcgaggaccagctcgacccggcgccgcccgccatcgaccccaacaccccnaactactaaggagggaggggcggcggacgaggacgacgaggcggccagggaagtggtcgtcggggaagtggaggtcgctaaggtcgccgagagcagggacggcgtcgccagggtcgacgtcgcgcccgggcctgctccaggaccagaagcagtaaaaggactgtcttttctggatacgtctaga

SEQ ID NO: 56908 - protein, 100 aa, Zea mays
  misc_feature: Ceres CLONE 1501325
MAAYMRVTHRDEEGKKVTEKMPVPETRRPDTAKHFERKLEEQGLHRFERHPANAPRGVGIGAPPPKSGRGGKYTWEGPGSVVEDQLDPAPPAIDPNTPNY

SEQ ID NO: 56909 - DNA, 657 bp, Zea mays
  misc_feature: Ceres CLONE 1501329
  misc_feature: Encodes the peptide sequence at SEQ ID NO. 56910
aaagctggagctccccgcggtggcggccgctctagaactagtggatcccccgggctgcaggaattcgcacgagaccattacctagaacatcctaatcgaaaaaaaccattcccctccgccccacctcttgtccagtgccccaaatgctggcgaccacctgcagccggccgccgtgcccgtgcccgtgcgcgcggtcgcggcggctccccgcggcgaccttcggcggcaccagtagcgcgaagcgaagggcgccgaggagagcggcggcggcggtgcggtgcgggctgctgcccgtggacccgtgggcgccgacgatggactcccagagcgtggcgtcgcagctcttcgccgtctcgctcttcccctacctgggattcctctacttcatgaccaggtccaagaccgcgcccgggctcacgctcttcggtttctacttcctcctcgtcttcgtcggcgccaccacaaaagttcattatggtacctcactgtccaacgttgactggctgcacgggggcgctgaatcgctgctgactctcaccaacctgtttatcgttttggcgctgacgggagccctgatgaagctggaggaagagggcacagacgagattgtttctgaagcttctcaagacagtgcacaaaaaagttctgtctagatgg

SEQ ID NO: 56910 - protein, 169 aa, Zea mays
  misc_feature: Ceres CLONE 1501329
MLATTCSRPPCPCPCARSRRLPAATFGGTSSAKRRAPRRAAAAVRCGLLPVDPWAPTMDSQSVASQLFAVSLFPYLGFLYFMTRSKTAPGLTLFGFYFLLVFVGATTKVHYGTSLSNVDWLHGGAESLLTLTNLFIVLALTGALMKLEEEGTDEIVSEASQDSAQKSSV

SEQ ID NO: 56911 - DNA, 655 bp, Zea mays
  misc_feature: Ceres CLONE 1501336
  misc_feature: Encodes the peptide sequence at SEQ ID NO. 56912
  misc_feature (48)..(48): n is a, c, t, g, unknown, or other
  misc_feature (60)..(60): n is a, c, t, g, unknown, or other
  misc_feature (655)..(655): n is a, c, t, g, unknown, or other
ctttgctggagctcaccgcggtggcggccgctctagaactagtggatnccccgcgctgcnaggattcgcacgagaccattacctagaacatcctaatcgaaaaaccgaaatgccactcttcttctccaaattcgcaccattggtcccccgcgtccgccgcctttccatcgccgcggcgacagccgccggcgaggaccctaagctgtctcgaatcgcggatgagctcctcgccctatcccccgccgagctggacgactacgcggcgctcctgcgcctcaagctccgcctgtcgctcacctccagggcagctgctggagcctctccggccggggccggggacgccgcggctgcagccgtgtatgccccccccccggtgagggggggggggcggcttaaaatccagaagcacgagccccccgggtggattatgatcactcagggggtgcgcgcgatcacggacctgggtctaaaggaggcaaaccacctcctggcaagaggcccccccaggggggcccgccggggttgccccaaggtggaggcccccacccctctgcccgctcagttccaagggcgcgcgtgcccaccccgtggcactccccagccgcccacctaggggcccaccccccccatcttgggtgtcccctccaggcgacan

SEQ ID NO: 56912 - protein, 167 aa, Zea mays
  misc_feature: Ceres CLONE 1501336
MPLFFSKFAPLVPRVRRLSIAAATAAGEDPKLSRIADELLALSPAELDDYAALLRLKLRLSLTSRAAAGASPAGAGDAAAAAVYAPPPVRGGGRLKIQKHEPPGWIMITQGVRAITDLGLKEANHLLARGPPRGARRGCPKVEAPTPLPAQFQGRACPPRGTPQPPT

SEQ ID NO: 56913 - DNA, 668 bp, Zea mays
  misc_feature: Ceres CLONE 1501338
aagctggagctccccgcggtggcggccgctctagaactagtggatcccccgggctgcaggaattcgcacgagaccattacctagaacatcctaatcgaaaaacgttttagttgcttcacttggtgtcttagcggttcgtgtttgtaagtctaggctcctcttcccagccaccaactcgatctgccctagtcttcccatctcctacttaagtcatggtccagtaggccgtgcagtcctagagctcgagtgatctccttggctcttgtagcctatgtttccccggagttaatcccctcccaatatcttggtccatctgcccagagcttggtgtaccagtccctaggtggtgaccatcgtcggcaatcagtccacctcgccgtgaccagaattcccagaagaagaagatgaaattcaagaagtggtttctgaagaggagtctgcttcagtgcctgctcatcaagtgatgggagccatctaactggggtttaatagagggatttagacctctgtctctgcaactaaggagaagttttattcccttatctttgggttagttacttcatgtggaggacttgaagcttagaatgtttttatatatctcttatggaaaggctttcaccttccaattattgtaataagttacttcgagtactatcaggactttgtat

SEQ ID NO: 56914 - DNA, 636 bp, Zea mays
  misc_feature: Ceres CLONE 1501340
  misc_feature: Encodes the peptide sequence at SEQ ID NO. 56915
  misc_feature (494)..(494): n is a, c, t, g, unknown, or other
  misc_feature (518)..(518): n is a, c, t, g, unknown, or other
  misc_feature (523)..(523): n is a, c, t, g, unknown, or other
  misc_feature (530)..(530): n is a, c, t, g, unknown, or other
  misc_feature (533)..(533): n is a, c, t, g, unknown, or other
  misc_feature (551)..(551): n is a, c, t, g, unknown, or other
  misc_feature (628)..(628): n is a, c, t, g, unknown, or other
tggagctccccgcggtggcggccgctctagaactagtggatcccccgggctgcaggaattcgcacgagaccattacctagaacatcctaatcgaaaacactcgagccagccagccagccagcaagccgcttgggcgccatctctctagagcttcgtaccctcgaagagagatccggcgcggcccaataaacacccggcttactacagactcgcagatggccggcctcaggatgaagttcgtcgccgtcgccgccatggccgccgcgctcgtggcgtccgccgcagccgccgaggcccccgccccggctcccgcgtccgacgccgcggccgccgtacccctcgccgcggcctccctcgccgccgctgccttcggctacctcttctgctagatccgcgctggatacgtggttcctgctccaaaatatgattcgtctggtctggcgcgcgtgagtccagctcgtgtgtcgtgcgtgtctctgtgtgaggtgtccgcnggcgtgtgtgtatgtatggagtcngccgncggcgcngcngaagaggaagtgtgcccntggttgggtgtaacctgcttcgacgcgccactgtttgtcccggcgaacatgtactaccctgcctgcgttttcttggntatcaatg

SEQ ID NO: 56915 - protein, 57 aa, Zea mays; identical to SEQ ID NO: 43282
  misc_feature: Ceres CLONE 1501340

SEQ ID NO: 56916 - DNA, 625 bp, Zea mays
  misc_feature: Ceres CLONE 1501346
  misc_feature: Encodes the peptide sequence at SEQ ID NO. 56917
aaagctggagctccccgcggtggcggccgctctagaactagtggatcccccgggctgcaggaattcgcacgagaccattacctagaacatcctaatcgaaaaattccaagacataccgttcccccctttcgttggtatagatcccagcggcccccgtcctgccgtcccccgcctttgcctccctctatctaaagtcgccgacgacgacccagtgaaaagtccacagccttttccaagaggaagggatgggctgctgcagcagccggagctccgattcgccggccagccgcgtgacgcggtggcgctccacagggatcgtggcgctccgagacgccagattgaaggaagtgccaaatgaagttctacaagtgggcaattccttgagaactctggatttgaccaataacaagctagttgagattccccaggaaattggtacacttgcgaacatgcaaaggcttgttttggctggtaatttgattgaaatcatcccagctaacattggatacctgcagaatcttaaaatcctcacacttgaccgaaataggatatctatcttgcctgaagaattgggttcactgtcaaaccttcagcaactttctgttcctcaaaattttttactgtg

SEQ ID NO: 56917 - protein, 126 aa, Zea mays
  misc_feature: Ceres CLONE 1501346
  misc_feature: SWISSPROT Homolog: EC 4.6.1.1 Adenylate cyclase
MGCCSSRSSDSPASRVTRWRSTGIVALRDARLKEVPNEVLQVGNSLRTLDLTNNKLVEIPQEIGTLANMQRLVLAGNLIEIIPANIGYLQNLKILTLDRNRISILPEELGSLSNLQQLSVPQNFLL

SEQ ID NO: 56918 - DNA, 679 bp, Zea mays
  misc_feature: Ceres CLONE 1501348
  misc_feature: Translation starting site: 178
  misc_feature (435)..(435): n is a, c, t, g, unknown, or other
aaagctggagctccccgcggtggcggccgctctagaactagtggatcccccgggctgcaggaattcgcacgagaccattacctagaacatcctaatcgaaaaataaaggactatctcagcgatttccgaaccctccccacccccacacccacccgatccaaccgagtcccggcggcgatggcggcggcggcgacgaacgccgatgtggaggtggtcgacttcgacctcgatgacgacgacctcatggacgaggacgccgggccggatccagcaccgccccccgcctcccgcctccgctccaccatcgcgggcgacgacgcgccgcgtaggaccaagggccgcggcttccgcgaggaccctaactcctccgcgacccgcgactcgcgctttggcgcggggggacgcgccgacctcgactcgcttggcggccctggnaccatcagtcaattgaaggatggggatgtgtggtcacagagttcacgaagaagcttcagagatgaccttcaaaatgctttccagaattttggcaggtcaaaaacctgcatttgattttggaccggcgtaccggaatggccaagggttacccttttattgaatacgaaaagtttgaaaaactccggctgcattaaaaaactggatggggttaaacttttaaccaaaaaggggggtgttgggcttt

SEQ ID NO: 56919 - DNA, 683 bp, Zea mays
  misc_feature: Ceres CLONE 1501350
  misc_feature: Encodes the peptide sequence at SEQ ID NO. 56920
acagctggagctccccgcggtggcggccgctctagaactagtggatcccccgggctgcaggaattcgcacgagaccattacctagaacatcctaatcgaaaactcttctgcccccatttcgttcctttcacaccggagaccggagagcagagccgcgcacagcagaacgcggaagcaagaggaggcgatcgactactcgaccagccctctccgctcttgtctccgatggcggctcgcgtcctcgcggccctcgccctcgccctcgccctcgtcgccctacccgcgcccacgcgggcgtccaacgacgagggggacgcgctctacgcgctgcggcagcggctgtcggaccccaacggcgtgctgcacacctcggatccgaggggcgggaccccctgcacttggttccacatctcctgcgaccaggtcggccgcgtcgtccgcctggacttgggcaactccaacgtctccggctccatccgcccctgagctcggccgccttgtcaacctcaaatacctggagctggacaggaacaaccttgacggcgaaatcccccagggaattgggcaacctcaaaaaccggatcggccttggatcggtatgccaaccagcttaccgggaaggaatccccccggttccttccccaagctccgcccttacttcgaatccatggcccccggaaccg

SEQ ID NO: 56920 - protein, 86 aa, Zea mays
  misc_feature: Ceres CLONE 1501350
  misc_feature (25)..(65): Pfam Name: LRRNT_2 Pfam Description: Leucine rich repeat N-terminal domain
  misc_feature: SWISSPROT Homolog: EC 2.7.11.1 Non-specific serine/threonine protein kinase
MAARVLAALALALALVALPAPTRASNDEGDALYALRQRLSDPNGVLHTSDPRGGTPCTWFHISCDQVGRVVRLDLGNSNVSGSIRP

SEQ ID NO: 56921 - DNA, 636 bp, Zea mays
  misc_feature: Ceres CLONE 1501354
  misc_feature: Encodes the peptide sequence at SEQ ID NO. 56922
  misc_feature (420)..(420): n is a, c, t, g, unknown, or other
gatagctggagctccccgcggtggcggccgctctagaactagtggatcccccgggctgcaggaattcgcacgagaccattatctagaacatcctaatcgaaaacatgtcgtcgcgccccaacttcggcctcaacgagctcgacttcgtcttctccaccctcgtcgtcggatccatcctcaacttcgtgctcatgtacatgctcgcccccaccgccggggtctccgccgcagcggccgccgccgtctcctccctccccagccacatgttcgagccgggtccttactcgctgggctcccgcgtcgcgaccctcgtgtccaagggcaccacgttcgcggtggtggggttcggcgccgggctcatgggcaccgccatctcaaacgggctcatcgccttgaggaagcgcatggacccggccttcnagacccccaaacaaggcgccgcccacgctgctcaacgcccggcacctgggctctccacatggggcatcagcagcaacctgggggaccagaccctaaatggggtggagttccttcttgggaatggcatgcccaccccgggtctttagggggcctggattgtcctcacatgccagaaaaaagggggtgggggaaaagccccccggggggccccaaagg

SEQ ID NO: 56922 - protein, 153 aa, Zea mays
  misc_feature: Ceres CLONE 1501354
  misc_feature (106)..(106): Xaa is any aa, unknown, or other
MSSRPNFGLNELDFVFSTLVVGSILNFVLMYMLAPTAGVSAAAAAAVSSLPSHMFEPGPYSLGSRVATLVSKGTTFAVVGFGAGLMGTAISNGLIALRKRMDPAFXTPKQGAAHAAQRPAPGLSTWGISSNLGDQTLNGVEFLLGNGMPTPGL

SEQ ID NO: 56923 - DNA, 695 bp, Zea mays
  misc_feature: Ceres CLONE 1501361
  misc_feature: Encodes the peptide sequence at SEQ ID NO. 56924
  misc_feature (658)..(658): n is a, c, t, g, unknown, or other
  misc_feature (695)..(695): n is a, c, t, g, unknown, or other
aaagctggagctccccgcggtggcggccgctctagaactagtggatcccccgggctgcaggaattcgcacgagaccattacctagaacatcctaatcgaaaaactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtccacggcggaccggcgggccgcctgcaactgcctcaagagcatgacgggccggctcggcggcggcgtcagcatggccaacgccgccaacatcccctccaagtgcggggtctccgtcggcgtgcccatcaacccccccgtcgactgccccaagatcaactgatcgatggaaccttagtggaggaagctcccctcgttggatgggaaccgaacgtgggccttcaaccagcatggcagtccgtcgcccttacccaaaaatagtcccagccacccgggtggtgtcatggccccncgaactgggcccctcaataaaacaagtaaaatcctgn

SEQ ID NO: 56924 - protein, 129 aa, Zea mays
  misc_feature: Ceres CLONE 1501361
  misc_feature (39)..(125): Pfam Name: Tryp_alpha_amyl Pfam Description: Protease inhibitor/seed storage/LTP family
MAARSSSSQPQLVAAAAVLAAALLLLAAGAGTASAAVSCGEVTSSVAPCLGYAMGSAASPSAACCSGVRSLNSRASSTADRRAACNCLKSMTGRLGGGVSMANAANIPSKCGVSVGVPINPPVDCPKIN

SEQ ID NO: 56925 - DNA, 636 bp, Zea mays
  misc_feature: Ceres CLONE 1501369
  misc_feature: Encodes the peptide sequence at SEQ ID NO. 56926
gatagctggagctccccgcggtggcggccgctctagaactagtggatcccccgggctgcaggaattcgcacgagaccattacctagaacatcctagtcgaaaaaaccgtccacggtccgccctcctccttcgttcacgtcttcctcctcgcgttcctctcgtcagtacggcgacgccgcaaggctcgcaccgctgacagtcccccttcccggatcgagcctctcttttcccagatcggattctaattgggctatcgccgccgccgtgccaggtgccgagtccttagccgatcttcgccggcgaggagcgcccaccagaggcaggtgcttcctcgtctgctcatgctgaagatgagaaaaaggctgatagaggactctctcttatgggttctgccataaggccaggcatcgcaccaaatgtcaaatttggagggtctggatcatatccggatcttccctgggtttctaccatcggcgccggaccaaatggcagaaccatatcaagtgtgacatacaagtttggtagaaatgaggtaaagatagtatgtgcttgccatggcactcacatgtctccggaggagttcatgcggcatgcaagtgcagatgctccggcccaagataatagtgcaaccctgcc

SEQ ID NO: 56926 - protein, 84 aa, Zea mays
  misc_feature: Ceres CLONE 1501369
MGSAIRPGIAPNVKFGGSGSYPDLPWVSTIGAGPNGRTISSVTYKFGRNEVKIVCACHGTHMSPEEFMRHASADAPAQDNSATL

SEQ ID NO: 56927 - DNA, 663 bp, Zea mays
  misc_feature: Ceres CLONE 1501374
  misc_feature: Encodes the peptide sequence at SEQ ID NO. 56928
ggagctccccgcggtggcggccgctctagaactagtggatcccccgggctgcaggaattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgagaacggcgggtgcaagtgcggcggcaactgccagtgcgacccctgcaactgcggcaagtgagctaggtgctccaccctgcaggccggccggaggaagctagctaattataaagcttaataaagtatagcggcgtcgctgtgtgtgtttcgagtcagtcagtcagttgcgtgccatggcatgctctgagtctgagatgatgatgatggctgatggcggcgtcgtgtcctcccctggcctcctggggcgcttctggcgagcagtgtgttgtgtttgtgtgggtgccgcacgctagcaggctagccatgtgccct

SEQ ID NO: 56928 - protein, 82 aa, Zea mays; identical to SEQ ID NO: 43085
  misc_feature: Ceres CLONE 1501374
  misc_feature (1)..(80): Pfam Name: Metallothio_2 Pfam Description: Metallothionein

SEQ ID NO: 56929 - DNA, 672 bp, Zea mays
  misc_feature: Ceres CLONE 1501383
  misc_feature: Encodes the peptide sequence at SEQ ID NO. 56930
tggagctccccgcggtggcggccgctctagaactagtggatcccccgggctgcaggaattcgcacgagaccattacctagaacatcctaatcgaaaagtgagccgcggcatcagagggaggatttcagccattcaggagggccaccgtacgcagcgagaccagccagcagacggcgatgttcgcgacggcggtgcggtgggcggcgaagaaggggaagcccaagatggcgccgatcgagctgacggcgccgccggagcaggcgcagtccatcacgcgcgccatcttcgacgccgtccgggagcacggcccgctcaccgtctccgacgtctgggaccacgtcaaggatgtcgggcttcgaggtctggcaagcaagaggcagatgaagatcatgctgcggtggatgagggagcgccagaagctaaagctcatctgcgaccacgacggcccgcacaagcagttcctctacaccacctggtttaccaaccccaggaacgcgccgcagaggcccaatccgaagcccaatgtcaaagcggataagctccccaccttcccttccccttcgaagcaactgtgacgaggacttgtttctgtgctctctgcacttgtttctgctgccccccgacatatgttcagcatggaaacaaatgctagatttgttcaggcgaatttag

SEQ ID NO: 56930 - protein, 132 aa, Zea mays
  misc_feature: Ceres CLONE 1501383
MFATAVRWAAKKGKPKMAPIELTAPPEQAQSITRAIFDAVREHGPLTVSDVWDHVKDVGLRGLASKRQMKIMLRWMRERQKLKLICDHDGPHKQFLYTTWFTNPRNAPQRPNPKPNVKADKLPTFPSPSKQL

SEQ ID NO: 56931 - DNA, 650 bp, Zea mays
  misc_feature: Ceres CLONE 1501396
  misc_feature: Encodes the peptide sequence at SEQ ID NO. 56932
aaagctggagctccccgcggtggcggccgctctagaactagtggatcccccgggctgcaggaattcgcacgagaccattacctagaacatcctaatcaaaaagtaccccgccggcccgcgtccccgctccagctcgaaaccctagacctgtgcggctgtccctattctctccaacggaaagatgtactccgaccagatctccaccgggcgcaagagctccatccacgaccgccttgactgcgacctccccgccggcacgggcgccggctgccgtgttcctcacacggtgtccaagatgcaacagcagataccatgaaaaatggaagcgtgatctgtatcacgaagaccatgaaccaacttctaatcctaaagacttgcgattgaagcttcagacgcgaagttcacaacaaagtttgtaccagcacaacgatgttctggtgtgcctgatttacgtgagaagatatctggcataatgctcccacaaccatcaaatgctgatccataccccttgcccaagccaatatcatacgctgctaacatctcagggcatctcactgctgatgaaatgcccgcacctctaaacaagagagcaccaaaacgcactctcgtgagaacgacctctcagacgaaggctgaaactccactcagca

SEQ ID NO: 56932 - protein, 44 aa, Zea mays
  misc_feature: Ceres CLONE 1501396
MYSDQISTGRKSSIHDRLDCDLPAGTGAGCRVPHTVSKMQQQIP

SEQ ID NO: 56933 - DNA, 658 bp, Zea mays
  misc_feature: Ceres CLONE 1501402
  misc_feature: Encodes the peptide sequence at SEQ ID NO. 56934
  misc_feature (370)..(370): n is a, c, t, g, unknown, or other
aaagctggagctccccgcggtggcggccgctctagaactagtggatcccccgggctgcaggaattcgcacgagaccattacctagaacatcctaatcgaaaaatcaatcatcaccgcaagcgtgcgcgcaacccagctcccaccgacgactgcaccggccgtcgctgccgcgctacttcggccccttttccggcgacgagcaccaccaggtagctgctaatggagattgacagcctcagagaaggatttgatcgagttgctgagaaacgttcattatcttctgctaaagctctggaagttgttgatcaaatagtgaatgaaattgagcaggctattgtgaagctgcagatgatgaatacagattctactnggaatgttgaccacccatccatccttgcagaactgaaagctaagctcaatgaaatggcaccactaaaccagcttgaaggcagccaaaaagagctccatgttgctctgagcaaatatctcaaacttcctggagaagtccttcaatccagattttcctaaagcatacaaaaatggggaatttgaggcccttcggttaacaatttccttacgaaatactttttaccgcccaaggcctcttttaactttgggaacatgtttgcccctgagtggggggaaacaggcgggacct

SEQ ID NO: 56934 - protein, 102 aa, Zea mays
  misc_feature: Ceres CLONE 1501402
  misc_feature (51)..(51): Xaa is any aa, unknown, or other
MEIDSLREGFDRVAEKRSLSSAKALEVVDQIVNEIEQAIVKLQMMNTDSTXNVDHPSILAELKAKLNEMAPLNQLEGSQKELHVALSKYLKLPGEVLQSRFS

SEQ ID NO: 56935 - DNA, 646 bp, Zea mays
  misc_feature: Ceres CLONE 1501406
  misc_feature: Encodes the peptide sequence at SEQ ID NO. 56936
  misc_feature (377)..(377): n is a, c, t, g, unknown, or other
  misc_feature (378)..(378): n is a, c, t, g, unknown, or other
  misc_feature (393)..(393): n is a, c, t, g, unknown, or other
  misc_feature (395)..(395): n is a, c, t, g, unknown, or other
ccggtggcggccgctctagaactagtggatcccccgggctgcaggaattcgcacgagaccattacctagaacatcctaatcgaaaagctcgacaatgaggccatctatgacatctgccgccgctcccttgacattgagcgcccaacctacaccaacctcaacaggcttgtctcccaggtcatctcatccctgacggcttccctgaggttcgatggtgctctgaacgttgatgtgaacgagttccagaccaacctggtgccctacccgaggatccacttcatgctttcgtcctacgctccattcttttctgctgagaaggcctaccacgagcagctgtttttttttcccccccacccacagggggagagggggggttnntccttgatggccaantncgacccccccccatgagaaaaaaaatggcatgctgcccgcaggaccgggggcgaaattgggtcccaagggaccaaacacctgctgtgcgccccaatcaaaacggaggcccaccatacactttcacgggacgggggcccccaccgggctctatatgcggagaaaacaacgaacagcccgccccaggttgtgtaccgccgtggacggataccaaccgcatggtgccgcacatcccatgggggggataccccag

SEQ ID NO: 56936 - protein, 43 aa, Zea mays
  misc_feature: Ceres CLONE 1501406
  misc_feature (33)..(33): Xaa is any aa, unknown, or other
  misc_feature (38)..(38): Xaa is any aa, unknown, or other
  misc_feature (39)..(39): Xaa is any aa, unknown, or other
MLSSYAPFFSAEKAYHEQLFFFPPHPQGERGGXSLMAXXDPPP

SEQ ID NO: 56937 - DNA, 629 bp, Zea mays
  misc_feature: Ceres CLONE 1501409
  misc_feature: Encodes the peptide sequence at SEQ ID NO. 56938
aagctggagctccccgcggtggcggccgctctagaactagtggatcccccgggctgcaggaattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgagaacggcgggtgcaagtgcggcggcaactgccagtgcgacccctgcaactgcggcaagtgagctaggtgctccaccctgcaggccggccggaggaagctagctaattataaagcttaataaagtatagcggcgtcgctgtgtgtgtttcgagtcagtcagtcagttgcgtgccatggcatgctctgagtctgagatgatgatgatggctgatggcggcgcccttgtcctcccctggcctcctggggcgcttctggcgagcagtgtgttgtgtt

SEQ ID NO: 56938 - protein, 82 aa, Zea mays; identical to SEQ ID NO: 43085
  misc_feature: Ceres CLONE 1501409
  misc_feature (1)..(80): Pfam Name: Metallothio_2 Pfam Description: Metallothionein

SEQ ID NO: 56939 - DNA, 683 bp, Zea mays
  misc_feature: Ceres CLONE 1501411
  misc_feature: Encodes the peptide sequence at SEQ ID NO. 56940
  misc_feature (306)..(306): n is a, c, t, g, unknown, or other
  misc_feature (309)..(309): n is a, c, t, g, unknown, or other
  misc_feature (355)..(355): n is a, c, t, g, unknown, or other
  misc_feature (408)..(408): n is a, c, t, g, unknown, or other
  misc_feature (486)..(486): n is a, c, t, g, unknown, or other
  misc_feature (683)..(683): n is a, c, t, g, unknown, or other
aaagctggagctcaccgcggtggcggccgctctagactagtggatctcttgggctgcaggaattcgcacgagaccattacctagaacatcctaatcgaaaaactctccagtctccacgttgcccttctcttccccactcgcctccgctcaccttgcctcgatcgttccaggagtaataaaacactaaaatggcgatggcggcggcgaggagagcgctcctggcccacctccgcgtgccggtggtccaccctgcagcggcggcagcgaccatccccgcggtaggtcggctactagaagaagacgacnganacaaagggggtctttccctcgacaaggggcaaggtcgctgacccgngttttttttttccccccccccctgggggggggggggggggggtttaaatctcnaccccctactttttccactcctcaccgaagaaccacaggaacatagagaggctggggaacgcggggggagaacgcccnaccggcgtcctccaaggaaaaaaattttcgttccgaaggatgccccaacaggcggtacaaaaagaaagagggccccccccccaaaaacggggtgggggtgtggaatagggggtgccccccccagaggggggaagaagagggagcgcacctttttgtgccatagggtaccaaccgggggggcacgaaccggtcggcan

SEQ ID NO: 56940 - protein, 53 aa, Zea mays
  misc_feature: Ceres CLONE 1501411
  misc_feature (40)..(40): Xaa is any aa, unknown, or other
  misc_feature (41)..(41): Xaa is any aa, unknown, or other
MAMAAARRALLAHLRVPVVHPAAAAATIPAVGRLLEEDDXXKGGLSLDKGQGR

SEQ ID NO: 56941 - DNA, 648 bp, Zea mays
  misc_feature: Ceres CLONE 1501415
  misc_feature: Encodes the peptide sequence at SEQ ID NO. 56942
aaagctggagctccccgcggtggcggccgctctagaactagtggatcccccgggctgcaggaattcgcacgagaccattacctagaacatcctaatcgaaaaaatcgaaaaatgttactcagatcgagcctcatgattacatatcaaagctcttcaatctattcacccagttcaacaatgtgttgactgattttgatagagacatgtggtcctatatatcattaggctacttcaagcagataccaaaagctggtgaagttggttcttccaccatgcctcataaaatcaaccccattgattttgaaaatagtgatggtaatttatgtctggcgaattctgtattatctggtataagcatgaaactgccaatatcccggatgcagcgtgacctgacagactcaactgttttgagaaacttgggtatgggattgggtcattctctattggcttacaaggccaccatacgtggaatcagcaaggttcaggtgaatgaagcgcgtttagctgaagacttggagcaaacttgggaggtccttgctgagccaatacagacagtgatgcgaagatatggaatacctgaaccttatgagaagctgaacgaacttacgagaggccaagctgtcaccaaggacagcatgcatcaattca

SEQ ID NO: 56942 - protein, 148 aa, Zea mays
  misc_feature: Ceres CLONE 1501415
  misc_feature (57)..(148): Pfam Name: ASL_C Pfam Description: Adenylosuccinate lyase C-terminal
  misc_feature: SWISSPROT Homolog: EC 4.3.2.2 Adenylosuccinate lyase
MWSYISLGYFKQIPKAGEVGSSTMPHKINPIDFENSDGNLCLANSVLSGISMKLPISRMQRDLTDSTVLRNLGMGLGHSLLAYKATIRGISKVQVNEARLAEDLEQTWEVLAEPIQTVMRRYGIPEPYEKLNELTRGQAVTKDSMHQF

SEQ ID NO: 56943 - DNA, 675 bp, Zea mays
  misc_feature: Ceres CLONE 1501417
  misc_feature: Encodes the peptide sequence at SEQ ID NO. 56944
aagctggagctccccgcggtggcggccgctctagaactagtggatcccccgggctgcaggaattcgcacgagaccattacctagaacatcctaacgaaaactctcgatccggaaacctctcataccctagccgcctcctgcaagtttcggagctcacgaatctgcgccatggcgagagagacggacaccttcgcatttcaggctgagatcaaccagctgctctcactcatcatcaacaccttctactccaacaaggagatcttcctccgcgagcttatctccaactcttccgatgcgctggacaagatcaagttcgagagtctcactgactacagcaagctcgatgcacagcctgagcttttcatccaccttgtcccagacaaggccacgaacacactctccatcatccacagcggcatcagcatgaccaaatccgaccttgtcaacaacctcggtaccatcgccaggtccgggacgaaggacttcatggaagctcttgctgcccgcgctgatgtgtccatgactggccagttcggcgtctgtttctactctgcctacctcgtcgccgatagagttgtcgagacctccaagcacaacggtgacgagcactacgtgtgggagtcccaagcgggcgggacggtcactgttactcgtgacacgtcaggtgagcatctt

SEQ ID NO: 56944 - protein, 169 aa, Zea mays
  misc_feature: Ceres CLONE 1501417
MARETDTFAFQAEINQLLSLIINTFYSNKEIFLRELISNSSDALDKIKFESLTDYSKLDAQPELFIHLVPDKATNTLSIIHSGISMTKSDLVNNLGTIARSGTKDFMEALAARADVSMTGQFGVCFYSAYLVADRVVETSKHNGDEHYVWESQAGGTVTVTRDTSGEHL

SEQ ID NO: 56945 - DNA, 748 bp, Zea mays
  misc_feature: Ceres CLONE 1501418
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
ccccgcggtggcggccgctctatactagtggatcccccgggctgcaggaattcgcacgagaccattacctagaacatcctaatcgaaaaaatcacctcctcaacctccagcccaacctccagcccggaatcgagagcaatggcgctcgccaaggccaaggagatcgttgcctccgctcccctcgtcgtcttcagcaaaacttcctgtcccaattttccatgaccggannnntgaactgtatctcctactgtagtggtaaaccagtatgctgacttgtgtgcggtgccgttggaccggtcgccctgcagcccccggatcggtagagccacgtctcccgagcttatcttctattttatttcctatacctcacacacttcaactcggaccgccgtttgcttcgcgctttgttcccttcaaccttatcgcgagcttttttgcgttcgtttacccggattcgtgttattacctgattccacttacatgtctctcaaccttcttctccgaccgaccctgctaacccatacaattttttaagcgaggatttttgtccatggcccatattcccccctataagagaaacaaatcagttatgacctacacgtctcatttcacgttggttaatgccctccgctgtcagtcttccgtcgactatttaatttagatagttgtatataatttctatactacgttatatcgtacttcttgatacgtacatataccagcgttatctaaaaaaaacaaaaaaaaa

SEQ ID NO: 56946 - DNA, 638 bp, Zea mays
  misc_feature: Ceres CLONE 1501421
  misc_feature: Encodes the peptide sequence at SEQ ID NO. 56947
  misc_feature (567)..(567): n is a, c, t, g, unknown, or other
aagctggagctccccgcggtggcggccgctctagaactagtggatcccccgggctgcaggaattcgcacgagaccattacctagaacatcctaatcgaaaactgatctgttcttggagtggggaggcgaggagaggagaggaggaagatggcggcgcaggagcacgagcacgagcacgagcacgagaagcagcaggcgaagacgagcaccacgagctcgctcccctccagcagcgagcgctcctccagctccgcccccaacaaccttagggaaggaggcgtggagagcgacgaggagatacggcgggtgccggagctgggcggcgcgtcggcgtcggcgtcggcgtcgtcgggcgcgggcaaggaggacggcgcgcgggcggtggccgcgggggcgcaggggcaccctccggccgccgggaagaagcgcggccgcgccccgggggacaaggagcagaaccggctgaagcggctgctgcggaaccgcgtgtcggcgcagcaggcgcgggagcggaagaaggcgtacctgacggagctggaggcgcgggccaaggacctggagctccgncatgccgagctcgagcagcgggtgtccacgctccagaacgagaacacacgctccgccagattctgaagaca

SEQ ID NO: 56947 - protein, 161 aa, Zea mays
  misc_feature: Ceres CLONE 1501421
  misc_feature (100)..(154): Pfam Name: bZIP_2 Pfam Description: Basic region leucine zipper
MAAQEHEHEHEHEKQQAKTSTTSSLPSSSERSSSSAPNNLREGGVESDEEIRRVPELGGASASASASSGAGKEDGARAVAAGAQGHPPAAGKKRGRAPGDKEQNRLKRLLRNRVSAQQARERKKAYLTELEARAKDLELRHAELEQRVSTLQNENTRSARF

SEQ ID NO: 56948 - DNA, 647 bp, Zea mays
  misc_feature: Ceres CLONE 1501426
  misc_feature: Encodes the peptide sequence at SEQ ID NO. 56949
gaaagctggagctccccgcggtggcggccgctctagaactagtggatcccccgggctgcaggaattcgcacgagaccattacctagaacatcctaatcgaaaaatcagagagccgagacgacacgctcgagacccagcaaggcaagaagaacacgagagagacagcaggcaccaggcagggatcaatcatccgtccatggagaacctaaaggaggtaagtaaacctagtgatctctgcctccctggaccctctctctcttgattcctttcccgaggagctcagctcgctcggctagctaggcaccgggttcctgttcctgccgcgaggcgcgtctcacacgcggcggtcggtgcgcgcatgcagcagcggggccacgacgcggcgggcgccaacgcctggatgacggtgccggcgttcggggactgggacacgaagaacggcgcgctgccggactactccatggacttctccaagatccgcgagatgcgcaagcagaacaagaaggagctctcccgcgccagcctcggcggcgacgacgacctcctcgcccacgcccagaagccgcagcccagtatcgccccgcccaagctcggccgcccccgccccggccccgccgacgaccactccccaacggggagggaagaag

SEQ ID NO: 56949 - protein, 96 aa, Zea mays
  misc_feature: Ceres CLONE 1501426
MQQRGHDAAGANAWMTVPAFGDWDTKNGALPDYSMDFSKIREMRKQNKKELSRASLGGDDDLLAHAQKPQPSIAPPKLGRPRPGPADDHSPTGREE

SEQ ID NO: 56950 - DNA, 655 bp, Zea mays
  misc_feature: Ceres CLONE 1501430
  misc_feature: Encodes the peptide sequence at SEQ ID NO. 56951
aagctggagctccccgcggtggcggccgctctagaactagtggatcccccgggctgcaggaattcgcacgagaccattacctagaacatcctaatcgaaaaaagaaaccaacaccgtaccgtaccgcagctctccgtcgccccaccgccacctgcaagatgagtccgtggaagcccctcttggtggccaccgcggccctcgccgcgctcctcgcggccgacgctaccgtggagacgacgtgcaaggcggcagccgccacggacgaccgcgtcgactacggcttctgcgtgtcggagctgagcaagcaccgcgacagccctggcgcggacgcctggggcctggccaaggtggcggccaacctcggcgtcaacaacgccggcggcgcggtccgcgacgcggaggcgctgctggccggccccccgccgggcgcgggcgcggacggcgccaagacgagggcggcgctggggcagtgccgcaggctctacttcgacatggagctcgcgctcgcgggcgcgtacgacgagatcgacgcgcgcgagtacgcggcggggaaggagatggccgtggagggcatcgcgttggcgcggcgctgcgacgccgtcttcgccgaggccgggatgccgtcgctgctcgcgcggcgcgcggagtacgcccg

SEQ ID NO: 56951 - protein, 165 aa, Zea mays
  misc_feature: Ceres CLONE 1501430
MSPWKPLLVATAALAALLAADATVETTCKAAAATDDRVDYGFCVSELSKHRDSPGADAWGLAKVAANLGVNNAGGAVRDAEALLAGPPPGAGADGAKTRAALGQCRRLYFDMELALAGAYDEIDAREYAAGKEMAVEGIALARRCDAVFAEAGMPSLLARRAEYA

SEQ ID NO: 56952 - DNA, 666 bp, Zea mays
  misc_feature: Ceres CLONE 1501431
  misc_feature: Translation starting site: 129
  misc_feature: Pfam Name: PC4 Pfam Description: Transcriptional Coactivator p15 (PC4)
  misc_feature (310)..(310): n is a, c, t, g, unknown, or other
  misc_feature (312)..(312): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (400)..(400): n is a, c, t, g, unknown, or other
  misc_feature (403)..(403): n is a, c, t, g, unknown, or other
  misc_feature (404)..(404): n is a, c, t, g, unknown, or other
  misc_feature (407)..(407): n is a, c, t, g, unknown, or other
  misc_feature (412)..(412): n is a, c, t, g, unknown, or other
  misc_feature (413)..(413): n is a, c, t, g, unknown, or other
  misc_feature (442)..(442): n is a, c, t, g, unknown, or other
  misc_feature (443)..(443): n is a, c, t, g, unknown, or other
  misc_feature (463)..(463): n is a, c, t, g, unknown, or other
  misc_feature (467)..(467): n is a, c, t, g, unknown, or other
  misc_feature (468)..(468): n is a, c, t, g, unknown, or other
  misc_feature (495)..(495): n is a, c, t, g, unknown, or other
  misc_feature (578)..(578): n is a, c, t, g, unknown, or other
  misc_feature (590)..(590): n is a, c, t, g, unknown, or other
  misc_feature (642)..(642): n is a, c, t, g, unknown, or other
acgctggagctccccgcggtggcggccgctctagaactagtggatcccccgggctgcaggaattcgcacgagaccattacctagaacatcctaatcgaaaagtgtccagtcgagtctcagcaaggaagatgtgggggaaaggaaagaagcgtttcggcggtggcggcagcggtgagcccgcggccaatccccaggccacgagggacgatggcccctccgaatccgctgaagacggtaccgtcgtagcctagatatcgaataacaagaatgcgtcccttaggagctgtaaaccaaggtcttcgtcgacttncncgagttctacttcaaggacggcaagactctccccactcgcgaaggtatatttctccccccccatcgggggggggggggggnnnnncanatnnaanccctnnataaccccatccaaaaaaaaacatcaccnnaccccccccaccttcccctnaccnncaaacttttccctcttcccccctcaanacccaaattaccccaactctttttttttccccccatccctccccttttccttttttcccttttacccccctcccttttttaanattcccccatancccacaaatttttttttttctccccctacctatttttaaaattaaacccctnacaaacccatacttcaatttcccc

SEQ ID NO: 56953 - DNA, 654 bp, Zea mays
  misc_feature: Ceres CLONE 1501437
  misc_feature: Encodes the peptide sequence at SEQ ID NO. 56954
aaagctggagctccccgcggtggcggccgctctagaactagtggatcccccgggctgcaggaattcgcacgagaccattacctagaacatcctaatcgaaaagacacagacgaacctttccggtatcgcggcgggaaaaggaggtagttttcccgccaaggcgctcccaaactctcctctcccgccgcccctcctctccaacaatttcatcccggcaacaagcgcctcccgcccgcgcgacctgtgggctgtggtctccgacgacgcccgcgcaccaccgtcaacaggcgccgaccgctacccccggccggacgaggatccgcttactgcgcagcctccgacgccgcatggagatcgtgcgctcccaccggcaggttgccgccgcagccgccggtggcggcgcgggggccctgccgacctacaaagcggcgccgcagctcgaggtgcggctggaggagttcgagctcttcgccatcgaccgcctccgagttctcaaggggatttcggatggactctcacgggggaagaggccggaggaggtggagaaactggtcaatgaattgtggaagacacacatggggcaccaggatccagcagagactttgaataaggatataatatcacactttgtgctccgtcttgtctactgcagaa

SEQ ID NO: 56954 - protein, 102 aa, Zea mays
  misc_feature: Ceres CLONE 1501437
MEIVRSHRQVAAAAAGGGAGALPTYKAAPQLEVRLEEFELFAIDRLRVLKGISDGLSRGKRPEEVEKLVNELWKTHMGHQDPAETLNKDIISHFVLRLVYCR

SEQ ID NO: 56955 - DNA, 662 bp, Zea mays
  misc_feature: Ceres CLONE 1501438
  misc_feature (247)..(247): n is a, c, t, g, unknown, or other
  misc_feature (358)..(358): n is a, c, t, g, unknown, or other
  misc_feature (384)..(384): n is a, c, t, g, unknown, or other
aaagctggagctccccgcggtggcggccgctctagaactagtggatcccccgggctgcaggaattcgcacgagaccattacctagaacatcctaatcgaaaacagtcgcctcgtctctccctgccgcgtcgcctcgtctctccctgccgcgtcgcctccagttccgacgccagcgcgcctcccgcctccgccgcgcctgacgaacgcagtgtatgactgtgcatgtagagtagaggagggtccggcnagatggggatgcgagataagtagcggtaccagaagcgagtgctcgcgcgccgtacccgcgtaccgcgcctaggcgatgtccaggacttcccctgcgctggaaggagccccnggtaggaactcccgtaggcgcagcancctgaagagcccgaaaaaccaggcccagtcgcctcaattgggcatttccccatggtttccaccaggaacaattgaaagggtccttttaaggatttgggggaattaaagggttttggattccctcaaacccccccaaaaggaaaagccccggccctttgggattcctttgggttgaaaccccccgtttgggaaaaagggctccccaattaaaaaaaaaattttttctttttttgggggcacccttctaaatgccccccttttagaccggggaaacgggg

SEQ ID NO: 56956 - DNA, 649 bp, Zea mays
  misc_feature: Ceres CLONE 1501442
  misc_feature: Encodes the peptide sequence at SEQ ID NO. 56957
ggagctccccgcggtggcggccgctctagaactagtggatcccccgggctgcaggaattcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtggcgacgctgctgaactgcatgatgtgggtgctgtacgggctgccgctggtgcacccgcacagcatgctggtggtgaccatcaacggcaccggcatgctcatccagctcacctacgtggcgctcttcatcctctgctcgggggcggtgcgccgcagggtcgtgctcctgttcgccgccgaggtcgccttcgtcgtcgccttggccgcgctggtgctcaccctggcgcacacgcacgagcgcaggtccatgctcgtcggcatcgtctccgtcttcttcgcacc

SEQ ID NO: 56957 - protein, 141 aa, Zea mays
  misc_feature: Ceres CLONE 1501442
  misc_feature (9)..(98): Pfam Name: MtN3_slv Pfam Description: MtN3/saliva family
MVSADTIRTAIGVIGNGTALVLFLSPVPTFVGIWKKRAVEQYSPIPYVATLLNCMMWVLYGLPLVHPHSMLVVTINGTGMLIQLTYVALFILCSGAVRRRVVLLFAAEVAFVVALAALVLTLAHTHERRSMLVGIVSVFFA

SEQ ID NO: 56958 - DNA, 649 bp, Zea mays
  misc_feature: Ceres CLONE 1501445
  misc_feature: Encodes the peptide sequence at SEQ ID NO. 56959
  misc_feature (502)..(502): n is a, c, t, g, unknown, or other
aaagctggagctccccgcggtggcggccgctctagaactagtggatcccccgggctgcaggaattcgcacgagaccattaactagaacatcctaatcgaaaaaccaaaggtatcttgcaatcacaacgaacaaaagctctcgatctcaccgacaccgaggaagaagagatcaatggcgtccgagcagggagtcgtgatcgcgtgccacagcaaggctgagttcgacgcccacatgaccaaggcccaggaagccggcaagctagtggtcatcgacttcactgccgcctggtgcggtccatgccgcgccatcgccccactgttcgtcgaacacgccaagaagttcactcaggtcgtcttcctgaaggtggacgtggacgaagtgaaggaagtcaccgcggcctacgaggtcgaagcgatgccgacttccactttcgtcagaacggcagacggtcccgaccatcgtgggtgccaagaagacgagcctctgggcctgatcaaaagnatgccgggctgggcctgggtttgcgttggcctaaggaaatcaaatcgtcgtcccctcaaaaagggccaccccttaggcttgaaaaagttgcccttacaattccgggcttttccctttgggggggcattggaaacacaaaaaaatttt

SEQ ID NO: 56959 - protein, 159 aa, Zea mays
  misc_feature: Ceres CLONE 1501445
  misc_feature (8)..(111): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
  misc_feature (110)..(110): Xaa is any aa, unknown, or other
MASEQGVVIACHSKAEFDAHMTKAQEAGKLVVIDFTAAWCGPCRAIAPLFVEHAKKFTQVVFLKVDVDEVKEVTAAYEVEAMPTSTFVRTADGPDHRGCQEDEPLGLIKXMPGWAWVCVGLRKSNRRPLKKGHPLGLKKLPLQFRAFPFGGALETQKNF

SEQ ID NO: 56960 - DNA, 667 bp, Zea mays
  misc_feature: Ceres CLONE 1501449
  misc_feature: Encodes the peptide sequence at SEQ ID NO. 56961
  misc_feature (667)..(667): n is a, c, t, g, unknown, or other
aaagctggagctccccgcggtggcggccgctctagaactagtggatcccccgggctgcaggaattcgcacgagacctacctagaacatcctaatcgaaaaaccggcttcctcctcctcctcctctcccctcccgattccttctctctcccgctaaatggatgggcacgctacgccggatttctcccccgcagtcggttccttgggccacacaatcgcgcgctcggaaaactctgcggagggcgaaggaggcgaagcaagggcgacgtatccgccgccggagaaggtagccgtcgatccgcttcattcgcgcttcaaggtccacccgtgatgagcaaagcaggcggcggccccgggtcggccccggtcccgacggccgcggccgcggcggccgcggtgcagaagcagaagtcgctgctgcagagcttgctgcaagaatttgggcagtcgatccggcgcggcggccgggtatggcggccacggagcagctgaaggagctgggggagaagctgcaggcggtggcgccggctcctgcggacgaactcgccaagctcctcgagctcattgctgaagcatgggatgcaggaggtctctatcaagttggtcagtttcctcactggaacgtttggtcagagtggaatggtaaggtaagatactttcaaagacttn

SEQ ID NO: 56961 - protein, 66 aa, Zea mays
  misc_feature: Ceres CLONE 1501449
MAATEQLKELGEKLQAVAPAPADELAKLLELIAEAWDAGGLYQVGQFPHWNVWSEWNGKVRYFQRL

SEQ ID NO: 56962 - DNA, 668 bp, Zea mays
  misc_feature: Ceres CLONE 1501503
  misc_feature: Encodes the peptide sequence at SEQ ID NO. 56963
cagagctggagctccccgcggtggcggccgctctagaactagtggatcccccgggctgcaggaattcgcacgagaccattacctagaacatcctaatcgaaaaaatgtccgtcgtgatctgctgccgccatcaacgccctactcccctcctagatcccgtgatctgctacgaagctgccatcaatgccctcctcccccttcgctcagctccccctcgcgccttcgatccgctaccgtgacccgctgcgaggcggccatcaacgcccatgtcctccttcgcgcagctaccttcccaggatctcgggcgctccttcgtcgccatactttttggttcagcgggacgcccagcccgtagggcctaagcttttgctgatcacttcaagatggctctggactgtttcttcgctgtatggtttgttgtgggaaatgtgtgggtgttcgatggacattcttccgcccatgacgcacccaacctgtacaggtgtcggtgagaggtattcaagttggaattggaattgtaggttatagtccactaggagaggttttttttgtgcagtggagcaaaactagctgactcgctgtcagagcaggacttctgcaaggggaactcaaactattacctatatgtgcataatacatggttcaactatcctttgctttaaacatct

SEQ ID NO: 56963 - protein, 35 aa, Zea mays
  misc_feature: Ceres CLONE 1501503
  misc_feature: The sequence is a functional homolog of SEQ ID NO 178 in the 10/666,642 US patent application
  misc_feature: The sequence is a functional homolog of SEQ ID NO 2 in US patent 7053203
  misc_feature: The sequence is a functional homolog of SEQ ID NO 404 in the 10/666,642 US patent application
MALDCFFAVWFVVGNVWVFDGHSSAHDAPNLYRCR

SEQ ID NO: 56964 - DNA, 671 bp, Zea mays
  misc_feature: Ceres CLONE 1501511
  misc_feature: Encodes the peptide sequence at SEQ ID NO. 56965
aaagctggagctccccgcggtggcggccgctctagaactagtggatcccccgggctgcaggaattcgcacgagaccattacctagaacatcctaatcgaaaaaacagtgacatccaaaccgtgccattttttcgagcggcttgagccacaacagccccactctgtctgagtgtctgtgcctgcctgtgcaaagtagggtttccaccgggacacaggccgcctccatcccatggcgcgcgccgccgcctccaggctcgccgccgtggcgaactcttcctctacgcgcgagttgttcgcccgccacctcgccgccgctgccgcctcggcgtggaccgcaccgccgcgtctgcctgaaccagggagggagcggcggagcccgggctggtggtgtccgagcaggtcgtttcatgccacaaggcgggtgtatacaagggattactatgatgtgcttggagtaagcaaggatgcttctgcaccggatataaagaaggcatattatgcgctcgcaaagaagttccatcctgatactaataaagatgctgatgcagaaaaaacatttcaagaagttaccgtgcctatgaagttttgaaagacaaatgacagcgtgaaatatatgatcagcttgaaccagaagcatacgagcgtcaagcgtcaagtggtgaccctggagg

SEQ ID NO: 56965 - protein, 119 aa, Zea mays
  misc_feature: Ceres CLONE 1501511
  misc_feature (69)..(119): Pfam Name: DnaJ Pfam Description: DnaJ domain
MARAAASRLAAVANSSSTRELFARHLAAAAASAWTAPPRLPEPGRERRSPGWWCPSRSFHATRRVYTRDYYDVLGVSKDASAPDIKKAYYALAKKFHPDTNKDADAEKTFQEVTVPMKF

SEQ ID NO: 56966 - DNA, 686 bp, Zea mays
  misc_feature: Ceres CLONE 1501527
  misc_feature: Encodes the peptide sequence at SEQ ID NO. 56967
  misc_feature (459)..(459): n is a, c, t, g, unknown, or other
  misc_feature (482)..(482): n is a, c, t, g, unknown, or other
  misc_feature (490)..(490): n is a, c, t, g, unknown, or other
aagctggagctccccgcggtggcggccgctctagaactagtggatcccccgggctgcaggaattcgcacgagaccattacctagaacatcctaatcgaaaaaatatttttgagaaagagccaaggatccatagagatgtgtttgttgctcccagtgcagcagtcattggggatgttgagattggtcatggatcgtcaatctggtacggatccatattgagaggtgatgtcaacagcattcatattggatctggttctaatatacaagacaattcccttgtacatgtttcaaaagctaacattagcgggaaggtcctcccaaccataattggaagcaacgtgacagtgggtcacagtgctgtattacatgcatgtaccattgaggatgaagcttttgttggtatgggtgccactctgcttgatggagtggtagttgaaaagcacagcatggttggtgcangatctctttgtaagcagaatcanggattccnttctggaaaggtctgggtcggtaatcctgccaaagtcctaaaggaagctaaccgaaaaggaaattgggtttcttcgtttcattcgcaaccaatttttttcacccttccccagggccctgcgcccaaaaaaacccaaaacttttccaaaaaatttgccctcaaaaaaagtttgagaaaaaaattcccccccaaaaaa

SEQ ID NO: 56967 - protein, 228 aa, Zea mays
  misc_feature: Ceres CLONE 1501527
  misc_feature: SWISSPROT Homolog: EC 4.2.1.1 Carbonate dehydratase
  misc_feature (153)..(153): Xaa is any aa, unknown, or other
  misc_feature (160)..(160): Xaa is any aa, unknown, or other
  misc_feature (163)..(163): Xaa is any aa, unknown, or other
AGAPRGGGRSRTSGSPGLQEFARDHYLEHPNRKNIFEKEPRIHRDVFVAPSAAVIGDVEIGHGSSIWYGSILRGDVNSIHIGSGSNIQDNSLVHVSKANISGKVLPTIIGSNVTVGHSAVLHACTIEDEAFVGMGATLLDGVVVEKHSMVGAXSLCKQNXGFXSGKVWVGNPAKVLKEANRKGNWVSSFHSQPIFFTLPQGPAPKKTQNFSKKFALKKSLRKKFPPKK

SEQ ID NO: 56968 - DNA, 648 bp, Zea mays
  misc_feature: Ceres CLONE 1501536
  misc_feature: Encodes the peptide sequence at SEQ ID NO. 56969
ggagctccccgcggtggcggccgctctagaactagtggatcccccgggctgcaggaattcgcacgagaccattacctagaacatcctaatcgaaaactcgatttctcgcggagcggccctccacctttatcgccgccgccgccgttgctgtgttccgtctcttcgccgatggcttcggccaagagaatgatgtcaggacctcctgcttctggatatgaccggtcacctctattttacggaggaggtggtggcgccccacctccaattccgcttggaactggtagctatggtgctccatatccacaccttgggatgcgatatggctatggtccaccagtaggacctcctggttcatacggtcttttctcttcatatggtccacctgggccaatgagtggtatgggatatggcccaggacctgagctaggccgatatagctatgggtttagaggttctccaatgccggtttctagtccatggtctggtggagcattagctgagaacaatgacaacattgcttcacgaaagcgccgtggaggccctgatggactttctgagggtgactggacctgtcccaaatgcgacaacattaacttttcgttcagaagcacttgcaacatgaagaaatgtggagccccgaggccaact

SEQ ID NO: 56969 - protein, 160 aa, Zea mays
  misc_feature: Ceres CLONE 1501536
  misc_feature (129)..(160): Pfam Name: zf-RanBP Pfam Description: Zn-finger in Ran binding protein and others
MASAKRMMSGPPASGYDRSPLFYGGGGGAPPPIPLGTGSYGAPYPHLGMRYGYGPPVGPPGSYGLFSSYGPPGPMSGMGYGPGPELGRYSYGFRGSPMPVSSPWSGGALAENNDNIASRKRRGGPDGLSEGDWTCPKCDNINFSFRSTCNMKKCGAPRPT

SEQ ID NO: 56970 - DNA, 650 bp, Zea mays
  misc_feature: Ceres CLONE 1501548
  misc_feature: Encodes the peptide sequence at SEQ ID NO. 56971
ccccgcggtggcggccgctctagaactagtggatcccccgggctgcaggaattcgcacgagaccattacctagaacatcctaatcgaaaatcagaagctagaagcctagagcagccaagaaaagcacatacccgagtcgccgaaacaacaacaatcccaatcccccctcgtcactcaaaactcgaccaacaatgtcgctgattcgccgtggaagcgcattcgaccccttctcccttgacctctgggaccccttccagggctttcccttcggctctggaagcagcagcagcagcagcctgttcccctcgttcggaggcaccaccagctctgagacggccgccttcgccggcgctcgcgtcgactggaaggagacgccggaggcgcacgtgttcaagaccgacgtgccggggctgaagaaggaggaggtgaaggtggagctggaggacggcaacgtgctccagatcagcggcgagcgcagcaaggagcaggaggagaagacggacacctggcaccgcgtggagcgcagcagcggcaagttcctgcgcaggttccgcctgccggagaacgccaggacggagcagatcagtgcgtccatggagaacggcgtgctcaccgtcaccgtgcctaaggaggaggccaagaaggccgac

SEQ ID NO: 56971 - protein, 153 aa, Zea mays
  misc_feature: Ceres CLONE 1501548
  misc_feature (57)..(153): Pfam Name: HSP20 Pfam Description: Hsp20/alpha crystallin family
MSLIRRGSAFDPFSLDLWDPFQGFPFGSGSSSSSSLFPSFGGTTSSETAAFAGARVDWKETPEAHVFKTDVPGLKKEEVKVELEDGNVLQISGERSKEQEEKTDTWHRVERSSGKFLRRFRLPENARTEQISASMENGVLTVTVPKEEAKKAD

SEQ ID NO: 56972 - DNA, 665 bp, Zea mays
  misc_feature: Ceres CLONE 1501555
  misc_feature: Encodes the peptide sequence at SEQ ID NO. 56973
  misc_feature (665)..(665): n is a, c, t, g, unknown, or other
aaagctggagctccccgcggtggcggccgctctagaactagtggatcccccgggctgcaggaattcgcacgagaccattacctagaacatcctaatcgaaaaaaagagcgcgcgacggcggcccctgggagagccatgcgagactggaggcggaaccgcgcacgacaccaagctgccgcgccggactgctgcacgcaagcgcagcgcaggaccgaccgacctccgtaggcacgcacggcgccggcggcatggcggagcacctcctgtcgacggccgtgcacgacacgctgccggggagctacgtgcggccggagccggagcgcccgcgcctcgcggaggtcgtgaccggcgcgcgcatccccgtcgtggacctgggcagccccgaccgcggcgcggtcgtggccgccgtcggcgacgcctgccgctcgcacggcttcttccaggtcgtcaaccacgggatacacgccgccctggtcgcggcggtgatggccgcggggcgcggcttcttccggctgccccccgaggagaaaggcaagctctactccgacgaccccgccaggaagatccggctgtccaccagctttcacgtgcgcaaggagacggtgcacaactggcgcgactacctccgcctgcactgccatcccctcgacgaagtcctgcccgan

SEQ ID NO: 56973 - protein, 138 aa, Zea mays
  misc_feature: Ceres CLONE 1501555
  misc_feature: SWISSPROT Homolog: EC 1.14.11.9 Flavanone 3-dioxygenase
MAEHLLSTAVHDTLPGSYVRPEPERPRLAEVVTGARIPVVDLGSPDRGAVVAAVGDACRSHGFFQVVNHGIHAALVAAVMAAGRGFFRLPPEEKGKLYSDDPARKIRLSTSFHVRKETVHNWRDYLRLHCHPLDEVLP

SEQ ID NO: 56974 - DNA, 643 bp, Zea mays
  misc_feature: Ceres CLONE 1501556
aaactggagctccccgcggtggcggccgctcttcaatagtggatcccccgggctgcatgtattcgcacgagaccattacctagaacatcctaatcgaaaaagctcttgtgttttctgttactgatgacagatttccaccaaacaagccggggacgacggcggcgaggacgacgacgacgacagggacggtcctggaccagcgcatgtgccaagtatgggagcgcttgatgactcggccatgacggtgcctgacagactctgtgcacgacgaggaagtgctgcaccggttatggaactctctaggacgcgggcctcaccgactacaagtccgcgacgtcacctccgtctccacagccccaacgtcatcgtcctctcgctcccccagagctgcttgcttcgtggattcctaatgtgactcttctcgctctggagatggaatcctgtcttcccctcgtgctgtatcatggtcccggtcatactttcctccctgtcgcgggtcaccgcactgactatacttgtgtctcttgctatctcctcgactggccagatatcatgctaactcgccatcctgattttcatagtgactgcctgcctcactgcgtgctttactgcaatgcttgtattgcagtatgctagagctccg

SEQ ID NO: 56975 - DNA, 1144 bp, Zea mays
  misc_feature: Ceres CLONE 1501573
  misc_feature: Encodes the peptide sequence at SEQ ID NO. 56976
gataccgatagctagtacgttatagctccttcagtaaccaccgaaccatccacgagccaccgccgctggcctcgcgcaacatgctgccgcctcacgtcgagatgccgaccaccagggcggcgggcatcaagctgttcggcaaggtcatcaccacgcattatcagcagcagcagcagccgccgcagcccgtgcgccacgcgggcgccgcgccggcgtcgtcggggcgcgggagcggcggcggccccggccccgacttgctggaggaggtggcgcgggcgcgcgcggcggcggccgaggcgcggctgccgtgcccgcgctgcttgagccgggacaccaagttctgctacttcaacaactacaacgtgaaccagccgcgccacttctgccgggcctgccaccgctactggacggccggcggcgccatccgcaacgtgccggtcggctccggccgccgcaagaaccgcccggtgctgctcccgccgccgccgccgccgccgcacgctgccaccgccactactaccggcagtagtgctactatcagcgccgacgatagtaacgaccgccgccgctcggcctcggggtctcctcctccggtgtttacctctgcgttcaccgcgccctactacctcggctcgcccgcccagttcgccacgtcgtcgccggcttacgccgctggcgctgccggcccgccggggacggcggggcagtgcttgtggctggtggcggcgaccacgaccacggatcgttctgctgcaacggagaccgcgcttttctgatatgacgtgaatgaaaaaaaaataagaaaatgaaatgatgtgatttcgcttggttgcttgctcctcgcgctccgagcattttcacggatccggccagccggcggtttgggtttgacctgctggtaacaatttcgagtgtgcatgttcgggctttttatttatttttaggtgtagttgtgtaatcgtccaggtgtctgtttctaacctttttcttttgacttagcatcgaacttttgtaagcatcaaacttttgcaaccttttcttttgacttggcagcaaactttttgtgaaggttgtgtaagtccttttggggagcttttgtaagcttgggatgtaatttaacttgactagaaaaaaaaaaaaaaaa

SEQ ID NO: 56976 - protein, 231 aa, Zea mays
  misc_feature: Ceres CLONE 1501573
  misc_feature (70)..(132): Pfam Name: zf-Dof Pfam Description: Dof domain, zinc finger
MLPPHVEMPTTRAAGIKLFGKVITTHYQQQQQPPQPVRHAGAAPASSGRGSGGGPGPDLLEEVARARAAAAEARLPCPRCLSRDTKFCYFNNYNVNQPRHFCRACHRYWTAGGAIRNVPVGSGRRKNRPVLLPPPPPPPHAATATTTGSSATISADDSNDRRRSASGSPPPVFTSAFTAPYYLGSPAQFATSSPAYAAGAAGPPGTAGQCLWLVAATTTTDRSAATETALF

SEQ ID NO: 56977 - DNA, 662 bp, Zea mays
  misc_feature: Ceres CLONE 1501583
  misc_feature: Pfam Name: KIP1 Pfam Description: KIP1-like protein
aaagctggagctccccgcggtggcggccgctctagaactagtggatcccccgggctgcaggaattcgcacgagaccattacctagaacatcctaatcgaaaacttggaaattttcatgatgatgatgcgcattcattcatccacacgacacgcctgcccgtaaaaatttacggcgtcacatgtttgtgcagccatttcctttgccttgagattttgatgacccgcgttctgcattcatgtcttcgttgcagacatcgatcagcgggtgcgcgcgctggccgtggacgatgccgcgccgcccacggagcactccttcgcggagcgcgccgaggagtactaccagaagcggccgcagctgctggccctcctcgccgacctccaccgccgctacctctgcctggccgaccgctactgccaccaccagcacaagcgagagcagccctcgctgccggcgtctgcctcctccgactgcggctcgtccgacgtcgacgaccgctgctccgacgccggcagctcgctctccttccaggcccagcacgcgccgccgcgggccggactccccgccgaggaagaggaggagctgctggtggcggagctggtggccgcgtgggtggagcgcgacgtgctggcggacgaggcggcgcggcgcgcggcggagtcgg

SEQ ID NO: 56978 - DNA, 682 bp, Zea mays
  misc_feature: Ceres CLONE 1501586
  misc_feature (398)..(398): n is a, c, t, g, unknown, or other
  misc_feature (411)..(411): n is a, c, t, g, unknown, or other
  misc_feature (682)..(682): n is a, c, t, g, unknown, or other
aaagctggagctccccgcggtggcggccgctctagaactagtggatcccccgggctgcaggaattcgcacgagaccattacctagaacatcctaatcgaaaaaccgataccgtctccgcctttccttccttttgcgctagcttccacagcatcaccaccgccgccccagctcgcttccctccccgctacacggacacggccgctcagcgctcaccaccgcttccatgctcctcgcctcgtctcccgctcgcgagacgtagctccagatcctctcccccacccacggcagcaccgcattaccctcagatccacccccgcgagcctcatttcagatccacccatgcgcctcccggcccttttcgccctgcaccccgcacgccgtaggggggggagcttcngcggccaaggccnctgaaacgggccccccgaggaaggagcaccgtctgtcccacgaagcgccgggtggaagccggcccccccatggggttggggccccagcgcggaaaccgggggctactaccccgcgctggtaaagaagcgatctccagcggtaaaaccggcatcctccagggcaaaaaaccacttctttttcgttctcaaagggggggagcccctttttcccccgcaaaacaacaatggttgggttcacaccccccttgggccaaatgtggggaacccccan

SEQ ID NO: 56979 - DNA, 670 bp, Zea mays
  misc_feature: Ceres CLONE 1501618
  misc_feature: Encodes the peptide sequence at SEQ ID NO. 56980
aaagctggagctccccgcggtggcggccgctctagaactagtggatcccccgggctgcaggaattcgcacgagaccattacctagaacatcctaatcgaaaaaaaaattcgcagcgtgtctcttcctccatcgcagcgtgtctcgtgctccccccaggctcctcttcctcgctttccctccaccccgggcgcaaaccctaaccctaccgtcgctcgccccgcggcgtctgccaatggcgcgccccgtgtgagtgtgcgcgagagaggggtagaccttgaggccgctacccggggaggagagcgagagatgtataaacaggggggagcggggggaggggctgggctggactcgaagcggatcaacgacgcgctggataagcatgtcgagaaggcaaacgcgtcgccgtccacggcgagggaaacggcgggcggcggatgcgaccaccaccgcctcgtcgtgccatccgccgagtcatcccaggcccaagggccgctgctccaaaggggagtctgagtctgtataaaaaggatcagatagtagcggctactaatggtggaaaaacgcccctgagattccatggcatttggcaacctggggaggggaatgagttccatcggggaaagtcaaccggggagttatatgcggggaaaaagttacaacctattgggg

SEQ ID NO: 56980 - protein, 68 aa, Zea mays
  misc_feature: Ceres CLONE 1501618
MYKQGGAGGGAGLDSKRINDALDKHVEKANASPSTARETAGGGCDHHRLVVPSAESSQAQGPLLQRGV

SEQ ID NO: 56981 - DNA, 660 bp, Zea mays
  misc_feature: Ceres CLONE 1501619
  misc_feature: Encodes the peptide sequence at SEQ ID NO. 56982
aaaagctggagctccccgcggtggcggccgctctagaactagtggatcccccgggctgcaggaattcgcacgagaccattacctagaacatcctaatcgaaaagtccccgtctcaccgcactgccttgccccctactctgcctcgcttagcttagccgccgctgctacgcactctcgccgtccttgttcccgcgtcgctctgctcgcgatggcgtcccgcgttgcagtgctgctcgtggccgtggcggccgtgctgttcgccgcggcgtcggcgcaggagatggacctgggcgtgccgcccgcgccggcgcccgacacgggcgcggcagcgggggccgcggcgtcggtcctggccgtggcttgctctgccgtcttcttcatcctcgtcgccggtggcctcgtgcagtaggcgctgccgtcgacgtggtggctagctgctggttcggggtcaggcggagccctgttcgatcgttttcgccttagttagtagtaaaagtagcagtcatgggctgtgttgattgtgtccctgtctccccctgggggggcgttgggaacctgggctattggcttattctttgttggccattctgggattggtccgacgtataccttggtgttggaggcttgtggttgttattattaaagaacgatggggatctg

SEQ ID NO: 56982 - protein, 66 aa, Zea mays; identical to SEQ ID NO: 45446
  misc_feature: Ceres CLONE 1501619

SEQ ID NO: 56983 - DNA, 650 bp, Zea mays
  misc_feature: Ceres CLONE 1501633
  misc_feature: Encodes the peptide sequence at SEQ ID NO. 56984
catagctggagctccccgcggtggcggccgctctagaactagtggatcccccgggctgcaggaattcgcacgagaccattacctagaacatcctaatcgaaaaaattccatcgcaacagctcaccaccaccaccatggcgctcccgccgcacatcatggcgctcagcaaggtgcagcgcctctacgacgcctgcgacgtcgtcttctcctcgccgccggtggcgcccacgctcggggacatcacatggctgcagaacatcctcgatggcgtggaagcagccgacgtcgggatcgacgacggggagaagccgacgtcgtcctcgtccgacgacgacctcctcctgccggcgccggcgttcacgcggatcacctacgtgcacatacaccagtgcgacgatttctcgattggcgtcttctgcttcccggccggcgcgacgctgccgctgcacgaccacccggagatggtagtgctcagcaagctgctgtacggctccgtgcgcgtgcgctcctacgactgggtcgccgcgccgcctgataattcgccgtcgccgcccaggaggaggaaacgtggcctggccagggtggtggccgcggacgtggtgcgccgggcgccctgcccggcgtccgtcctcttcccgcgcagcggcggc

SEQ ID NO: 56984 - protein, 172 aa, Zea mays
  misc_feature: Ceres CLONE 1501633
  misc_feature (12)..(172): Pfam Name: DUF1637 Pfam Description: Protein of unknown function (DUF1637)
  misc_feature: SWISSPROT Homolog: EC 1.13.11.19 Cysteamine dioxygenase
MALPPHIMALSKVQRLYDACDVVFSSPPVAPTLGDITWLQNILDGVEAADVGIDDGEKPTSSSSDDDLLLPAPAFTRITYVHIHQCDDFSIGVFCFPAGATLPLHDHPEMVVLSKLLYGSVRVRSYDWVAAPPDNSPSPPRRRKRGLARVVAADVVRRAPCPASVLFPRSGG

SEQ ID NO: 56985 - DNA, 750 bp, Zea mays
  misc_feature: Ceres CLONE 1501636
  misc_feature: Encodes the peptide sequence at SEQ ID NO. 56986
  misc_feature (56)..(56): n is a, c, t, g, unknown, or other
catagctggagctcccaccgcggtggcgagcccgctctagaactagtaggatcccnccgaggctgcagagaatctcgctacgtgaccatctatcctatgaacatgcctatatgcgtaaatatcatcatgccttttccattatctacctcaactccccctgttgcgtcatcagacggatcaggtcgaagcagaacagagctgcaagcatggcgctctcctctcttctcgcgccgatgccgtggtctcccgctcaccctcggcattcgcccggctgccgactgccactatgcctctgctcgccgtgcgctctggtctcgcgcggcctatgaacggacccgtgggggcaccagcctcgacgacgatgcatgggccgcccagtcggcgtgtcccccctactcgtgactacgctgaggctactcctactgcatcctgcttggagggggggccctactacttctgggtgtgctgagtacgagccaccatgctaccaggccctccggcaacagggctgcctgcagctcatcaggatgatggacgtgcactccgtccccctccagctgcatataattatgcagctcgagcgtgccgctgccacctgcagcagcctgtacgagccaactctgatgctccagcagcagcaactgctggcagcccagggtctcaaccccatggccatgatgatggcgcagaacatgccagccatgcgtggactctaccagtaccagtaccagctgctcagctaccgcacca

SEQ ID NO: 56986 - protein, 128 aa, Zea mays
  misc_feature: Ceres CLONE 1501636
MGRPVGVSPLLVTTLRLLLLHPAWRGGPTTSGCAEYEPPCYQALRQQGCLQLIRMMDVHSVPLQLHIIMQLERAAATCSSLYEPTLMLQQQQLLAAQGLNPMAMMMAQNMPAMRGLYQYQYQLLSYRT

SEQ ID NO: 56987 - DNA, 684 bp, Zea mays
  misc_feature: Ceres CLONE 1501638
  misc_feature: Encodes the peptide sequence at SEQ ID NO. 56988
atagctggagctccccgcggtggcggccgctctagaactagtggatcccccgggctgcaggaattcgcacgagaccattacctagaacatcctaatcgaaaaatttttgctcccaacaagtcgtgctccactagggatcctatgccatatgcctcggggaccccccaggtaccagctccagccaggccaacttccaaccctctcctctccgcagggtgtatcatttgtcgagggggatccagtggcgccgcttgggtatcctggtgagatcgaaatctgtctgggatacatggactgcggtcgaagggacaacaaagaacaaggtaatcctctacacagaccccggatttgacaacaccatggccatatgcgagcagcttcatgcaccggaactgcagatgctaggcctcagaactacgttccgtgacgagcacaccggcctgccctcgcgaaacgcgctacagatgttgtgggatggtcaaacgactgacatccccgtcgcatagggatcccatgttacactcaactaagacgccaggctgacgatctcgagctttgtcgcacggaggctgaaggggctgtgtaaacacaggattttcccccgcccgtgtctcccaagcagtaaaaaaacagacgggcatgaattcctttccctagtccgaagctaggcatcccctgggtccg

SEQ ID NO: 56988 - protein, 48 aa, Zea mays
  misc_feature: Ceres CLONE 1501638
MAICEQLHAPELQMLGLRTTFRDEHTGLPSRNALQMLWDGQTTDIPVA

SEQ ID NO: 56989 - DNA, 643 bp, Zea mays
  misc_feature: Ceres CLONE 1501655
  misc_feature: Encodes the peptide sequence at SEQ ID NO. 56990
atagctggagctccccgcggtggcggctttctagaactagtggatcccccgggctgcaggaattcgcacgagaccattacctagaacatcctaatcgaaaagttgctctgtcctctgttcgaaaaatttcctcttgttgagacctggggcatctctctctctcgcccccccccccccccccccctgctcgcggcgcagcggagccgacgcgatgccgccgaggaggaaacggcgagcaccaccggccaagtcgcagaggcagacggagccggatccgctaccgctagtgccccctggcgccgacgcgccgctggaagagcggctgatatggggcagccaacaagaaagcgagcgccggaatacggccctcaaacccataaaagacccggaggctgggaacatactttaccggttggaaatggcccccccccatttttccggggagcaattgggggggaaccccctggcggttttttcaggagaaacggcacaatctggtgggggggccccaaaacaagaaaagaaggggccgggggcaaaataggaaaaaccgggggaaaaggggaaattgggaacccttggcaaaaaaaagggccttcggggggctcttggggggttattccaaccggggggtggggcctcc

SEQ ID NO: 56990 - protein, 110 aa, Zea mays
  misc_feature: Ceres CLONE 1501655
MPPRRKRRAPPAKSQRQTEPDPLPLVPPGADAPLEERLIWGSQQESERRNTALKPIKDPEAGNILYRLEMAPPHFSGEQLGGNPLAVFSGETAQSGGGAPKQEKKGPGAK

SEQ ID NO: 56991 - DNA, 626 bp, Zea mays
  misc_feature: Ceres CLONE 1501657
  misc_feature: Encodes the peptide sequence at SEQ ID NO. 56992
  misc_feature (624)..(624): n is a, c, t, g, unknown, or other
  misc_feature (626)..(626): n is a, c, t, g, unknown, or other
catagctggagctccccgcggtggcggccgctctagaactagtggatcccccgggctgcaggaattcgcacgagaccattacctagaacatcctaatcgaaaaatgctcgattggtgggagcggtgcctattcagtatccttccgctgcgtctccatccggctcagtttcttcgttaatattccacttgcttgcgaatttctccgacctcgcgttgctcgacaccgtcatcagctagggctagggcttacgttagatccgcgtttgattttgggtatctctatcccgacaagacttaggttttgggtaggcatttgttcgattcgttcttggtgggaagcgttttgttttaccggccaggcaatccgtcgattttgcgcgtttcttccaatttgctgcgcgaggtttctcatccagtgttcctttacatgtacctggattttacgttcctgtgtcattgggatgttctccctttaactagagtagacatattggtgctgatcctgctctggctcgtctgcttcaatggctcccgcttcgcttccgacgtcttcgaaagccactgaaagcgcggattttccaaggctcaaattacggcctggcaattggcacgccctcctcatangn

SEQ ID NO: 56992 - protein, 45 aa, Zea mays
  misc_feature: Ceres CLONE 1501657
MYLDFTFLCHWDVLPLTRVDILVLILLWLVCFNGSRFASDVFESH

SEQ ID NO: 56993 - DNA, 646 bp, Zea mays
  misc_feature: Ceres CLONE 1501663
  misc_feature: Encodes the peptide sequence at SEQ ID NO. 56994
  misc_feature (419)..(419): n is a, c, t, g, unknown, or other
aaagctggagctccccgcggtggcggccgctctagaactagtggatcccccgggctgcaggaattcgcacgagaccattacctagaacatcctaatcgaaaagtccaaaaaaaaaaaatctccaactcgtcacttcgcttccccacttctccattccattgcggttctgcgagcccctacctccctgtggtgcttggccatggcggactaccacttcgtgtataaggacgtggagggggcgagcacagagtgggacgacatccagcgccgcctcgggaacttgcccccgaagccggagcccttcaagccgccgcccttcgccccgaaggttgacgccgacgagcagcccaagtccaaggaatggcttgacgtgcgcgagcccgaagagctcgaggaactagaggacgatctggatgacnaccgcttcctcgagagtacaggaagatgagctcgcaaagctgaaggaagcgcaaaaccgcgcgatttggactatacttcccatcactgggtccgacttcgtggcggaaggattcgcagcccaatcaaatgttggggttgggggccttcctcctacaggatgggaatccctgaagggggattggctccaaaagggtctggaaaaattggcctcccagggatccaagga

SEQ ID NO: 56994 - protein, 82 aa, Zea mays
  misc_feature: Ceres CLONE 1501663
  misc_feature (74)..(74): Xaa is any aa, unknown, or other
MADYHFVYKDVEGASTEWDDIQRRLGNLPPKPEPFKPPPFAPKVDADEQPKSKEWLDVREPEELEELEDDLDDXRFLESTGR

SEQ ID NO: 56995 - DNA, 609 bp, Zea mays
  misc_feature: Ceres CLONE 1501681
  misc_feature: Encodes the peptide sequence at SEQ ID NO. 56996
  misc_feature (520)..(520): n is a, c, t, g, unknown, or other
caaagctggagctccccgcggtggcggccgctctagaactagtggatcccccgggctgcaggaattcgcacgagaccattacctagaacatcctaatcgaaaaactcgagctcgagcgatcccactcccgatcagcagctgatcgctcactcttgcagctcgatcattctttagctgctctagctctagcctctagccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgcccccgccgccgaagccaaggtggaggagccagctgccccggcggagaccgagccagctgccgccgctgagcccgaagcggcccccgtggcggcggaagaagagacgccaaagaagaagagacggcaaaggaggcggagccggaaccggaagcggcggcggctgaanaagtgaaaggaggaagcgcagcgccccctgccaagaacaaaccaaaccggcagccccttaacccaaagctgctgctgcctcctaaagaa

SEQ ID NO: 56996 - protein, 90 aa, Zea mays
  misc_feature: Ceres CLONE 1501681
  misc_feature (89)..(89): Xaa is any aa, unknown, or other
MATAEVQTPTVVATEEAPVVETPAPPAVVPEEAAPAAEAKVEEPAAPAETEPAAAAEPEAAPVAAEEETPKKKRRQRRRSRNRKRRRLXK

SEQ ID NO: 56997 - DNA, 685 bp, Zea mays
  misc_feature: Ceres CLONE 1501682
aaagctggagctccccgcggtggcggccgctctagaactagtggatcccccgggctgcaggaattcgcacgagaccattacctagaacatcctaatcgaaaagataatttggatgtctgcttgcaaccctgtatagctccttcagtccagcttctactggctggcaggtaggcacacgcataagcgataaggtcggctaagccacgatgtcaccgcgggcgccgtgcctcgtggtgctcccgctcctcctccccctcctcctcgccgctgaatcccacgctacggctaatgcggccggtgacagcgaccctccccacagtgcctacaacatggccggagcagttccacgcgctggtcttcaccaatatcaccgacagcagcgagccgggctgcagctgatcgacctgtactacgatctggcccagagaaagcaacctccaactcatccgggaccaggtcttccgcgacccgatctacaacaccgagtgtatcaaccgcacctcctacttcttcgactcccggtcctggacgaccaatgcttttccccgtgggggatccttgcccccagactgggctcgccgaacagcaccgggctatttaagaacaacaaaacacgttaaacggctttaaactgtccccctttggaaccaaggggccgactttaatgcctggatactaaaaaagg

SEQ ID NO: 56998 - DNA, 654 bp, Zea mays
  misc_feature: Ceres CLONE 1501688
  misc_feature: Encodes the peptide sequence at SEQ ID NO. 56999
atagctggagctccccgcggtggcggccgctctagaactagtggatcccccgggctgcaggaattcgcacgagaccattacctagaacatcctaatcgaaaaaaggaaacagtcacgtctcccagatctaactgccccccgactcacgaatcccaaagcctccatggcgacgcaccgccactgcctcccactcctcctcctcgtggccgccgccctcgccgccgtccctgctcgcgcggcgctgggcggcgggcgcggcccgctgctgggcgggtggttcccgatccctgacgtgagcgactcgcacatccaggagctaggcgggtgggcgctggggcaggcgaatcaccagaagctggccgccgacgggctgcggttcccccgcgtggtgcccggccaccaacagtcttgtcccgaataaactaccgcctctacgtcaacgccgccaacccgcccgccagacctggcccttactccccgccctggaacaaaaaggtctggaaccgaaacccgacaggtcgccccctttaaccaggggcccccgcccctggaaaacctacccccccggggggggccaaacaaaattctcccgaaaataaggggcaagataacttaaatgggcgccccaaacaaaaaaaaaccccccccctgtcc

SEQ ID NO: 56999 - protein, 85 aa, Zea mays
  misc_feature: Ceres CLONE 1501688
MATHRHCLPLLLLVAAALAAVPARAALGGGRGPLLGGWFPIPDVSDSHIQELGGWALGQANHQKLAADGLRFPRVVPGHQQSCPE

SEQ ID NO: 57000 - DNA, 629 bp, Zea mays
  misc_feature: Ceres CLONE 1501691
  misc_feature: Encodes the peptide sequence at SEQ ID NO. 57001
cccccgggctgcaggaattcgcacgagaccattacctagaacatcctaatcgaaaactctacgccagccttgccgagagcccgagaccaatcgccgccgtctcccggaatgacggggtgacgaaaccgcgccgcaccagacaagacataggagccgccgccgcgacccacaggccaccgggtcgcctaggaggggatccagcgagccatgtcgaccgacgtgcccatgagccccgagctcgagcaggtggacggcgagatccaggacatcttccgcgcgctccagaatgggttccagaagatggacaagatcaaggactccagcaggcagtccaagcaactggaggatctcacagccaaaatgagatgacccccccccttgttcgaagagtttgaccgctttctcaaggatggaggagaaaaagaacacccctgatggtaacaagcagctcaatggacaagaagcagttcatgatcaaagaactcaactccctatgtgacctttaggaaaacggtccatgagcagcctgtgggaaataagaaggatcctaactatttcagatccgggtataatgaccaaggtggcctgatgggaaacctccagtgtccaatcgggccatcagaatatgg

SEQ ID NO: 57001 - protein, 53 aa, Zea mays
  misc_feature: Ceres CLONE 1501691
MSTDVPMSPELEQVDGEIQDIFRALQNGFQKMDKIKDSSRQSKQLEDLTAKMR

SEQ ID NO: 57002 - DNA, 672 bp, Zea mays
  misc_feature: Ceres CLONE 1501692
  misc_feature: Encodes the peptide sequence at SEQ ID NO. 57003
  misc_feature (626)..(626): n is a, c, t, g, unknown, or other
aaagctggagctccccgcggtggcggccgctctagaactagtggatcccccgggctgcaggaattcgcacgagaccattacctagaacatcctaatcgaaaaatgtactaccagtctaccacgcggtccacgcgttaacatggttacatgcagggtgaccaggcgtcgatcgtggctggtgccatcaacttcgtcaaggagctggagcagctgctgcagtcgctggaggcgcagaagcggtgcaccgagccaccggcgccggcgccgttcgccggcttcttcatcttccctcagtactccaccaccgccgcgacgggtggtgcggttggctctagtagcgacagcgctggctccggcggcgatcagagtggcggcggcgggggagcgcggcgaggcgtggccaacatcgaggtgtccctggcggagagccacgccaacgtgaaggtgctcgcggcgcggcggccgcggcagctgctgaggatggtggtggcgctgcagtgcctcggcctcaccgtgctccacctcaacgtgaccaccaccgccgaccacctggccttgtactccctcagcctcaagatggaggacgagtgccggctgtcgccgtcggtcgacgacatcgccgccgncgtgaacgagatactcgccgagatctccgacgagtgcgcccgccgg

SEQ ID NO: 57003 - protein, 175 aa, Zea mays
  misc_feature: Ceres CLONE 1501692
  misc_feature (160)..(160): Xaa is any aa, unknown, or other
MQGDQASIVAGAINFVKELEQLLQSLEAQKRCTEPPAPAPFAGFFIFPQYSTTAATGGAVGSSSDSAGSGGDQSGGGGGARRGVANIEVSLAESHANVKVLAARRPRQLLRMVVALQCLGLTVLHLNVTTTADHLALYSLSLKMEDECRLSPSVDDIAAXVNEILAEISDECARR

SEQ ID NO: 57004 - DNA, 650 bp, Zea mays
  misc_feature: Ceres CLONE 1501701
  misc_feature: Encodes the peptide sequence at SEQ ID NO. 57005
catagctggagctccccgcggtggcggccgctctagaactagtggatcccccgggctgcaggaattcgcacgagaccattaacctagaacatcctaatcgaaaaattttatacgcgcctcccccgtcccgtctcgtcccctctctctctctccctctcgcgtctcgtcttggccactcaccccacccgccccctctctctttctctctctctgccacagtgcactgctcagtcggcagtcgcagcgctgcggctgtggttcttcttgtcctgttccgccgcccgcccgcccgctgctactgctgggatagtgaaacctggtgcctggtggttcggttaggtgcttccctcgtcaacgtcagacgcccccacttccgccagcaacaacaccagcagcagcacgatgatgagcttcaggagcagcagccacgagggcttcggcttcggccacgccgccgccgcggccagcggagcgccgctgccgtggtgggcagggccggccccgatgctgagcggcgagccgctggccctgtcgccggaggcccactgccgggacggccgcatccaggccccccagggacctcccgtgccgtcggtcaaggctcctgtactggcaccccagcagccgcctccgctgccggagagggggat

SEQ ID NO: 57005 - protein, 82 aa, Zea mays
  misc_feature: Ceres CLONE 1501701
MMSFRSSSHEGFGFGHAAAAASGAPLPWWAGPAPMLSGEPLALSPEAHCRDGRIQAPQGPPVPSVKAPVLAPQQPPPLPERG

SEQ ID NO: 57006 - DNA, 659 bp, Zea mays
  misc_feature: Ceres CLONE 1501706
  misc_feature: Encodes the peptide sequence at SEQ ID NO. 57007
aaagctggagctccccgcggtggcggccgctctagaactagtggatcccccgggctgcaggaattcgcacgagaccattacctagaacatcctaatcgaaaagagcacagctgcccagcaaactagcagcgccctcgtcagttccgtctcgttcccaacctctcccggattcgattcgattgacccgtccgctccaaatcgaatctaatcagcagttttggagttgcggaagggagaaagagagagagagagagaggagaggggcatggatcaggtgctcaacaaggtggggagctactggttcagcaaaagggccagcaaggaaatcgactccatcggcgactacatcaactcgatctcaagcaacattggagggtcaaccaaatggatggggaacaaaattaaagggaagatgcacaatggcgttgcagatctcctcgaggaatatgacatgccggcagggctctttccccgggacacgacttactatgagttctgtgaagagacaaagaagctgacagagtacatcccttccggcctggggaggtggattccaaggactctcggggctgtgggtcctccacctggggtggaccggctacctttgaaaaagggaaatttttcccacttctaagggctttgaaaaacccaaagggctg

SEQ ID NO: 57007 - protein, 122 aa, Zea mays
  misc_feature: Ceres CLONE 1501706
MDQVLNKVGSYWFSKRASKEIDSIGDYINSISSNIGGSTKWMGNKIKGKMHNGVADLLEEYDMPAGLFPRDTTYYEFCEETKKLTEYIPSGLGRWIPRTLGAVGPPPGVDRLPLKKGNFSHF

SEQ ID NO: 57008 - DNA, 653 bp, Zea mays
  misc_feature: Ceres CLONE 1501712
  misc_feature: Encodes the peptide sequence at SEQ ID NO. 57009
atagctggagctccccgcggtggcggccgctctagaactagtggatcccccgggctgcaggaattcgcacgagaccattacctagaacatcctaatcgaaaaacacagctcaacaaaggagcgcggcggcccctcattccttcctcccacttctctcgcgctgcgctcgcttacctcgcttcgcattccgttcgagcaggggagcggccgtgagaagggaagggagggaattaaggcaagatgttcatcgagagcttccgcgtcgagagcccccacgtgcggtacggcccgacggagatcgagtcggagtaccggtacgacacgacggagctggtgcacgtggccaaggacggcgcctcccgctgggtcgtccgccccaagtccgtcaagtacaacttccggaccagcaccgccgtccccaagctcggggtcatgcttgtggggtggggaggcaacaacgggtccacgctgacggctggggtcattgccaacagggaggggatctcatgggcgaccaaggacaaagtgcagcaagccaactactacggctccctcacccaggcttccaccatcagagtaggcagctacaacggggaggagatatatgcgccgttcaagagcctcctacccatggtgaacccagacgaccttgt

SEQ ID NO: 57009 - protein, 137 aa, Zea mays
  misc_feature: Ceres CLONE 1501712
  misc_feature: SWISSPROT Homolog: EC 5.5.1.4 Inositol-3-phosphate synthase
MFIESFRVESPHVRYGPTEIESEYRYDTTELVHVAKDGASRWVVRPKSVKYNFRTSTAVPKLGVMLVGWGGNNGSTLTAGVIANREGISWATKDKVQQANYYGSLTQASTIRVGSYNGEEIYAPFKSLLPMVNPDDL

SEQ ID NO: 57010 - DNA, 699 bp, Zea mays
  misc_feature: Ceres CLONE 1501717
  misc_feature: Encodes the peptide sequence at SEQ ID NO. 57011
atagctggagctccccgcggtggcggccgctctagaactagtggatcccccgggctgcaggaattcgcacgagaccattacctagaacatcctaatcgaaaattttttcttctcccgtccgcagtccgcttggcgtgcgcgacggctagggcgaccgccgccgccctacgccctacgtccagctgcccatgtcttcttcgggccccttgccggcgggaactcaccagaccaggaatcgtgctggcaaccggcgcaagtctggagatagggctgataaagctaattactcctacaataatgatggagagaagagcaatgttccttcattaaagaaccttcctccaattgttcatcatgaaacattcttcagcaatgctcagaatgactacaatcaaacaggattagtgccttttggagggatgttctggccagtgaggcttcacagcttctcaattgatcgctggactgcctgcatccaacatgtacaatgaccaatataatttgacccctcatagaaaacgggtaaaggattctgggacctagtcggctcccccatgggggtcgaccctgaaattgtccctcttcagatggaacctccctccgaggagagttgcccccgtggccggtggaacaccgtttttccagaaattttgggcgccgcctttgggcgcccccctgggtgagtcaatccggaaggtt

SEQ ID NO: 57011 - protein, 100 aa, Zea mays
  misc_feature: Ceres CLONE 1501717
MSSSGPLPAGTHQTRNRAGNRRKSGDRADKANYSYNNDGEKSNVPSLKNLPPIVHHETFFSNAQNDYNQTGLVPFGGMFWPVRLHSFSIDRWTACIQHVQ

SEQ ID NO: 57012 - DNA, 669 bp, Zea mays
  misc_feature: Ceres CLONE 1501735
  misc_feature: Encodes the peptide sequence at SEQ ID NO. 57013
aaagctggagctccccgcggtggcggccgctctagaactagtggatcccccgggctgcaggaattcgcacgagaccattacctagaacatcctaatcgaaaaagccgtgttgctcgccgccgccccgccgtgttgctcgccgacaccgccccgccggcagccaaaatgccgttcaagaggttcgtggagatcgggcgagtggcccttgtaaactacggcaaggagtatggccgcctcgtcgtcatcgtcgacgtcgtcgaccagaacagggctcttgttgatgcccccgacatggttcgttgccaaatgaacttcaagcggctttccctgactgacatcaagattgacattaaacgtgtcccaaagaagactacactgatcaaggcaatgggggaagctgatgtgaaaagcaagtgggagaatagctcatggggcaagaaggtgattgttcagaagaggagagcatcactcagtgacttttgacaggatcaaggtcgtgttggcaaagatcgagaggggcggttccatttgggaaatatcttgctaagctttaaaaggtggatacatgcgtgcttagattgcttttggtggtttcctctggttgaaaatagggggaagggataataacggatgtgacttggaaaaagtaggctggggggaggaatagag

SEQ ID NO: 57013 - protein, 105 aa, Zea mays
  misc_feature: Ceres CLONE 1501735
  misc_feature (44)..(105): Pfam Name: Ribosomal_L14e Pfam Description: Ribosomal protein L14
MPFKRFVEIGRVALVNYGKEYGRLVVIVDVVDQNRALVDAPDMVRCQMNFKRLSLTDIKIDIKRVPKKTTLIKAMGEADVKSKWENSSWGKKVIVQKRRASLSDF

SEQ ID NO: 57014 - DNA, 658 bp, Zea mays
  misc_feature: Ceres CLONE 1501736
  misc_feature: Encodes the peptide sequence at SEQ ID NO. 57015
  misc_feature (421)..(421): n is a, c, t, g, unknown, or other
atagctggagctccccgcggtggcggccgctctagaactagtggatcccccgggctgcaggaattcgcacgagaccattacctagaacatcctaatcgaaaaaaggcgcctcgagccacttaaacagagcaagccgccgcggcggcgaccgggcgaccgacgccgaggctgcgcgccctgcgccgggatcgagaggggaaagggaaggggaccagccggctcgcttggaggctggagctcggcccggcgggcccatggggggacgcctggtgtccatgctccggtggccgccggacctgggcctgcccagcctggccgcgctgctccccgcgccgcccgcgcacctccgggtccaggtccaggagtggtggcagtggcagtggcagcggtcgcggcccgagcagctgggcgcggcggcccnccggtggcccgagctcgtgcgggacgtcccggtcctggtggacgccgcgctgtggggcgtcgtcccggccgtcgagtccgtcgcgctcgtctccatgatgtgctgcttcttcctctgctgcggctgcacgctctgacgatgggttccgcagtgccgcccgcctgccaagcaaagcaagtactgctgcccgcctgccaattatgggggatgattcctccgtccatccccattggcgtc

SEQ ID NO: 57015 - protein, 100 aa, Zea mays
  misc_feature: Ceres CLONE 1501736
  misc_feature (56)..(56): Xaa is any aa, unknown, or other
MGGRLVSMLRWPPDLGLPSLAALLPAPPAHLRVQVQEWWQWQWQRSRPEQLGAAAXRWPELVRDVPVLVDAALWGVVPAVESVALVSMMCCFFLCCGCTL

SEQ ID NO: 57016 - DNA, 681 bp, Zea mays
  misc_feature: Ceres CLONE 1501739
  misc_feature: Encodes the peptide sequence at SEQ ID NO. 57017
atagctggagctccccgcggtggcggccgctctagaactagtggatcccccgggctgcaggaattcgcacgagaccattacctagaacatcctaatcgaaaaatctgttcccatctcttctgcctccgtctcaatctcgaccggtcaccccatctccaccgccacatccgtcgtcttccgccgccgccgatggcccgcctcctcacgcaaaccctcaccctagcccgccccgcctcctccccctccactaccgccgcatccgcttccctccgtggcctcgccaccaaggtcgagatcatcgagatcgatctcgccgaggaagacgctggctcctcgtcccacggctccccctcctcgtccccgtcgggcgaggcggccgggatccggcgcctggaggaggccatccacggcgtcaccccccccccacgccgcggcccgactggctccccttcgttgcgggaagggcccttctggggggcccccgcttgcaccgcccggacgggggtcgccctagattgttaggccagaatcgcgtcttcctgggggctactcaaaagggggcgtctgggttccttttggttggcccggtccacaaacctgtggggttttaattcgccccctgaaaggagggaggcggccggtttttgttatccaccactgaataagaagggcggggggcct

SEQ ID NO: 57017 - protein, 110 aa, Zea mays
  misc_feature: Ceres CLONE 1501739
MARLLTQTLTLARPASSPSTTAASASLRGLATKVEIIEIDLAEEDAGSSSHGSPSSSPSGEAAGIRRLEEAIHGVTPPPRRGPTGSPSLREGPFWGAPACTARTGVALDC

SEQ ID NO: 57018 - DNA, 787 bp, Zea mays
  misc_feature: Ceres CLONE 1501740
  misc_feature: Encodes the peptide sequence at SEQ ID NO. 57019
  misc_feature (11)..(11): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (787)..(787): n is a, c, t, g, unknown, or other
ggggggggggnggcccgcctctctctaaaaannnnnnnnnnnnggggnnnnccaatactggagctccccgcggtggcggccgctctagactagtggatcccccgggctgcaggaattcgcacgagaccattacctagaacatcctaatcgaaaaagagtccagaccatagcctgcagccttccatccacgaactcccgttctccatttccagccatggcggtgtcgatcgagctcaccaaggagtacggctacgtcgtgctggtgctggtggcctatgtcttcctcaacctttggatgggcttccaggtcggcaaggcccgcagaaagtacaaggtgttctaccccaccatgtacgccatcgagtcggagaacaaggacgccaagctcttcaactgcgtgcagagggggcaccaaaactctctaaagtgaatgcccgttttcttcggcatactggctgctgggcgggctggggcaccccaaccatcgcccgccggtcctggggggcatctacattcgtccacgaaggttccttctaccttcaaggggatacgcccacccggccgttccgggaacaaccgtcctcaaggatgggggggggctcaactgccttgggcggtggcctggggcctgaaccaattggcaacagcattcttttggggatcgaaccgggtttcatccgggaaaaatcgctcctaaaccttgggggttttaatttgtggacccttccagaggggggggttaaacccggacacaattctactcaatggggtccgaagcttgcaaaan

SEQ ID NO: 57019 - protein, 71 aa, Zea mays
  misc_feature: Ceres CLONE 1501740
  misc_feature (9)..(70): Pfam Name: MAPEG Pfam Description: MAPEG family
  misc_feature: SWISSPROT Homolog: EC 2.5.1.18 Glutathione transferase
MAVSIELTKEYGYVVLVLVAYVFLNLWMGFQVGKARRKYKVFYPTMYAIESENKDAKLFNCVQRGHQNSLK

SEQ ID NO: 57020 - DNA, 682 bp, Zea mays
  misc_feature: Ceres CLONE 1501750
  misc_feature: Encodes the peptide sequence at SEQ ID NO. 57021
  misc_feature (529)..(529): n is a, c, t, g, unknown, or other
  misc_feature (650)..(650): n is a, c, t, g, unknown, or other
aaagctggagctccccgcggtggcggccgctctagaactagtggatcccccgggctgcaggaattcgcacgagaccattacctagaacatcctaatcgaaaaattgatggatattaacgaaagccctgtttatctcctattaaatcctacaatcaacctctcccaaaaagatctccctgtgactatctatgagagtgagttgcatgtcatcgatgggattcctcagctcatcttcgtcagatcaaattatacaattgagactgtagaggctgagaggatatctgtggaccatgttgcccatctcaaaccttctgatggtggctcagcagcaactcagttggctgctcatcttacaggaatacacagtgccatcaagatgctcaatagcagggtccgtgttatccatcagtatctcgttgccatgcaaaaaggtgacattccattagataattcgctgcttaggcaagtctcaagcctcgtaagaaggctaccagctatggagtcacagaaattccaagacgactttctnatggaaatacacgacactctcctcatgacctacctttgcatggtcactaaatgttcaagcacaatgaacgagttggtcgagaagataaccccagcctatgaaagacgactagcaggagagnaggtcaaggtgctttcatgtaactccacggcc

SEQ ID NO: 57021 - protein, 192 aa, Zea mays
  misc_feature: Ceres CLONE 1501750
  misc_feature (182)..(182): Xaa is any aa, unknown, or other
MDINESPVYLLLNPTINLSQKDLPVTIYESELHVIDGIPQLIFVRSNYTIETVEAERISVDHVAHLKPSDGGSAATQLAAHLTGIHSAIKMLNSRVRVIHQYLVAMQKGDIPLDNSLLRQVSSLVRRLPAMESQKFQDDFLMEIHDTLLMTYLCMVTKCSSTMNELVEKITPAYERRLAGEXVKVLSCNSTA

SEQ ID NO: 57022 - DNA, 685 bp, Zea mays
  misc_feature: Ceres CLONE 1501802
  misc_feature: Encodes the peptide sequence at SEQ ID NO. 57023
aaagctggagctccccgcggtggcggccgctctagaactagtggatcccccgggctgcaggaattcgcacgagaccattacctagaacatcctaatcgaaaagactagggaatttcatgactgaccatggcaaccatcggcgacaccgtaggattcgaaagtggtctgcgcaactatgcaaggagcccttgtacgggagccccttctctcatcatgaaatgtggatgtaatcgtcccaggtggccgagaacagggagccgtcgggcggcggcggcagcgccccgacgaacgccgcgaaggagatgttggcaatgtctactttgggccaaatcaccccatgaagccacatcgtctctgtatgacacatcaccttgttctttcatatggacttcatcaaaagatggagatatataggccacacaaagcatatccaatagagcttgcccaattccattctgctgattatgtggaattcttgcaccggataactcctgattcccagcacctatatgcaagtgaactaactagatacaatcttggagaagactgtccggtctttgataatttgtttgagttctgccaaatctatgctggaggaactttagatgctgctcgcagattaaatcataaaatatgtgacattgccattaattgggctggtgggctacatcatgccaaaaagtgt

SEQ ID NO: 57023 - protein, 116 aa, Zea mays
  misc_feature: Ceres CLONE 1501802
MKPHRLCMTHHLVLSYGLHQKMEIYRPHKAYPIELAQFHSADYVEFLHRITPDSQHLYASELTRYNLGEDCPVFDNLFEFCQIYAGGTLDAARRLNHKICDIAINWAGGLHHAKKC
